United States Patent 11,781,116 (MAMMALIAN CELLS FOR PRODUCING ADENO-ASSOCIATED VIRUSES) - sequence listing, part 2

SEQ ID NO: 33 - DNA, 1947607 bp, Cricetulus griseus
  modified_base (9131)..(9185): a, c, t, g, unknown or other
  modified_base (85917)..(85926): a, c, t, g, unknown or other
  modified_base (130258)..(130307): a, c, t, g, unknown or other
  modified_base (161268)..(161322): a, c, t, g, unknown or other
  modified_base (179391)..(179629): a, c, t, g, unknown or other
  modified_base (234242)..(234319): a, c, t, g, unknown or other
  modified_base (240083)..(240304): a, c, t, g, unknown or other
  modified_base (248487)..(248674): a, c, t, g, unknown or other
  modified_base (248916)..(249508): a, c, t, g, unknown or other
  modified_base (249800)..(252970): a, c, t, g, unknown or other
  modified_base (253181)..(254777): a, c, t, g, unknown or other
  modified_base (261192)..(261224): a, c, t, g, unknown or other
  modified_base (271171)..(271450): a, c, t, g, unknown or other
  modified_base (350331)..(351743): a, c, t, g, unknown or other
  modified_base (415672)..(415775): a, c, t, g, unknown or other
  modified_base (416570)..(416643): a, c, t, g, unknown or other
  modified_base (418904)..(419165): a, c, t, g, unknown or other
  modified_base (490061)..(491702): a, c, t, g, unknown or other
  modified_base (491876)..(491971): a, c, t, g, unknown or other
  modified_base (492495)..(494343): a, c, t, g, unknown or other
  modified_base (494762)..(495476): a, c, t, g, unknown or other
  modified_base (495871)..(495972): a, c, t, g, unknown or other
  modified_base (541501)..(541667): a, c, t, g, unknown or other
  modified_base (572683)..(572867): a, c, t, g, unknown or other
  modified_base (659578)..(659773): a, c, t, g, unknown or other
  modified_base (685081)..(685182): a, c, t, g, unknown or other
  modified_base (700304)..(700570): a, c, t, g, unknown or other
  modified_base (765272)..(765398): a, c, t, g, unknown or other
  modified_base (765708)..(765827): a, c, t, g, unknown or other
  modified_base (779244)..(780414): a, c, t, g, unknown or other
  modified_base (845122)..(845545): a, c, t, g, unknown or other
  modified_base (845596)..(845965): a, c, t, g, unknown or other
  modified_base (846448)..(846905): a, c, t, g, unknown or other
  modified_base (857354)..(857888): a, c, t, g, unknown or other
  modified_base (858801)..(859269): a, c, t, g, unknown or other
  modified_base (859718)..(859885): a, c, t, g, unknown or other
  modified_base (862098)..(862386): a, c, t, g, unknown or other
  modified_base (862715)..(862796): a, c, t, g, unknown or other
  modified_base (863036)..(864561): a, c, t, g, unknown or other
  modified_base (866239)..(866369): a, c, t, g, unknown or other
  modified_base (902701)..(903997): a, c, t, g, unknown or other
  modified_base (922144)..(922563): a, c, t, g, unknown or other
  modified_base (941416)..(944119): a, c, t, g, unknown or other
  modified_base (1041513)..(1041688): a, c, t, g, unknown or other
  modified_base (1045833)..(1045842): a, c, t, g, unknown or other
  modified_base (1050701)..(1050711): a, c, t, g, unknown or other
  modified_base (1077729)..(1078115): a, c, t, g, unknown or other
  modified_base (1078582)..(1080364): a, c, t, g, unknown or other
  modified_base (1080556)..(1084088): a, c, t, g, unknown or other
  modified_base (1084827)..(1084945): a, c, t, g, unknown or other
  modified_base (1097720)..(1098028): a, c, t, g, unknown or other
  modified_base (1197367)..(1202559): a, c, t, g, unknown or other
  modified_base (1214087)..(1215732): a, c, t, g, unknown or other
  modified_base (1228684)..(1228693): a, c, t, g, unknown or other
  modified_base (1276187)..(1276346): a, c, t, g, unknown or other
  modified_base (1280263)..(1280632): a, c, t, g, unknown or other
  modified_base (1289545)..(1289589): a, c, t, g, unknown or other
  modified_base (1293820)..(1293908): a, c, t, g, unknown or other
  modified_base (1307008)..(1308419): a, c, t, g, unknown or other
  modified_base (1357503)..(1357852): a, c, t, g, unknown or other
  modified_base (1358256)..(1358351): a, c, t, g, unknown or other
  modified_base (1361968)..(1366005): a, c, t, g, unknown or other
  modified_base (1372210)..(1372404): a, c, t, g, unknown or other
  modified_base (1372746)..(1373278): a, c, t, g, unknown or other
  modified_base (1373864)..(1374217): a, c, t, g, unknown or other
  modified_base (1442158)..(1442268): a, c, t, g, unknown or other
  modified_base (1442716)..(1442725): a, c, t, g, unknown or other
  modified_base (1502335)..(1503771): a, c, t, g, unknown or other
  modified_base (1526460)..(1526881): a, c, t, g, unknown or other
  modified_base (1544592)..(1544884): a, c, t, g, unknown or other
  modified_base (1576491)..(1576586): a, c, t, g, unknown or other
  modified_base (1582073)..(1582325): a, c, t, g, unknown or other
  modified_base (1688500)..(1688644): a, c, t, g, unknown or other
  modified_base (1689703)..(1689841): a, c, t, g, unknown or other
  modified_base (1690915)..(1690935): a, c, t, g, unknown or other
  modified_base (1691371)..(1691590): a, c, t, g, unknown or other
  modified_base (1741208)..(1741217): a, c, t, g, unknown or other
  modified_base (1784568)..(1784585): a, c, t, g, unknown or other
  modified_base (1804117)..(1804126): a, c, t, g, unknown or other
  modified_base (1804433)..(1804483): a, c, t, g, unknown or other
  modified_base (1883118)..(1883150): a, c, t, g, unknown or other
  modified_base (1918208)..(1918469): a, c, t, g, unknown or other
  modified_base (1925852)..(1925883): a, c, t, g, unknown or other
  modified_base (1928475)..(1928518): a, c, t, g, unknown or other
taaaaccctacctatcacatatcctttctgcttcccagggagggtgaggacttacataggggtcatcagagtctatcatatcctttgggatagggcataggtccacccccatgtgtctttgctcagggagtatccctctgtgtggaatgggctcccaaagtccacacctgtgctcgggataaatactgatctattacaggaggccccacagatttccaaggtctcctcattgacacccacattcttggggtctggatcagtcccatgctggtttcccagctatcagtctgggcaccaagagctcccagttgttcatgtcagctgtttctgtgtgattcaccagcctgatctggactcctttgctcatcactctcctcctctgcaactggattccagttcagttcagtgattagttgtgcgggtctgcttctacttccaccagctgctggatgaagattatagggtggcatataagtgagtcatcaatctcattatcacagtagggcatttaaggtagcctctcatctgttgctaagattgttaggacatgtcatctttgtagatctccagacatttgcctagtgcctgatttctctttaaacctaaaatgtctccctctactatggtatgtcctttcttgttttcttctattcttcccccaactcaacctttctgctccctcatgtcctcctcacccctccccttctccccttctcattctcctaactcccttcccccaccctccatgctcccaatttgctcaggagatcatgtccctttccccttctctggaggaccatatatgtctctcttagggtcctccttgtttactaacttctctggcagtgtagattgtaggctggtaatcctttactttatgtctaaaagcaacataggagtgagtacataccatgtttgtcttttttgtgactggattacctctctcagaatggtttctctagttccatccattttcctgtaaatttcaagattccattgttttttttcctgctgagtagtgctccattgtgtaaatgtacaacatttgctctatccattcttccattgagggacatctaggatgattccaagttctggctacttcaaatagtgttgctatgaacatcgttgagtagatgttcttgttatatgcaagtacttcttcctcttcatatcccgagtgtccctctttctgttagtctctctttaccttcatccaacatggagtgcttgtcataatttcatccctttttattgtttaataaaactccattgtgtatatatacagcagtttgtttaactgttcatttgtcattttttggtaaggctctttttaaaaaatatataataaatttaatgctgctaatataaggaaatagaattcatccatatgttaaattagagttggaaatctgtctgtcaaacatttttttgattccgaccttcaggaatggggacgcaaaaacctatgaacagggtaagaggatgaacaagtgaagcagagcctcctagtggttataattggaataacagaaatgtaaaaataaactactgactatgaggacccttgcatctactaggaagcagtttgcagagacacacacaggggaatttggggacatagggataaattcacaacactacctccttcaaggattagcagccagggatcaaatttatctgcagtgtcttttgaggatattctgtctccagtacacagctcactcatatcccatgttcccttgaaatgtgtcgtcttagatttgctttaggtccaacacaatgcacttgaattcaccttacttgacagagttcttgatggttgtttatttttttatttttttgtgaagctaaactaaatttttaactgaaaattaccaaccaaaataacactgatcatcctacagcaaaagataccaagaccaagacattttttattattgtccatattgagataatgatgccaattcccccttatatctgttaatgtagcatattgcaatcataggttttttttttaattggaacatggccctcacttggtcatgaacaacattagattttagatttagcattagtgtttagtatagaactgtcaaagcttcagagttttctaaaacctcatttctattgaaagtaattatatttactccagtacatttttctttatatttttacaatatacattcctatcccctgacttgatgttgatgtaaatgaaaaacacattttgaagtccaatgaatgcaaggttccctgtgatgtgtagcagggcacagtcaatatacagggaccttgaaagtcagaaagtgggtggtaaggctgacagaggttacatgagtttctagaaataccatagcaaaatgccacaaactgagtggtttaaaataacagaaagtcaaggagttaccaggtctaaggtatttctgagactctagataaaatactttttaagatcttctagcatctaatgtttacaacaatccttaaagattttttggaatatagagataaacttccactgcatgattattttttctccaagtatgctcttactgtattctctctatgccccagtcacctcttgtgaaagagactctatatattggattaaagatgcctagatattcttcttatcattttgttcaacctccaaagacattttcccaattactagaatagtaggatcgtatgatatcttctgtggcactgtatgtcccattctggtggttctataatgcccaatcttaagattttgtttcacatcagcaaaaacatgaagtaagggaaacatgttcttagattataccatatatcaaaaatgtttttaaattctactcacttttcagagaaggtctggtacccttgtctctccatcacagtagctacccagaatccatcatccgtatatgttgattatgacttataaatgtgtgtgtgtgtgtgtgtctgtgtgtgtgtgtgtgtgtgttgtgggctatttgtacactgtgaagttgtatttcagtgataggtataataaaaagctgagtgaccaatacttagggatgagtggcacacaggacttttgggctgagagagaatgcttggaagaagaatcaccagccagacacagaggaagcaggatgaacagtacagagtaaaggtaaccaacccaggtaaaagaatgtagatttggagatatgggctaatttaagttataagaactcctgaagaacaagcctatgctaaggctgggctttcataatgaataataaatctccatgtcattatttgcagtctggggtccctagaaaaagaactactacatatggtatccactgtggggtatgtattttcacataggactcatgaaagcgtaaaaataaaaagttctaaacatacaaacacagagtcaaatatggcttcctagtccctagtttctcagggaggccactggtcatagagatgcagctcctgattgctgcttgttggcttgagccagccaactacatgtgctgagataagaactgtgtttaaggcttggctcatgtggtcagagaaagcaaaaggtaggcagtaaagcagtccagaccaagaaaacctttaaacaaatacagtaaaagatgggtatagacagtcacagaaagaaaacaaatagtttaaaaataatagtctttaagagaaaataaagtaaaataaagaaaagccctataaagatggtaaatacacaggtcatctggatcctgtatggtgctttgttgaatttgaatgttttgaatgctgatgaccaaagagcagctgctgagagaaattgaattatgaaagggattgatgatttaaaccaccctatgtactttagacatgtcttggtttcagaatggatgtaataaattatgatgcattagggaagtggttatgcctttgtttccacaggaaacaaaaagttatagttttcttcaaaattaatgaagatcaaatttgatatgagtgaggaagccaggaaaaagtacaggacaaatgacatatatgctgatcttttacatggaagaagttctaatactgagacagacatgatcaatcttgttggctacagaatcctcatgacttactattatatgccatcctttcaaatagcatggatagagatttatattagagtctggttatgcagtctagactgacttataaagttgacaggtgcctattatctgctcaaacaaaaaaacagaaaatcatctttagatgatttatgcacaatgcacattccatacttgtgttaatgcagatatatgtagcattaataataaaaacccagagacagatattggggttcaagctgaagttcagaaaaggaaagcagccaaccactaaaggactcttatttctaccaaggggcaattgtgtcctcaggatgacttcagactgaatacactgcactcctgtctccacctgccttatattcctctctagtgatgggattaaaggagtgcatcaccactgcccagcttctacggaaaacgagtgtggctattaggattaaaggtgtctgccatcactgcatggcctctatggctgactagtgtggttagctttgcactctgattttcacacaagctttatttgtgagatcataaacaaaatatcaccacagatgcatgtgttacctttagaattttgtgtattttgagaaaacaaggaccacacaacaataaagacaagcagcccaggttaccagcctcttaaaatgcctctgttacagtttcctcaaaattctgcaaccagaacaatgtcaaagatgctaactgagatggtccagcctcacagactatccagccaagatttcagataagctctatactttccactcacacagaggctaagcaaaaataacacaactagttctcccatgacttgaccatcatcccagttttctcatggtctcctaaagaagccattatatcccacatatcaggacatatacagaacaagatgcccacattctgaagagctgaggtggatggtttttagtcattctgtagtttatggatatttgtcatcatttaggggaattagttacaagttgttattggtaatggtgaggaaaacagctgaacagagagattagattcagggatctctttcttagggtaaaaagggttatagtatagagatgataggatgaaagggtggattgtttccatctacttttgaacaatctctagtctcaaatattttatattagtatagacttttgtatattgatacaaatgtagggttatttttattatactgtttgtgtgtatctattcttgtttacagtattgtacctatgaagctcatctaaaaatgtaatgtaaaggtttagttcttgaaaactgtttaagataataaagacaggttagtagttagtcatctataataatcaaatatatacccatgttataaatgtttccaaggtcaaacagagatatgttttaaattgatagatgatcttcaaacacttcagagatctaaagaatatggcatttaaagtatttaagtaacacaaggcttttcatgacaatgagacacatctgctcctgtcagcaccaatttacttcaaaagaggatgacagtcatcgaagtacatccatattgagtttactttcatttgtggcaaagttagccactgagcaaagaaattgccctggatttgagtgctgacagaatgctacccaaattagacaagcaggacacaaaagaaggcaactgccaaactttgccaaagcaagatagaatagtccttcaaaatccctgcttcacaaaaaagtctgtcagactgagatggatgtcccaatgttgttgatgaaacttggggtgactgtcctggcatccagatagctctgttgtttcttagttttggaagttgattgctctgcacttcctgtttaaatggataatattgcatcctccttgggtatctgacagggttaaaaattatatatagttacagttttctatagttttgataaaaagtgaaacagatacaaaacattgcactcactaagatagaatagataacagattattttctctgaatttaccaaatactaatggactgaacattgcaaatgtattgcttacttgataattgttctcattgtatataactttactctgttagagttaaaaccttcccattttatttatacacaaaaggaaatcttgtgtgatagttgtacattgtgaagatgtatttctgtgataggtataacaaaatgctgaatgtccattagtcaggagagatggggggacttctgggcagagagagaatgctgagaagaagaaagcagagtcaccagcagacattgaggaagcaggatgggcagcatagagtgaaggtaaccaagccccctaaaagaatatagcttgaaagatttggattaatataagttatacaaacagttagcaacaagcttacgctaaggctgagctttgataattaataataaatctctgtgtcattattgttggtctggcagtcctgacaagaaagaactacaactactattactgctactacacacacacacacacacacagagagagagagagagagagagagagagagagaaagagagagagaaagagagagagaggtagtctcttttcttctctcatttatagacaaactcataaaaatattttatgcatataggaaaatgtaaattaaaaaggaaactttagaagagagaaagagttgatctctacaattaagtagcttcaactcatgtgaatattctccccaacacaaagaaatttgttcagaaaattcacactaatctaaggtataaatgttattttcatgctactgtgaaagcagagtgaaaggaattgatctattttatagttacaaagcacatctggaggaaaaatcattatatctgaatattacagtataacctgcaaccattttccttctcaagtgcattgtctcaaatgtaaaatccccattgtattcttaactagctacagagacttggctgtgaagaaactcaggtaaatgactcttgcttgactctctacctctttaattgtactgtagacttctatcaaatgctgttgaggacatgtacctaattgattagtaatcttgcttaatcttgaacaaactttaaaatgaaaatattctttcacatattatttaccaagcatataccctactattaataaagtatggaagataatgtgcattctttacagcccctttcaaaatcttttattccttattttattgaatataaatattaacagaatagattcaacttaagatacagtcatgttaagttagtatgtcaatatatttcccttaaatataacaactattgtaatattcttctctgtttcagataactattaatttggatcctttcttttccttttattgaaaatatattttctcacatatatatcctgattacagtttcccctctttctcctcccaggtcctacctatctcccctccatccatatctataccttttctgtttccaattagaaaacaagaaggcttctaggggataatgataagataaaataaaatatagtaagataaaacaaaaactaatatatctgaatagggacaaaagaaaagaaaatgagaccaagaaaaggccaagaaacagatgaagatagacagaactaccagttcccacattcaggaatccatgaaaatactaaactggaagccataatatatactcaaaggactgtagtaaaatggagagaaaaaaatttaaacaaacaactctgacgctgtaggaaaaactgtggccagcctacccaagcatcagtcaccctgcccaggtgcagccgaggccagccctcatgagcatgcacagctggaacttcctccctgagccaagccttcccctgtgcccacagactgatgactaagaaacacctgacccagagacaccaatgaggaaaggacaacacagcagagtcagcttcctgacccaatgggaccttgggaggggggtataaaggaaggtgtaatttccttaataaacaactatgcagcacgctctgttactcactgactccctgtgtctgagtactgaggcattggtgctgcatcttctcacccactcccccaaggggtgtctgagcaggatcaccggcaacactgacacaacataataagtcaaggaccctccaaaggtaatagtaagtttattttctgttgtctacctactgctgggcatgtagtagtttgtttccccagtgagattccattggcagaaactaaatttccattttcatgtgtttactaattacaggtagctttgggttagggattggggactgtgtctatttctcctttcatctctaggaccccatgctgccttagaatctgtaagttaatatgtgctgtatttagaaggccttcttttcttggtgtcttccatcccctctggctcctacactctttcagaattcttttcctttgtgttcactgaaccaagaagggagagatttgagggagacatcctgtttaaggttgagtatccctggattttaactctctgcacaatgtctggctgtgtgtcactatatctgtttccacctgctgtaggaggaaactttgatgatgttgaacaaggcactgacctatgattacaggataatttcattaggcatcatgttattgctacattcttttagtataacagtagtatttttttttaccctagttctctgggttatctagtttcacgtccttggtcaatcaaaccggggtatggattccatctcatggagtggaccttaaatcaaatcagatcttggctggctagtcccacaagtttgtgccaccattacactagtatatcttgcaggaaggaaaccattgtagaccaaagggttagtgactgggttggtgtttccatttctcctttgatagtttcagagtacttgttttggaaagacactagccagtaagggtgaaagctctatgtaagcaccagctagatgtctccatatttaatgagggatatatatatatatatatatatatatatatatatatatatatatatatatgtttttcttattggttaatgaataaaacactgattggctgattggccagagaggaagtgaaatannnnnnnnnnnnnnnnnnnnnnnnnnnnnnnnnnnnnnnnnnnnnnnnnnnnnnntttttcctcagcagctcaacctctctatatatatatatatatatatatatatatatatatattataagtctttaataactttaaatcagaattatttggtagtactaatgtaccatttctacatattgagtgataagatgttaacaatctatccttaactatacagctaaatagtcaagactattactctggccaaatatgatttaaaaacagagagagaatgatgagcaacagaataatcatgttaagtcaaaatcactgaaaattgacataatttctatcatgaatataagaaaaatctgaattattcattggttaaaaaaccatgtattttatgaattctcaactacaaggaactaaaacctctgagactacaatagaaatttaaacatgagagactggcttgtttctgtcaatagaatatttgttgggaaatgtttggtttcaaataataggagggtaataaatctgtaacgtcagcggtctgtgagggcactgctattagaagccaaaagaggagtagacagttcatatgaatacttaagaagagaagcagaagtaaagccagaatttaagaggaaactacatttaaggatcaaagggaaatgtttatgggacattcaaagttttaaaacagggagagagaaagcatcatataaaatgttaaccggagtgaaaggatgacaaggacacttagcaaatagggaaatataaagaaatagagatcacttagcagcataccccttattgtttatacaatatcattattagcaaaatggaatttcagtgaactgtaaaatgccatggggtagcaattggtttatacctcctaaggagaacaaaatacctggatagagcagaagtggaacaataaagaagcttctagatcaagggagtctgacgcattggtgagatttaataagtgccagttgagaaaaggttattgaattttaggaaggcaggtggtgatattaacagaatgatttcagtagcagggggcgttcacaagctggatttgcaagggattaaaatggaattgagtagaagctgtgtcccaggtataggtcacatatttcaggggtagataggcaataagaagacacaggaaatacgattgtccccaatacagaacttaaggagaaatccaaaaggcaagagtggtcctggataacaaattgttggacataacttgaaaatgtgatctcgaatgacagccacatattttattgagtagctttggtctccagaatgtagtttctgcactcgagctgtgtaaaatctatttagcgaagaaagcaaatggtgacagttgtatacaagcttagcaaatcatgtctggattagggacaagtgattggagcaaagacaacacaaaggagaggagcctaactctggcaaaggtaactgtccggttccagctccagcatgctagaggtggagacctgcctgaatagcaggtagagatgagtatggtttcgaagcagagaggagagtttttaaccagtatgtgggatagagaggcaaatgaaagggttgtatgagttttatatgtaacacaaggaaatgaaaccagaagacaacagctttgcattattaagcaattttgctcaaggtatggtcctgtccatcatcatctcaggcctggtcttacaaagtgggtttataaattactaataaattattaatttgtaggttgtgagttgttatctaccaaagggactgatcaggtttccacaaaacagtatgctccagagtaaggcctctctcgagctcaaggatatcatctcagggtgggctttctcaaaggtactcctgttcttggaacttgatgtaactgcaggtacaggataacagcatcttcttgcttcatgggatggggtagataatgtgggcagatactccttgagtgtttcacatgaatcagagacatcaggcttccatcttggttttagttacttgtgtattcaaaggaggacccagctgcagagtgcctgtcccagggggatagaaggttgagtgctgaaagttctcccagaggaggttttcaaaccaaagaagatggaaggtaaaggcagaaatgtaacaataagtctttactccatctacccaagccctgccttggggtgtggggtgatcccactcctgacaccagattttgagggaattaccaataggatgctacacctcctttcctccattgttatcactaacgataatgtacatctagttagggatagcttcctattgtttatggttggattggaaggaggtgttcaggcttggacacctctttcagatgactttagggtttagttaaaatagaaatagataggtggtgacatagcagaatattgtatctccttgtatttcacctttatgattattagttttggatatgttaagttttaatcctcttttaaactaaaaggggaattgtagaggacattgtaacaacacctgctcggggctggctgcaggtgtgcctgaccatgcctgctggaggaagatctaagagtgagcggcaggcacatggaagccccttcttcttccttttcatcattggcttgctctacttattccatgccctgccagctggctaggttgctctgtaagtaaggcatttctctaataaataccctaatatctttacctgactctgtgctggtaattccctcattatggaaatgaggtgaaaaatagcatatgggagttatgtctccagtaagaggagactaaagagaaatgcagtggatgaggtcagtgtgggcctccctggtgattcttctgtagctgatgaacactcaatacaggatatttggtaatcaggttgcctggacacaaatcaaaaatttatggaaatttttagctgatcaagaatttgttttttatctcccttggcagaaaaaaaaattctcagattttccacaaaagttgggaagagcttttagacaatgaattttatattagtgactatgtgtttcttgaacttactgtggtttaatcccactaatgaattaaaacaatgtaaactgatgacagagctatcctcccaaagaccccagagcagtgccttttcttgcttttctagtttccagacaccatccacattctttctccatggccctctgtatagacaagttatgatggagggaattgtcagttctaattctgccatggatttttctatgttggtgatgggtaagtgcataaaatatattcagatctggaagtgtaaaatttaatgggaagcccctcagcttccattctgagtgccaatccaagctatatagaagcccacaaaattctacagactttgggtctcattccttttggtgtgtgatttttttatttatttgcaaatatttttaataagaaagtttaatacaatttttaaaaaaggtagaaagaatgaaagaaaaaacagaagattgtgacacaatctctggattaaccagtgagaagaattcagcaaaagccaaatacagagatattgtagccattatctatgacaatgaaagtgttgaaaacactgaaaccgagccagtgcaaccagacatgacaacctgggttttatcaatagtatccacattgtggaaggagaggaaagactcccacaagttgtcatctgggttccacaagcatgaacacgaacacacacacacagtgcatttttaaatgtggccaagtagcccactattctgaaatggaagtgccatcctagtggcattttacacatagtggtattaattccagtcatttaggaatcaatgtttgaaggcaaaagacctgcattcatatgggatgttatccattacccacttctccaagggacatcattatttcttgcataagtaatacagaatacatacattcaatatcagtgcaataattgataattttaatgtaaaggagatttacaaactttagagctttgtacatgttgattgtaatggctttgtattgctagactggggttgtttaggttgtgatgtataaggagaaagactactacttttgttctccaatctgtgcctgaagtatgacataaaggttttatagaagtaagaggattaaatcagggactattttgacatctgtaatggaaatagaggaaggacaagatgaagatgtaggcttggatgaagaactgtaaacttcacaaaaagcactgcaatgaaacctaacaaggaaaaatagccctaggaattaatggtatatttgttgaaaataggaacagaaataaaggtgaacctaagacatgaaacagatattttgaagtaaggttatcacactgcaaaaatataactgaagggtatgaagtatgagtatgaagatttgaacatacacacgcatacatatctatttctatagctatctatctatatatatattatatatatattatatatatagttctatgaactatatatgagacactgttctatgaagtgaaattgagaaagaaaatagatgatagattagatatagagttgtgtaatagatttaaagtagatataggtagataacagatgatatattcaacaagtagatgataggtaaagaatagatgatataatagggatagatagatagatagatagatagatagatagatagatagatagatagatagatagatagatccttttgtttctttgtttctttgtagccattgctataacctctctgtggattttcatgtatctaaatttttttattaaaacaagtttaactggaagccctgtgtctgcttgctcttgttgttgaagaattatttctgtcaagcatcattttatgaacccttttcatatagtagaaactgaacaagcatacaaattaatcaatcagctacagtacatattaggatttgtcttacagcaagctattttgtagggattaatttctcctccataaagaagtaggaaccatttctactctttttccatcactagtattttcctataatatgatgtttaaactcctggtccttattgtttcctcagttgtgttaagaccacatagtatcaagaacaccctttatctaatcataagaaagtgatgaaatttttaacttccatagagggctacatattttaataaaagttatataattaaatttgtatatcaggttcacctgaggaatgttctgaaatcttattatgtataaggctgctagcatgggaagaaggaaggaaggaagaaggaagaaaggaaagatttttatagaaatcatttttttctctcctatctataaaagcttttactgttgccacagtataacagataaaattgcctttttaaaattgtatttttacaattgcctgccacaaattgtcactgacactgaatacacaatctatatttttgcttcctccagcactttactgaatttatattgtaatatgagttgaaaattaggcagtggcttggctagataacttgatagacagttcttccctttgcttctacgaggttggaataacctaagactaacagtgggagaattcacaagagatgcttctctttacaacatgatacaacattttctttctatttaccagtgagaggcacctaatgaaaacaacagagtgcctggcagaatcagagatactccttcccataggaaataaaagaaaaacgcgagattgcttgaatacattttcagaaacattagtcttttcattccatttcattggaaataaacaaggagagatctttgtgagatgcagtggtgaagaatgaactccagtagcaagaccaaatcattagcaaatggtccagtcagtgggaaagccaaaactagacagtagtgaaggcatggggagataggggttttcattatagctgctggaataggctggggataggaatgtcaacaggaactcatgcagataaactggtgtgttgctagaccacaaatgaaagaactacataaaaaattcctcactaggctagttctccaggcagcttcactgtttgctctcaagtctcaagttatgatcacttactcatctgagttctaagcataccattgcagattcagtgatctctttaactatgacctggccctctccaggctctgcattagattgagtataaagtctgagctttattgttaaagaatgccttgaagaaagggatcctgctccacacagttcataacttcttcagctcccttggcatctcaggacaacaggcaaaggacacaaagtctactagaggcttcatttttcttcgatgcctattaatctcagaagatctcatggatcaatttttttcctggccacttgtggtcagagatgatttgaaaggcagggtttttccaatttgattcaaattgtcataatgtatccagaaaattagtgtctagactaaaatgatggtaattgttaaggtcttcaaagtagaagtttttgaacttgagttcattcatgtgtagttttctattgtttcatttagaaatattttattgtacaaatctaaaacatgtaaaggttaacattacattttcaaaacattaactttttaacttttacattcctaccatcctttttctataatgattgtgtgtgtgtgtgtgtgtgtgtctgtgtgtctgtgtgtgtatgtgatatgtatgcgtggggatatgcatgaccatatgtatgtgaacgtgtatatgtgtgcatgtacatatagaagccatcttgccatcatagactgttttccttagttgcactctagttattgaagcagggtctcatgtttagcttgtttccctactcatcttaccccagtggtttttcctttctgcttctcaagcactgtaattacaggtggacaactgtgcctctctggcctttgtgtgggtattgaaaccccaaactccagtcctcacaattggagagcaaggattttatattcttgcctcagttttgttgtcttaatgtggtcctttttaaatgagtgtctacaaacctaagatcaatctcatttatgaatgtaaggctttgattttcagagagcacacattattatatttgtgtgtcaaaataaataacactcattttacatactttcattttccactttaagtgaaaccaaaatgtattataggctattgagcatcagagtgtcttgaaaacaaatatttcaaaaagataaaaatcaagaaattgagcatatttttctatatactctggacagaatgagctgttgtgatttgaatgtaaaatgttctcgtgggctcatatgccgagacacctggacacagctgttggagctctttgggatttttgtggaacctttaggaaatgcagcctcactaaaaaaaaagtgtgtgtgtgtgtgtgtatgtgtgtgtgtgtgtccatatcataaggcccatactgaacaaaaaggtgaggcaggatgagcatgagtgagggtcacttctaggaccaattactttctgtaatagagaagtgttgaacttctgttgacctttgatgtgaagtaagagttgaaaatataaacaactgtacaaaataaaatcagggtctatttactacagagtagtctagttccttgaataatgctacctaacattaaatgctgcttttcctttactgtactttggctttataactacattggtattagtccccaaagtaagtgcccatcatccttaaaacagtgatgatgctgaagcaaatgaaaaagaccaaagttccactctggcaatgatgtaagcaaaaaggggaatagaccatttgtgctttcagtaaaagttatgactttgaaatgaaacaaaaatcttagtagggggtcttgtctagatcattcatctggtttatatccacttttcatcatatataagctgtttaagaactgtgagttacagaaaacttataataagcaaacatcaaattttgttatctctggtgaaatgcaattgattaattccagtggctagatggctgcatcttcctcagagcattagagcacatttgatgggtatgaggaaatagttctttaaagtcaactttcagtaagtagtagcatcttaataatacctcattttttaagttaaatacatttaaacttattttactaagagttatacttttgcttgaaataaacaatgctctttaacaaaaacaaaactctcagaagtgaagtttgagggaaagattggaattcatctgcattcagaaaagaacaagaaaaaataactttggtaatatctaagatacataagagaaaatccacctttaaaaatataaaagaaaacagagttactgagagactgtgggtgaagacacataatacacaagttagggtctataatgcatagcaaatgttgggagagtctttcatcctgttcgctcttactgtataacctttctccaatatctaaacaatgttttattattcctcttttctgtagtagtattcaccttggatagtctcaaaaactctagctcaatgtagcagcataggtcagggcttgcaaactttttctacaaaggttcacatcataaatattttatgtttttcaggccatatggtctctgtcacaactattcagcttcctttttggagcacaaaagcagctacagataatatataaataaatgaacatggctgtgctccatcaaaatgccatggacgtagaaagaggacttggctcatgaggcatagtctgccagtctttaatatagaactattaaactgatgactatgcagaagattttgctctataattatttattatgtattcatgagggatcatagagaattctgtgcttgttatggctttaattatgaaatcatattcatcccaaaaatgtaacaaagaattaccaatagtcaatgtaaaaatctttgactcataaaaagtaatagccacaaataagtgactataattaagatatagggaaagaacagtgtttcatgatattttgtggagacatgagcaagcatctgttcacttcaaattaaggcaccaatgacatccgcaggaatgattttaccaatgtttagcttagcaacccagaattcagagttccttaaagggttatttacagaatgatgggccacatgggctgctgtgtcactggaaggcccacattagtgtgggtgatatgactcatggaagccatattacctgagttccatgcccaatcttcaagcaactaaaccaaagagtgttttctcccccaacagttgttactgatttatataaccttggtgagaagtcccaggagtctgtatgcttcctcttgacccgcctatgcccaataagttctcttctttatgcaataaggccatgctttgatttagaggaagtagctacataacacttgttttctttctataggaaaaccaaaactgcagtagacatgactattcttccaaagaatagaatagtagatataattttaaggctatgaagctgagatttatgagtttggtccacatcttgtcacagatctgaaggtagaattaaggacatattttctcagatttatttctcattattttgtaattatgtgtaatgagggaatctatgtgcacatgaatgtggattcctgaggattaaggaagaggtattggatcttttgaagctgaagttacaggtgatccactaattaaatgaacactggtgctgcaaacagaacccaaatcctttgcaaaagcagtatgtgctattaagcactgagctgtctcttcagttcccatatttatcaagtgtttgtgttacatttttggtataatacttaaaacaatgctgttttgttttataatgactttcacatttttgaaatcataatataattacatcatttccctccacttttctccctcccacctctttcatgaaatttcttaaaatttgtgacctttttttctttaactgatataccccaatacataaatacaacctgttcaatctgtacaatatgatttatatgcacatattcttagggctgacaatttgaaaatgtaaagtcaattgaagcttagtttccttatgtgttatattttgttgtgtatcatttgaaataagttttagaatgaagtttaaaaatgaacatctttcattttgcttattgtcaaacattttccaaattagctattcacttttgctttacctagctgaggaaaaagccacttctaatgtgaggaaacaatgacacctgcctgccatggggccagggtctatgaaatggttcctatgcctaagtcttttagaattactgaggcatgaaaaagtatgaacacaagtactcttgtgagcaccaaattgcaccacttgagtttgtgctctacagcattggaaaacttgattaaatttctcccacttttctacttaacatgcacagctttttttttttttaaccacatgactttttgttgttgttgttgttgttgttgttgttgtagttttgagacagggtttctctgtggctttggagtctgtcctggaactagctcttgtagaccaggctggtctcgaactcacagagatctgcctgcctctgcctcccagtgctgggattaaaggcatgcgctaccaccgcccggaaccacatgacatttttattgattctctgggagtttcacatcatgcacccagatcacaatcccttcccagtccttccgtggttgccccacccccattccttgtggcacctcctcccccttgaccttcccctgaaaagatgtaaaaaaaaaaatcaaaatttaaaaaagggggaaaatacaaaatccactttgtgctgtctatatactcactgatgaatcgtcaaattcttagtggcctgtcccttcaacagaactgagtccttcccatcccacacctctgtggagagctctccatacttaatagttaatagttctctttagtggcttcctatctaagctttcaattttcttcaggggaaggtgataagggggtaagggttgtcacagaagccttccatgtctctctccctctcaactgcatctgaagtcatcgacatcacggcgaaagtgtctctttacatacagcaggaacacagattcggagcttctacttggtttctggagacaacacagaccacgaactcatctgcctgcttcagcgggaccgctgatgttggcaagaccctcaaaggcagcaggggccacagacagaggtcagcatagcttcaggtggcagcgcaagccactcacatcaatatcaatatggttcccagaggcagcatgccccaccggcatagaggtggctttaggctgcagcagagacgagggcatcagcatggcctttggtggaaactcaggaccacagacagcaagcatagctttaatgactggaaagtccctagtttttaataatcatattcttgaagaaccttaagctcatattatgaaactcaaaataaacaatacccttattgttattgcaaatgggttaaatatacgagttaattaccagaggctatagaagctgaactgtagtttattatttccgcttactagtaggacatatttgttcctaatgccagctttccttttatgattttggtaaatccacaaggttttcttcagagaagtcttgcttgcttctgttaggtttattgctagaaaattttatatttttattggtttttcaaagggtacttttttcattatagttcctaactgcctatacttaatatgcacacataacagcttttgcctacttatttataagtggcttgttttttctatgaactcactgaaaataataactcaaggacactataattcaaggtttctaatcctagcaagaatgtttcctgttgcacctaaatttccatttcatttcacttcaaattagaatggaaagagtaggccagaaattaaccactgctgttttacctttgacaatatctgcaggtcatcccaggctggtaagatggcacttgccactaagcctgttgttctgagtttcatccttggtataccatatgctaaaaagagagaatcaattcccacaagttttcctccaatttcaaaacatgcagatacataacacacatacatctgcaaacaaactaagcaaatgcaattttggaatatttgtcttctcttgagagatacacataaaaggtcttattataaattatagtgccccagtaactagaaaaatacgttaagtgaatcgttacaaaacgtagctgtcataattctgtgtccttagcatctatagacaactccattcctaaaccttgtatctatgaagtgaagacagtgttcaaaatacagtcagtggactcctaatagtgcctaagttattgatacaaaaatacctttcataaaattattaaagtgctattgttcagtaactcttctgacatttgcccatggttttctactatagtcaatctactggtgcttcagtttaaatcaaagctctgagatgaaatggcatagtaggcaagtgatccctcatcagcataaatttgcagattaaaagaagagaaaaagtaaaacaaaaggttccacctaaatttttcctattgaatcataaaatataagtattaaatctcaatccacggctatattttttgacattttttatcacaacacttcattcagttccttagggcacctgctcttgagagtggtctgttggctgactgaagagaaagcacttttgtaacagtctaactactgggataaattagacaccttctccataggaatgtatttctttatcaaaattgactcacaggcttatcgttactcagatttcaatatttagctgatgatttattgaaaatgaattcagagactctgattttagggaaaacaactggaaatatttgtttccaagcatacaactatgtcaaccagactgctacaaaatgacttagttcaattaatcttaatgttgtactccttgatttcatatcctagctatgaatagctacattactttttatgaaccatattcctggtttgcatccaaagttgcttagagctgttttgtccaaagagagacaataagcctaacttaaataaactacatgggttacacaaaatcagaatctgcttccaagttacatagacttctgatctgcaaaggggctgctcttagccaggcctgggggcacatgcctataatccttgttacccgggatgccgagacaagagaattccgggtctaaagtctgcctgattatcgaatcaattcaagtctaaagtgattgatctaattaggtcctgcctcgaaataaaagtaagaaagagttggggctctgtatatttcagtagaaaagcacttaagcagtgtgtattaggatcatttcctcataaaacaaaacaaacaatgaaaactcaagtgttatattaatctttctaaaccttagtattttaactttaaaatgtgattaagctaccaaaaaatgacagcttttcctagaaagaaaattcatacaaatattaatttatggaatacatgatcacattagaaacatactttagccaagtgctaaatacaaagtatatatgaagactttctgaagaaaccatgattataatttaaccatttttaataatgttctgtatgtttaggcaagtaactcaatctaagcacttataataaagaatttcttggtacttcaaagtcatttagctggaatgttgaaatggtcatgcccaggaatgtgataaaatattttaccatttaccttcctaacctcagaggccattgtctaggtacatttttttaaaagcctcatcatacactgtccagagcttgaggtgaaatttcctgggatttgtcatctaacgactcaaagtcaggttcaatattgctgttacttttatgttttttgtgtattagacctttagcagaccctggcaccttccagtagacagtacataaatcctatcatctggcatgagtctaatttacaggcagagaaagggggaaatgatgtagaaaactgtttttaaagaagaaattagttctttgaaaatcatgttgaaatgaacacaaacattcagatatgtaaatcagttcactgagctggttaagacaagaaaggtgtctcagaggatgtccatgagcacagccccctaccaacgggatgagcctgcaaaaggcagaagctgtgagttgacctttgacaggtttccctatagtcatcagcctttgcagtttccagacacactgctttggtacactgagctcaacagccattcacatttaaaacagaggatgggaagaatccttctgagacattttggcttctagggaagagaagaaacataatctccaaaactggtgaagcctctcggtgagccacaagcgatcagcaggctgtgttcactgagataagaacaatcatcagtaacattactggtgttcctgccccagcaggaacctttgatgacacccaggcacctttatgtgattacttaattgttggtgttccctccctgagacaggtcctcactgatgacacccaagcacctttaagagatgacatatttgcttgtgaaatccacttcaaattattcctcattttaaactgattatattagctactatgtgttcctcttagcttttgttgaatgtttagtccacaaaacactattaggactagcctataatacattgagccctgatattttcatgaagtcctctaaatggtgtattttgtttttatttccttttcctactgcttatctgaatacatacgagtctgagtaaccaagggttctctaaaatgaacgatgtgcttctttggatgaatgccttcagtgtaaggattctcttttattggggatacattaaggtgaatttcacatctctgacgctcaggcatttaaaaaatagacatagagagagagagacattctgagggaaagttagacctccaaatttatcttatgctgcagtaggcttttatgtcctattttaagaactagtgctggctctctagtttaatgagcagtttaatttaaagcttaaaattattaagtattccaatagagtcataaataatgcagtttataatattcttatcaagcacatgaagatacatttgtcttccattaacgacatactttttaaagtagcctgacctcttcagatatataagagcatgcaattagggcaatttgtcacaggccttttacacgttaataagatgtaattaattgtctgttttgtctaattaacttttcagacactggcagctcctgttcttctgctgtagtgcaaggaagcaagaagaacttatttgcaattctaatatttgaccaagacttctgaccataaactctaatccacacacatacatacacccaaaaaagtagaatagaaggtgatggaaaaattaaactaggaaataccacattatagtttaacctaaaaagtagggaaaatgctacattaagcatgattcagattagaatataaatgacatgagaaaaagtagaaccatacttaagactttccatataaaatacattatccatacattctttatgtaagcaatctcattaatttgttcccctttgagagtcaactattccaagacagtttgttaggagttagagtttcagaagagctatgataaagaccttgtccttggtgagctgccatgacatcaatggttgaattaattgagccctgaagatttctgcactaaattcataatctttttaagttttgaaatgaagatgagaaccagtatcattagcatatttgttcagtatgtgctaatgtatttagtcattcacattgtaaaattaggacattggttacacacatttgagaactttgagaaatattatgctgtacattattttctttattagttctttgactcaaagtgtcactagcccaaggagcctccaaatccttttatagggcaggtgggactgtatcttctgaccatcctgcctccacctcacaatgctgagattgcagatttaaaccaccacacacataaaaaattactttatgcagtatttttagacatttttcaaatctatgattttaatgaataaaataaatctcattatttaaccataatttatttaatattgactgtaaggcaaatcatccatggccctttaaaaagttccagatagtatcaaatgctgccacttgcatagagtgaaagaaatttttcttcattgctggtgagtctacaaaattgtaaagccactttggaagacagttggcagtgacttaattagataaacttcatacaacccacctgtcacttcctggtataccaaaatgagtttgaagcatgttcatgcaaaactctacacataaaatagtaccaaggctgtaattatagatagagcctctctatatgattgcaatagactctcaagtggaaggtggttttccattatagcatatttagctgattacaaattacaggtcaaatagtacaatatttggcattcttcatagctaagattattttgtttggttggttggcttttgtttatttgtgtctagtgttcaccttagatttgagttcttgcacaataggtgtactatgtgcatgcatgatacttgtggaggccagaagaaggggtagatcctttcaaaccggagttacagaaggttgtaagctgccatgtaggtagtattgacccctctgaaagagtagccagtgtttttaattgatgagccatctttccagccccaaatttaaaaaaaaaatgtttttttgagacaggatttctctgtagctttggaaacagtcccaaaactccctctgtagaccaggctggccttgaactcacagagatccacctgcctctgcctcctgagtgctgagattaaagatgtgtgccaccactgcccaaatcaaattaaaaattttaaaactatatcatatacaaaaatatctagaaataggatttctgcttataaataccagtctaggaaggattgtttaattactttaaaaattcacatttaattaagaagggtgtttgcatggtggaattttaaagatgtctatctaacatatttaagaaccatgaagacaaataatcaaagagaatctttaaattacagtgactgtacgaacatcccatgagacctctgctaacaagtcctaatctatactttatttgaaaactattaaagtctcctatcatgattgtagcaaacatattcttcattcttttttatttttactgtgataaaatgaatgccttagcagatgactctttgcagtctcattgtcacatcttccaagttctgatcctacctttgtcttcaccagtgtgtggccaagcacaaactcctcaagcatgcaggcctcagtttcttcatcagaaaagcatctgtctcactgaggaagcaggaggattagctgtgtcaataaatgcagaacacttagacagctcttctttggtggctaatgatccctaaggaagcataccattaaactggattaacactctctcttccccaatattcacctgcatgccaatcaatcgttagtccctttaaattcatgctgagtcttatacttttatttcaaggttttatttataccagtcatccttttaatttatattggagctacaatgacataaatgaataaacaaatgcacaaagtacctgtgtaaatatgtacaacacaggctgtgtaagaagtgacttaaatcttgtttcaatttgttatttagtcacattcctaaattctgtatgagtttcaaagattatttcttggtcatttgtggttatgatggattactggagcatggataatttataatgaatatagaattatttggtcactgtaccggaggccagggaattcagtatcaaagagtgggaacaaggtgggtcaaagcctactggataatgtccccatctcaccagtgattgcagagcatcagtgtggtcaaatgaatgacctctcaataactcttgtaattatgtactctttatatggtatttttttaagtttaaattagaaacaagattgttttacatgtcaattccagttccctctgcccccactgacccctgtcccatcccctttctgctcccttgggagggtgaggccttcgattggggatcttcaaagtctgtcatatcatttggagcagggcctaggccctcccccatttgtctaggctaagagagagtattcctctatgtggatggtctcccaaagtccatttgtatactagggataaataccggtccaataccagaggccccatagattgcccaggcctcctaactgacacgcgtgttcagaggatctggatcagtcctatgctggtttcccagctatcagtctggggtccatgagctcccccttgttcaaatcacctgtctctgtgtgtttctccagcttagtcttgacccccttgctcctctctctctgcaactggattccaggagttcagctcagtgtttagctgtgagtgtctgcttctgattctatcagctactgcatgaatattatttcaagtttattcttcaaacatgtaattggattccccataagtttccaatctgatctttgtcattaatctatatttgtaagctttaaaaaaagaaaaacctattaattgtttttttatttttgtcttgattctacttagatttcctgagttcatctctcctttattggagaccatatctttcagtacgtttttgtttctttttctgttagagcatgtatattcatttgctgatctaaattaaggaactagttcttataactgtaattatttctggcttttttctgaatttttgcaaaacacattgtgcttgttaattgcttttgtttgtttgttgtatgtctatttgtttgtcaacttgatgcaaggtcaagtcatttaagaagagtgaaagtcaattgagaaaatgcctccttcagattggcctgtagacaagactgtgcaggcattattttgaatgatgattgatgctgggaagacccagcccactgttagctctaccacctgtggccaagtggtccttggtcatacagaaaggcgggttggacaagccatgagtgagcaagccagtaagcagtgttcctccatgtttcttcttcagttcctgcctctgggttcctgctttgagtttctgccctgacctccctcaataatgaactctaataaggaaaagagaataaaccctttactcctcaagttttcatggtaacaatcaaactaggaagcaggtaatgtttttaaaaattatttcaaggactggggaatctggatttatgctcattgtgaactttgcagaatcaaaaatcacgttggagaaaaatctttgggcatgtctgtggaatgtcttagagattagtttaacagaattgataagatgctcctcctccaccaagtgtgggcagcatcatttttaaggctgaagtcctagactggataaaacagaaaatgtggatagaaggagaaactaaatgagcatggacattcatcactctgtgcttcttgattgtgaatgcaatgtgacaagctggtcatctattcctgccactgtaccttctttgcctgccagcaaatcttttctgccacagtggaatcctcttgaaccacaaaaagagtaaatccttcattccttaaactgcttttgtcaggtattttattacaatagaaataaaactaagagaaacaaattggtacccaaatgtggtgccctagctgtgataaaggtggctaagggtttgggacttttacaagtggttttaagggggattgtggaagagttctgactcagactcaggaagtgctacagcagagcttagtggaccatgctgctaggagctgaaagaaatatgctcagtggcatcctagcttttgggatttcagaagggaacagggactctattcagaattggagtaagggtcatttatgcaatattttcacaaagacactggcttccttaccctgttatctcaagaatttggtgtattagttactttcttattgttgtgaaaaatatttgactgacacaatttaaggaaggatgtgcttgttttagattataattcaaattgaagtctgtcttggaagggaaatcatggcagcaggcaggaaaagaatagtgacaggagtgagaagtggcaggagagactagccatgcatgcccacagtcaacaatcagaggcagaagaacactggtggccagtgcaatttttctttcattcactccagcagttaggatgggtcttcctagtgaattatcctaacctaaaagaacatgtattgagggacatgtctccttgttgattacatatccagtaaagttgacgaccagaattagccatcacattgactgaggctgaagacagaagtagggaatgagtttgcttggtgaagaacaattgaagatagtgtatcattctgggtattgtttgctcttctcatcgaagtctatggtgaaaagagcaatcagtctgtgtgtcttaccctaaatctgggcagcattactctctgagccctggtcctggattgtgtaacaagaaaaaaaaaaaaaaaaaaaaacaaggatccatgagcttccttcactctctgcctcctgtttgtggatgcactgtgacaagctggcctcttaatattgttgtcatattatcccttacacaaagaaaggattttttttttactgtaaaccgaaataaacccttctcccttaaatccttttggtcaggtatttcatcacaacaatagaaaaataactaatattttgtgtagctgagtggtaaacatcatgcacaaagacatagttttaatacttagcaccacaagatgatgatatattaaaataataataataataaacctcagattttaatacttgacaagcagaagttttttctgggtctacttttttgcctataagctggatagagtagatgatttgctttcagtatttctcgctgcataaatggatgttagcaacatgctgacgctatcccctacacagacctactgctctggttcggacaggtgtttgacaaagaaaaatgtgttcttcttcccattgtactcctgatggaacatggaagacttgagaattaagacccagtgggagaaagaaggtcctttatggggctctggtatctgttgccccatttttggctgctggccatcacctctgagtgagcagcactctgtgtcactggattgtctctctgatgtgctaatccattacatgcatgagaggaatggagagaaatttccaaagctgtaggctaaagcaaactttgtatcttttaaagttgatcacatgactccaaaatcacctgcatctcctccttcaatgttggcttcatccactgtgattgaaacttgttttagcatgtgtatagactctgtggtctcaagaaacagctgaaaattccattattaaataccacatcaaagcatactggtataatcattataaaagtttttgttttgttttgtttttattatcttttcaaagtagacaacacatcaactccataagattccagtaatgctaggctttgatggctaaagccagataatattgacactagagggggcctcatcatcatcgaggattgtctctgaattgtatatttaacagaaaagttggccagggaactgaaacaatggatgatggttccacaggggagactggaatccaatggaagttcacatagaacagagatttttctaagatgtttcttggactcctgcatcagcatagtgaacacacaaagcacaaaaattcactgatttagaagttagttaccatcatacaagaatacacaattagtaactaagttagtgctcttacacacacacacacacacacacacacacacacacaagaaccttctgtgtccatgtaataatgttttcaaaaccttccaagtgaatgtcactgcttaggaagtgacaagatgccaggctagccacaggaagatgagcattcggtgagcctgttacaaaatctggcactttagaattagactcttgcctgaaattcagtacaatactaaattgacaaaggaagaaaaagatgagtatttgttgttaggttcatacataaggcacatcacttaaggaggtactgaagatcagcttcttccagtagcataaaaaatggagtatcttctcatcattaattcaatgtgcataaaaggagtttatctttgtaaaacacatgaaattccatttgcaagttccactcaacaccttttcctttttttctacacctttagccatatatggttcaaagtaccagatttcaagggaatgcctgttcttttgtgacatattagctagcttcaaaaaggccctatttctgtaaataaaaaaaaaatggtaattgactgttgttagagaaaactgtctatttggcagtagtgacacagctgccacctggaggtctgttatctaaattacagaattgggtctgaaaatagaacagtttttaattttatttattaagtttttagattcagtcatttaaaggaaaaaattctgtcataaacatcaatataattttaaagtaaagtatataaagcacgatacacagaaatgattgaaaaatggatccgaaatgaaaaacatcccaattttaaggttcccaagaataagagatgaccacacttgtttcgcacctgttctgtaacaggcatggtcaaaacctaaaaacacatgttattagtgagagtggctcaggcattactactttcacacactcagataagcatggcaggaagactcagtaacatttctggatttttttacaagctagtttgaatgttttattctctgcctatagtttcccatgcggaacaaccagacagaaaagtgacaggaaaaggtgtcattctaagtagacactagattcacagggtttgtgaaggcttgatcgttctaatcttatcctgtgtgttcagacgtaatcatttacacccttcagcagtcctctagggaaatgaatcactccatccaatgccatgtctaaaactgattcagaagattcaggacccctaattacagtgttgaaagcaaacacttctcaatgagtacacaaattagatttctcccccaggctttcgtaaggactcccaaattacgtaattgctcattgactatttcaaataagtttgaaaaactctgaaataaaggtctgcaatgtcctgcaattaataccaaaatgtcaattgacaagacagattgtctgattagtacaacagtttatgtggggactgtgcaacatgcatcattataatctcacctttccccagaatatataattaatcttctcatgtcttagctttctaaacattgggatacaccacccgtgggaagaccctatctgaaaagcataatctactggctctggggagatggctctgtggttaaagatgagtactgcccttcgagaggatccatgtcaggcagctcacaaacagcagtaatgccaacttcagggaacccagacacttttgggctctgtgagtgagcaccttcattcacttgtgcctgcctacacagtatgtcagtactgaatatttattcacaaaattgaagtgaaaagtacctgtttagtgaagtcatagttcataaatgtcttgatgcgaaagattatcatgaattaatactaaacatgatctctgaatgatctggtcacttgccccacatagctacttccttgaagaaatgaatttattcttacttcagtctgtgaaataactttatgtacacattttttgatggtgatgaaaataaatagaaagacagacagacagactttttaacaaaagtatttatagaaaatgtaaagtttccagagaaagagcatataattttgagtacaggatttatgtttgcttgtatgaaattctgtagtgaaaaaactactagggtgaaggctctgtctggttttggaacagctaaatgatcttatataaatcttcccgtgctgtattgcatatagactgacagggacagaataaaaaccaaagcaaatatgaggtaaaaatgattttttattactttaggtatttctagatgtcagataaaaatgagaacattgctaaaaattttacagagtgacagctctgccttatggataaaattctacagtttgatgtatgaggcagaaaatgtgaaaaatattgagaagtgctgccctgacatgatgatggaagggagctgggtgagtgtgagcaccatagaagtgtagtggagcaaagtcaaactagagaaggatatagtcctttttgaatcctgccgactacagaagcacaaactacaaactgttcacttttgtttcacctttttaatgaacttttagacatgctcctttattgatttccttgaagaatagcttctcagctctttccattgcatatttgttttccagatacaaaataaatctgaaaagttctttaacaatggagattcagtcctctgctgttttgaaaagatgactaatattttatactcctgttcttgctccatttaggcatttctaagtatacctcagcccacatgggaacatacactgtatgatcatgtagtgaagttagccattgaggaatgatataatttaagtaccctgtctccttccctctaagggaacttacctgcagttcaaactattgaagtccttgctcccaagattttgctcttgcactgaattagatgagcagtggggcctgaggcctttggtttatactgtttagactcctggacaagtctggattcataaatctttctatgtctgaaaaaaatgacctccttggctccctacaaaacatctttcctttaaataaattatgttcttcttaacttatctaaaactatttctgaagtagaatacttaatggctgagctgtgtcatagagtaaaactggtctaggaagatggcaaggagagtgagtttaatctctagaaccccatgaaaagccaagaacatgtgagggctaactgcatggtccaaccagcaagcagagctagggaattcctaaagcaagctggccagttagaatagctatttggtgagctctgtggtcaactgagctcatgatgactgataactcaggcatgagactccatgactaaggcaacaaacaaccaaggaagacacctggcatcaaccttgggactccacatcaccatatgcccacataggagtatccatgcgtacagatgaccatgacacatgcagatggcatgcacacatacacaaacacatcatatagacgtatggtaagcttcatgacatatgggtatatttggacatggcaagtaaatcctgaatcctctagtaagataagttctgttcttccacacacagagatgagataccacacgactctcacagaaacacagtcatcaccacatcatatttctgttttaaaaatccttcttggtagaattatttatattcccacaaatacaatcagctgctaagtttttcttttttaactaaaaatattcaaatacacatacagttcttctaatacaccccctacttttatttcttcctctcatcagtcctcctttgttcctttttcacttcaactttcatgtcatatatacatacatgtttttaagtatgtgcataaaatttagaatgacaaatgggataaaacacagcatttgtccttccaagacaggtttaattcgctgaatatgaaaacctccagctacaacttttttgtaaagcaacataacttcatctttatgtttaagaaaaatttacatacacacacacacacacacacaaatgcgtgtgtgtgtgtgtgtgtgtgtgtgtgtgtgtgtgtgtaataccatattttctgtaaccattctaccatttgttttggatacctagtttacatctataaattagctattgagaatattgctgtaatagatgatatgcaagtgtccctcggatgtgttgatttcattaaaaatcagattctctatggactgatgaaaagacaaataaatgctattcaatcgtgtgtgtgtgtgtgtgtgtgtgtgtgtgtgtgtgtgtgtgtgtctgtagcaatcaacctttgtgcattaattttgaattaaataatacataatgtatctttctgacataatgtaattattaacactaacattatgccaaacttttccatcagaatatagcctatatatatatttctgtcattaatttaattattaacattaacattatttcaaactttttcagcagaatatggtctacaaaacaaacttatatttcacattagttgtgggctaaatgtatatttgtctaagatattactaaacattagtatggtatgggagtgaacttgggagttcaccatgctaagcacaaagtctaccactgagtgactgtcccagcctcacttgtgcattttatcttgagacatggacaaagttgaacttaaactttctctgtggcccagatagaacacataatcaccctgcctctgtttccatttatgtcttagcctggcataatattgacaagcattctgttaaaacaattgatgcctattcactaagtgtttatttaacttcattgtatcccacctcatttaaatcccagaatctcccagtgaacataagccaagtgctaagtgggaagctcacattgaaaaatatgtgctgtccttgttggatttggtggcataaacctgcagtatctgctacttgaactgctgctcctgatgaggcattaggattgcaacttcaaaaagaattcaaggccatttgaaaagacatatccagtccatggatccaagacttaagaggtaaaaagagtcctgagagcattacacaatggtggggcactttctagaatgcacaaagcccaggattcatccctagtacagataagggaaaaaaataattctttggtatgttctctgtgaacattcttcccagccttctgaattctatacatcgaacataaggattttgtcaggaaaatggcagttttaaagtataaataggacacactttacaggtaatattggctagaattatgaagtctaattgaatttcttcataaggtgtttgcatcaggaaattactggaaatatttttaaatagctactataaacaaatgtgcattacaaagaatatttacaatatagctgatgcaatggctcagcaggtaagattatgagctgtacaagctatatgacctgagttccattccggaattctacatagtaggagagaactgactacagaaagttgttacctgacctgcacatagcaaaggcagacacacgtacttgtgcacatgcacatacatacacacaggtactctctcttacacacacacacacacacacacacacacacacacacacgaataatttagttttaaaaattaactctagtataccttatacatccctgacattttctcacagactacagggtactataagatttgcttgaaatagattttggcttattatttttaaaatacctatggaaaatgccatacatcgataatttgctagtgttaaggctgtaaattgttaatggaagtagcttttgagtctccttaaccttcagtgacattttttgatttttgttgtctaaatggttctcctgcttaatatgtgtgaatgtttcctcagatcccctctgacacgatctcagttcaacattagctgatcacacattttcttcccactggatgtaagatgaataaggagttctgaatgcatcaatgtgcaaaagacagtatattttcatggaaaataatcacaaacaacaaacttagagtaaaattatgcatgaatgttgcttttattcaaatataatttttaagctcaattgtcagtattttctcaaacatgacacaacactgcaatgggacaatctctaagttaagacttgtaaacttcaactttatagaagtacttttagaaaattctgtgacgtgggatgtctttctgtatgttttgaatatgtgttgctctgattggttgatgaaaaataaagctgcgttggcctaggacaaggaaggatagagccagacaggaaatccaagcagagatacaggagttgaaaggtagcatctgggagacatcagcagtcatcaaggaacaacatgcaagagcaccacctgtaaaaccacaggccatgcgacaatacacagattaatagaaatgggttaatttaaatataggagctagctagtattaagcctgagccattggccaaatatttataattaatatataattctctgagtgattatttaggaatgggtatggggctgagcaggacaaaaaaaagcctttggttacagttctgatgtattgcttaccaaagtttatgttattatacctagaataattctatctgttgccaatggtttagaacataacctctggcttcttttggcacatggcagttaaaagagcaatctttctgtatttatatgacagaggagacacaatacattatgcacaaataacagtgtgcaaaatataatccatccacacccatattcaaagggcgtttcctaaaattcctgtcagtgctgattttttaatcacgctgtttatgctttaaatgcatttatatcccctcttgttgcaattattccccttatcacatccttccctctagtaaacaactacctttgggatgagatatttttgttaaaatgctacttatactgaccttcctgaaagttataaaggtttatgtgggataggttgtattagatccacttttctccttgcttttgatcaataaaattaagaaagctctccccaagaattttgataatcctttgtatctattggatctagtattattgccaatacaatgtttttttatttggttaaaccaggaatagttgctggaatacaaagatagttctcaaagtgccctgtataattcataatatgactaataatatagcaaaaatattagcagacattaatcaaaagatgggtaaattgaagatcacaattttacaaaatagaactactatagttgttactcaaatataatcttagttttcaacaatttcctgggatatcttgctttaatatgtaagatttttcccatactactggtaggcaaattaatgatttgcatagagagacacacaaattctctcaaggaacttttgaatgggcattatggctaaattgtctttctcctttccttggtcctctgttatctattataattctcttacgcttgactatgttaattagattagccataaagtcaaggaattcattcatggccactattacagacactacctcttccttaaaaaattagaaatggggagatgctgaaggatgtgaagtccatgtgcttacagaaagaattagagaaaccagaattattaaacaggctttttgcttcaatgaaagaagttgacacctgtttaccaggaaggatggagtggacactgtttattattaacctggtaatcttttgctattctgtggatccagccctcactctaatccttcagactcatgagcaccattactgactcaatagaagctatctatggtaaagaaaccacacatactctacaaaagacatgtactttataagggacttacaatgtagtcatgcctttggctttattgtgataattatcctgagaaaacttttcccaaagttttattgtcttaaaatgtgtaaaataaataaataagccacttggtgtcagaacccagaagttagagccagcctggctaagtaaggctgaaccaagattccttcttatttcatgaggatgatttccctcccaaccatgatacctacagggatcccacctcaaagatttattcctaaattttctgttacttctgctaactataatatataacacaatataatttctttttgcagaaggatgggtcagaagttaccaagcattgagttggtcttatacatactggatttgaactcatgctgtctgtattctaggcaagttttggatttgcaatcctctaacctcagcctcccagagacctgggattacatatgtgcatcaccaggcacagcacaactattatgctatattgatgttttattctgtaactttgttcaatttaccaattataacaggttcttgtagtgtctttaagattagaggtaaatgaccatgtagtcttagttacagtgtctattgctgtgaagagacaccatgatcatggcaactcttataaaggaaaacatttaatgggcctgtcttagagtatagaagtttagtcccttttgttatggcaggaatcatagcaatatacaagtagatatagtactggagaattagctgagagctctaacccaggatcagcagacagcaggaagagagagtgacactgggcctgacttgcccatctaaaacctaaaatcccacccatacttcctccatcaaggatacatccactccaacaagtccacatctcccaatggtgtcaactctatgagcctatgtgggccattttctttcaagctaccactcatgccatttacagaaacaatcttagttcacttctaattaataaattgcttttgctttttctaagatctgatctttacatatagcctaggtatatctcaaacacactatgtttgaaatgatcttgaatttctgagtctcctgccttcatctcctaaattctggaattaaagactgatagctgggaaaccagcacaggattgatccaaaccccaggaatgtggatgtcagtgaggagacctcggaaatccatgggacctccttaccagatcagtacttatccctagcataggtgtggactttgggagctcacaccatatagagggatactccctgagccaagacacatgggggtgggcctaggccctatcccaaaggatatgacagactctgaagacgccctatggaaggccttaccctccctggggagcaaaagggtatgtgaaaggtagagatttagttggggggtggtaggggagaaggtcagggagagggaactgggattgacatgtaaaacaatcttgtttctaattcaaataaaaatggaaaaaatatgcaccatcacaacccttactctgttgacagcagagatcattgctgtgtgataacacacatctggttagtacctgctttatttaaaaatgatccattttgaaaggtagaaaatcagtaacaagtgaaactatagaaataacacaatgtattaaaatggttgctcacagaccatcagcatatcattttataaagtaaaacaaatagatggactctaaaatgggaaacagtgatccctgcctcctagcacccaggttcctctctgtgtggaataaatttattcaggctcttctaaaagaaataatacactgaaaatagtagtacactattattttattagacaacactgtgactcttaggtgtttgcatttactcattttgtatccttcacctgaaaaaaactaagtacctatttaagaagcaatactgtaggaaggcacaaaacaatggacagggaactccagaagattgaacttgtaaatgggaccctgctctcagttagaaccttcataatagaggcagcaccagtcaataaatgctttggattgttggaagagaagaagtctccagaagccctgattcatcaaggggaaatggactggacctcaagagcaactgcaactacagacactgagataaattgcaagaacaccttgacttgctgagttgtaggataataactttttaaacagttgaacattaacaaacagtagaagaagatgacgcatctctggacgttataggctatggttttgattctcaaaagcatttctccttcccacaacacaagtatcctatagtgccacagattatttaaatgacctaaactcaaatgacatttaaatccactagaacagtactcaaataggtagcctaagtcagaagcagcctttaaaagcaaatgtgaaagggttcaaaatattgaatggaaattcaatatttatttctttattattggtttattttggaaattagaatacagtttgaccaggtgatttgtttccatgcaaactactagaaacaccgatcagctagttttcttaggtctaaactatattatggtaatatatgctgtggctattgcaaggatttgttatattattccttttgtttaatgcatggatttttcttttctttgaatttacatagtatatgttagaatggattaatatgtccttgggattgtaattatcatagtttaatagaaaattagctgagcttaatatagtgttatactttataccaaataatgttatctgataatgctatctgcagacaaaaatgcaagcctaatgtctctaggaaaggatagaattacaaatgctttaatgcattcagccttcacttgcacatcgacttcattttgtcttttaattactctgtgtctcagccagtttataagacatgtcaaagtctttgtgtgattccccttgaagatgcctttaaggttattctgctcactgttctgaatccaattctccaagacaggaaaattagaaataaagagatagttcagttttatatgcatataaaatggagagattaaatctaaaaataagacactataggatagtgttgacaacagaaactcttggacagagggatcaagggaatcttgtctagcttagaacaagaggaccagagggaataaaaaatttgttacctcttcccaaagtgtcatttcacagtgtccttggctgaaattgtagagtttggatccaaaagaaaaaaacaagttaggaagtataattaaactttgttgataaaaggtagtgtcagaggaaaatgagctggagtagaacctactcaaacattccaactctataagaataatatgattaagagacaagatgaagagccacatggataacttcaatgttcactgctggaaatggggaagtgtcaccaagaaatctgtgaaggaatactgagaactgacagacctggctactaccccaatgacagaggaatttggaaactacagaagtatagtctaccattgacaatttctggctctcagatgaggttgcaaagagcaggcaatagcatccaggtgaggatggaaaacagcatccaaccaggggtgagaaacagcatccatctagggatgggaaacaacatgcatgcaaggatgggaaactgatgggagatttccttctgtatatatgtctctttataggttgatgaataaaacactgattgtccaatagccaagaagaaagtacagacaggacttccagactaggagaatgctggggagaggaagtagagaggaaaccacaagagagatagcatgtagctaccaggatataagacactgggcattcccaggtaagataaggccatgtagaaatatataggtcaataattattagtcaatagttaaaagagaggctgtgatctccaccctctgcttgaggtgagttccaaccacaggcccacttacagaaacaaccctccctctccccaccatccataaaatttttatgatgcccaaaccctccttctatggttttctaacatcctgcttaaactaacacctggctcttggcctcttctccccctcccctttaccccacactactgactatatgagctagcctggaaaaaataaaatttgtcacttgatcagaatcctgtcttgtggtcattctctctgcatctcttatccccattcatctccctggatatcttgccttaggttgctgtctcacgggttggtacaactatatgtacctacttgaagaacagatttgaagacaatagtataagaacacactcaacaacagacagaccaatatatgacaccaccagaatctatggattccacaacagcaagacctgaacatcccaacgcagatgaaccagaaaagaaagactttaaaaacaactttatgatgatattggagaccatcaaagtggaaacaagaaaatcccttaaagaaatggaagaaaaaacaaacaaaaatacagaaaatgtaggaaaagacaaatcaaaaaaattcaagaaataaacaaatcccctaaagaatgcaaagaaagccaagaaaaacaaccaaacaagtgaaggaaacaattcaaacagttcaaggcttgaaagctgaaataaaagcaataaagaaaacacagaattaagggattctggaaataaaaaagctggctaaacaatcaagaactaccgatgtaaccataaccaatagactacaagagacagaagagagaatctcaggtattgaagactcactagaggaaatacagtccttgaccaaagaaaatctcaagtccctaaaacaaaattccaggaaatatgggacaccgtgaaaagggcaacctaagaataatagacacaggagatgatgaagaaatacagctcaaagttacagaaaacatattcaacaaaatcatacaagaaaacttccccaataaaaagaaggataagcctatgaaagtacaagaagcttacagaacaccaaatagactggaccacaaaaagaagtccccttgccatagaataatcaaaacaccaaacttacagaataaagaaaagaatattaagagtagcaaaagaaaaaaaaggcaagggacatataaaggaagaactatctgaattacaaacaacttttcaatggaaattttgaaagccagaaggccctggagagatgttctacaaatgctaaggaaacatggatgccagtctagactacagcaccctgaaaagttttcaatccctatagatggagaaaacaagatatttcataacaaaaccagatttaaactatacatatccacaaatctagccctacagaaagtactggaagaaaaactcatacccaaggaagataattacaatcacaaaaacataggcgatagataatcccaatttaccaaacacaaaaagaaaaaggggggatatccatgcaaaataccaccaccaacaacaaatccaaaacaaacaagaatcaacaatcaatggtcatcaatatctctcaatgtcaatggtattaacttgcctataaaaagacacagactaaaagaatggatataaagacagaatccaaccttctgctgcatacaagaaatacatctcaaattcaaagacagacatgaccttggagtaaaggactgggaaaagattttccaattaaagggacccaagaaacaagctggtatagcaatcctaatatctaacaaattagacttcaaattaaaaacaatcaaaagagatgaagatcacttgatattcatcacaggaaaattctatcatgatgaagtcataattctgaacatctacgccccaaataccaaggcacccatatttgtaaaagaaacattactaaagctcaaatcacacataaagcctcacacacttatagtgggagacttcaacaccccactctcaccactagacaggaccaccagatagaaagttaacaaggaaacaaagcaactaacagaaattatgacacaattgggattcacagaaatccatagaacattccatctaaacacaaaaagatacctttgtctcagcaccacagggaaattctctaaaatttgaccacatatttggcaacgtatcaaacctcaacagataaaaaattagaaaaggcctctgaatcctatctaatcacaatggtttaaagttagaattcaacaacacaaatagcagaaaccctacaaactcatggaaattgaacaacgcacaactgcaccattcctaagtaaaggaagaaaacaaaagaacttaaagacttcttagaattcaacaggaaagaatgaatgcacaacatacccaaacttatagaacactttgaaagcagtgctaagaggaaagttcatagaactaagtgcccacatgaagaaacttgagaacagtcacactagagaattaacagcacaagtgaaaggtctagaacaaaaaggagcaaacttatcccagaggagtggatgccaggaaataatcatattgagggctgaaatcaataaagtagaaacaaagaaaacaatacaaagaatcaacaaaacaaaaagttggttcttcgagaatatcaacaacatagacaagcctttatccaaactaataagcagagtgagaacatgaaaatcaacaaaatcagaaatgaaaaggggaacataacaacagatactgaggaaatgcagagaatcatcaggtcatactttgaaaacctgtactccacaaaattcaagatttaaagaaaatgggcaattttctggaaagatatcacttaccaaaattaaatcaagaacatataatcaatttaaataaacatataacccataacgaaatagaagcaatcatcaaaagtctccctaccaaaataaatcccagggccagatggtttcagtgcagaattctaccagaaattcagagaagagttaataccagtactcctcaaattgatccacacaatagaagcagaaggaacattgtcaaactctttctacaacgctacaattaccttggtacccaagccacacaaagacacaagaaagagaactacaaaccaatatccctcatgaacactgactcaaaactacttatggaaattttcggggatccacagggaagtgaatccaactaagattctaggcagtagtggagaggctgcctttgatgtccttcccccataatgagattgatgactaccttggttgccatactagagccttcatccagtagctgatcaaagaagaagcaggcacccacagctaagcactgagccatactcctagaatccagttgtagagaaggagaagggatgagcaaaggagacaagaccatgcttggtaaacccaaagaaacagttgacctgacctagtgaggacacagagatcctagatgtaaagctggggaaccagcctgggaagtaacaaaccctcttaaaatgagtgccagctaggaggcctaggaagtctatgggacctctaacagtggagccagtgttattactagtgcacaaatggactttgggagcccattcactatggaggggtactattgcagccagatacatgaaggagggcctaggccctccccccaaatgatgtgttatactttgatgatcccccatggaaggcctcactatccttggggagtggcttaggggtgggttgggggcattggtggggagcatgggaggatgagagggcaagggaatgagaggattgatgtgtaatatgatattgtttctaaaataaaaaaaattcttaatataaatttgtcacaggagaggctcaaaaggcacagacagattaatttctacaaaacttgaaaggttgtgagtaaatgagaactaaagggaaattgaggcaaaaaaggaactttaaatattatagatgggaagaatgaaaaaatgagaactcacatcttcctttttacagtcatgtgtacttgtaaaataggtattttctgactaaaaggaactttcaaattgaaaatcctctagtctgtaaagtaccatgtaatattagactgtcagtgaacatccttatcataattgtctgtggctgaagaagaattcagaatgtcgcagaaataatttttaaatatgtctgttagtgcactgtgaactgcagtcacttgcaaagtcaggctccatagtgaaggtactgcagaccttctgacttctactgatagggagattgggtgttgtaagtagagacaaaattatcttgtgtcatcttaatgtgctgccattctcctgttaggcaaactcaaaaggtatagctaatatcagcaaatatttagcttctactggatatcagtcaaaaaggctgcaagataagatacaaagatttccccaccatgctgtgcccttcttatgttatactcctgccaacaatacattctttttgtttggtagggtaattctgttttttcttcttgtttttttttttttttttgatttttcagagggatatgactgcactgtgctgattggaaatcactaaatttataatataaacaataaccttgcaagtagtctgaaagatgattgtgacttcctcttatgaaagactcaaattgagctcaaaactaaaaatacatggtttcaggtttaagaaaaatttcagagatcacaagtagaaaggtagaaatgaagtctgcactctagctgattttgattttcaatgtgtgatgctttttatttgcaaattctttacaatggaaataaattttcaggacaaacatcatcacaaaactgagagttcagatccccaaggaaagccaaggagtaacaaaaatggaaaaatggaaaatttcagtgtacatgatgatttgcaagcatctggcacaacagtaagtgagggataaaacataaaacaataagagtttgatatttgcatatactgtgtagagtaaagggtcatgggttttagcgtggtctatggcaggtcccaatgtgtccccaccagctccttcttgtttccagatgtatcatttccagagtgttccaaaataaatcaataaaaatataaataaataagctcaatggtcactaagcctccaggcattttggatcaaaacccaagaagatatcatcttgctcattaggaaaggccaaaactattggaaacaagtgttggtaaaggtgtgaaggagaggaaaaccttcatgttagatgtagactaagctaatacagtcatcatggcaaacaggagaaatgtctccgcaatttaccagacttataactgcaatatgataatatctgtgagtgtgagtgtgtgtgcgtgtgcgtgtgcgtgtgcgtgtgtatgtgtgtgtgcttgtatgtagacgggttatctgtattctcacatttgttgcatcactggtattgaaagaatccaagattcagatccaatctacttgcctagtaaagatagctgaatagaggtgtgatgtttacaaacacagtgttgctatccatacttgaaaatgagaaagaatctctgttttgacagcgcagatgacctaaaggccacacattttgaagagtaggccagacacagaaagagaactactacccaacctggtaaaatcttatccttctcaagaattctgatgcttttgatgactgttagtcttgccagctcaaagcaaaacagatttcaggaacaggtgttttagggtttatctatgtgaagataggaaagtgtaaagtatatgaaggtctgggaatgtagttacaaaggtctgaggatggaaagtcctaacacggtggataaatgcaagttatgaaggtctgagaatggaaggtataaaggtctgagaatggaaggtcgaagatggtaatgtaaggtacatgaattaaagttatgaaggtctgaggataaaaaggcttaagtgatgataaagtgagttgagacattaaaaagaatgaaatatgttcctgatttctctatttctcatgctgctgttaatagtcagtaaagttctacaataccactatatgatcataactactgggccaagattaagatgcttttcattgtccaaaaaaaaaaatctgtcaattttaaaatgttagttctttcagccaaggtacttctaacatgaatatgctgctaatgtgtctaatacttatgtttccataaactctaaggattcttgtaagttccaagaagctgaattggatccaaacaaacagatcagattcactccaaataaatattattcaatctttccctggtcccaggactcccttccctcatgttgggacccctttaggaaaccctccctcatctcacaatcttcccctcaagtgccaggacctaagaaattatttttttctaaacttaaccttgtcttctgctctgccaacatcttgccaggtctaagaggctcctaagggagttccatacagcctggactgtgatgaaacaaccagctaccccaggacgtggcagcaccccaaccttctcaggtcccccaaagatggtcaaagcccccccacgacagcagaaagcagtcttgagaatttgacatacttattccttaatctgccatgtctaacaacccatctttttaaaaaaataataagtaaaggtaggattgaaaggttcaggcattatgctggcctgcccctgttacctggcagaatccactcagggggaatcctgggaggcccagggttccatgggaaataagtctgcacacaggtgcaaaggacccctttaaaagacagacccctgcccatttatgctctctctattttctctactcctctctctacttcctcctcctctactcttctctctctttctctctttctggcgaccagccatggtggtcagccattaaccctgtttctcttctttcttactctctctactctgccgggcctataataaactggttaatatgtctaatagtctcatgtctcatcttgcactgccttttctttatatctaatttaaacaaaagtctaacaagatcttcagttgatcaacctaagcaaattatttcagttcaaataatagcaaaattcatagagtagatagattaaaccacaggtatttctttcaaactgtgtcatagatggaagtctcatatcagggtgccagcaagggtgagttctggtgagagccctctccatgacttcaagacagtcatcaaagtcaagacagtcatcctttctttgtgtgcacatgttgttgagagaaagaactcctctgaagtcttctgacaagttaagaagtcctggggacccctaccctcatggcctcacataatctcaaggatcactctaagttcacccttttaaaacatcactttgagggttaggatttcaacataagatttttgtgggaaggaacataaatagtgctcagtgtaggtacacacacacacaatacatatatatatatatagatagatagatagatagatagatatagatatagatatagatatagatatagatatagatatggatatagatatagatatagatatgtctgtatatatatgaatgttttgaataataatacatatattttatgtatacatatatgagagtcatgtgtttatttggctttataaagttcagcctaaacatttataagtacataaatgaacaaaactggatggcagtaatagacacaagttgagagtccctggaaattcacaagaaacaatctggaggcttcagagtgttgtgggcatctcctcacctgcacaaagatgaagtgtaattgacacaacttcttgtaaggagtgaaagaatctagaaaatgttgaataagctttacaacccacagaatatgtgatagatgtaatctgcttagctggtatcactgtatctggtacaattgttgacatagttagaatctgcagtcaatttgacacaaacagtgagtcacttgggaagagggaaactcaagtgaaaaatcacccagtttagactgatttgtgagcatgtctgtgtagcattgctaaatggtaattcgtttgggttggcccagcccattgtgggtggtaccaacccctaagtagagaggcctgcataataatgtagaaaatgcaagaaaatgcaaccatgttcattgcagcattttttttattttaattttagaagcattcttatttacatatcaattcccccattcccttgtcttcccatcctcccatgcccccccccaaacccccaccccaccccacacacactcctcagggatagtaaggtcttccatgggaggggggacaatcaaagtctgtcacatcatttgggggaagacccaggtccttctccccatatctgggctgcaatagtatccttccacaggaaatgggctcccaaagtctagggataaacactggctccactgttagaggtcacatagactgtcttggactcctgaacccacattcagaggccttggttcattccaatgctggttccccaggtcttagactggtgtctctgtgctctcactaggtcaggtcaacagtttctgtgggtttttccagcaccctattggttcctttattcatccctcctctctttccacaactggattccaggagtatggctcagtgcttatctgtgtgtgcctgtttctgcttccataagctaccaaatgaaggctctaggaatggcaaccaaggtagtcatcaatctcattatggaggaagggcatcagtggcagcctctccaccactgcctagattcattgttggggtcatccctgtgggtcccctaacatttcccttgtgccagacttctctctaaagctatactggctctttctatcaaggcatttctttcttgctctcctctatccctcccctgtctcagtcctcctgttctcctccaccctccccttttcccttctccccttcccacctccctcacccccacccatgttcccaatttgctctggggttcttgtctccctccccttcttcaggggaccatgtgctcttctcttggggtcctccttgtttcctagtttctctggtggtgtagattgtaggctagcagtcttttgctctatgtctaatatccatatatgagtgagtacataccttgcctgtctttctgttattgggttacctcactcaggatgtttttttcttccagtttcatccatttgcctgcaaatttcaagatttaattgtttttttccactgagtaatactccatgtcgttcattacagctttattcagaatagctaaaagctggaaacaatctagatgtccctcaatggagactagataaagaaaatgtagtacatttatgcaatgtagtatcactcagctgttaaaaaattgacatcatgaaatttgaaggcaaatggataaaagtagaaaaaataaccccaactgacatcacccagacccagaaatacaaatattatatgtactcacttataagtaggtattagctgttaagtaaaggataatcatgctacaatccacagacccagagaggctaagtaacacaagggctcaaggtaggacacatgggtttccctgggaaggggaaatcaaatagattttgtgggtggactgagagtgggtagatatgggaacaagagaggttaagcagtggttggggagaagggagagaaaggactaggagagatgactggaactgggggatatttggagattatgggactatgcagaaactcaatgcaagggaaattccctagaatctaagagagtgaccttagagaagtctcctagtagtggggatacagagccctaacagttcatgttccatgtaaggtagctggactgggccatcaacccagccataaagccttcaacctacaatctgtcctgcctgcaatatggagctagtgcaatggtggaacagaacttgtgggagtggccaacccatgactggtccaacttgaggccatgaaattagaaagagcccatgcccaatactgcctctatggccaagaaccagaagctggaaagcccagagacccaggatagatagaaccaaacaggactgggaaaacaaactcatagtggatagcctaattgtcaccagagaaatagcatccatcaactgatgggagcagatgtagagacccagagtcagacaagaagcagagccatggaaacctgacatgaattataagagccagaggggacaagagtaccatgagaatatggcccatagaatcagctaagcaggcttcatagggtcacagagactgaagcaacaaacacagaccctgtatgggtctgagctaggtcctctgcatgtaccttatggttgtgtagcttggtgttcttttgggacacccaaccatgggacacttttcatcctactgagttgctacatccagctgtgagtttgtgcccagcctgccccccccctttttttctgtttttatttttttgtagggaaatggaggaaagaggaagaagtgatctgggggacaggggagatgagggaacaactgagaggagagaggaagcagaaactgttagccaaacagaatgtatgtgagaagaataaaagttaaaaaaagagagaaaagggggagaaagaaagagagggaggggaggagtaagggaggaaggaaagaaggaaggaaggaggaaggaaggaaggaaggaaggaaggaaggaagtcatgccacatgggggcaagccataagccgtgccactgcctggtttgtgtcttcaggttcctgccttgagctcctgccccagctttgctggatgatgaactataagtagtaaattaaaattaaccctttcctcccccaaatagtttttggtcatagtgtttctcccagcataaaaaaaaaaaaaaaaggaagaaaaaaagaaaaaagtacacttgaacaactactctggagctatcttctgtctgctgcttttgatcacagtgaacttcagatgctcactttagcaaccgtctaaggagccacttgccttaaactccatgtgtacattacttttcacagtattcagcagagacaggtatttctgagagtttcactagaatgttttatttctgatacaaaattacaaacattaaaacagcaatcaaattctagtttctttacaacaatctggtagccaaatttaattttttcccattttttaaaatttgaattagagccgggcgttggtggtgcacgcctttaatcccagcactcgggaggcataggcaggcggatctctgtgagttcgagaccagcctggtctccagagcgagtgcaggataggctccaaagctacacagagaaaccctgtcttgaaaaaccaaaataaataaataaataaataaataaataaataaaatttgaattagaaacgattgttttatatgtcaatcccagttccctctccctcccctactcccctaccacccccaactaaaactctacctatcacataacctttctgctccccagggagggtgaggatttccatagggggtcttcagggtctgtcatatcctttgggatagggcttaggcccacccctgtgtgttgtggctcagggagtattcctctatgtggaatgggctcccaaagtgcacacctatgcttgggataagtactgatctactacaggaggccccatggatttctgaggtctcctcactgacacccacgttcctggggtctgtctccaaatttaaattttaatgactttttagtctctctctctctctctctctctctctctctctctctctctctctctctctctctctgtgtgtgtgtgtgtgtgtgtgtgtgtgtgtgtgtgtgtgcctatgagtgttttgtaagtggagtgggagtgagtgggagttagtacatatgtatgtatgtgagtgtgtgtaggagtatgtttgtgcaatggcctaaaaagggcatgtggtcttccggagatgaaatcacaggccactgtaagccaccttacatgggaactgggacctggactgcagccctttggaagagcaccaagtactcttagctgtggatatatctctccaaatttggttttaattgtgcttacatcttgctcttccttgtacataattatatttacctgacttaacatttcctccatttttgtcaaagtgctttttctatagagttccgagtgaatcctcatgctctattagagacttgcgttgttaacacacacttgactcaagtctgtcccagatattggtcctgtacctttgtcgtttcaaatactggcttcccctctttctctttagaattcagacattgttgttgatgagatatgtgtgctctcgtacagcttcatcagcaaaggtccacattttaatatcatttaagtttatgaaaggaagagctactgaagcccattcatgataatttctttttacagtataagaatctgaattggactttatattaaatacagttgttaaaaactgcagatttgtgaggcaaatgaaagccataagtttagcctggagcagagctgccaggcaagccaggggaaagtggctcctatggacatttgcctttaggcaaagtcttttgttagagctcctgaactagcagctgaatagcccacaggctctgagagccactgcaaaagagaccaaggtttgactgcttaacccatcttctctacaacttccctcttgaattgggtgagctaaaataaagttatagccttgagaaagaaaaatgttcgcattctaccactttcaactttagaaactccaaaccagcaccaacttgttgcaaaggttttcattggaagtgaagggggaaaatcaatactctggttcctgtgatcctccatgattgtagtaacattgcattcacttgcctcatgatgaataaaaccatcattgcagcagggcaggccagagatcttgtgaatcaaattatgacataaatgcaaaaaatgaattttaaccttgtttcacatttcatttgtcctagagaacatagaaaatctgaaacatgttcatgattcctgtcttcccagaaaagaacagaatgtggcatcacactgctgaggagaatagtaagactggactaaatagtaagactggactgaagctcatacaaggacatcctgtgcttttagcattgtatttgttatctaaggtgtgttttggttgctctgcattccagttgtagaaaacactgctaaaaagggatagaaacaataattaacagatataatttacaataaaatacaatacaattctgatgcagtggctaaagggaaataaagaggccaatagtataaaacctgctgaatccatttactgttgcttatgtgtatatatttcagagctgaccgctaggtattgaataaccaactagggagatcatccccagggaagactaattctccctctcttagccttcatatagttgcctgtagctctttatctaggtgcgaatccccatgaaatttcctcttccaccttagtaggtctaaaggggctgtcattgttcaggtcttcttttaggcagccatactattgaggtatcatggttgtagctttcctattgtttctaggagacacaatctcatgaaagacttcatggtcctctcattcttacagtcttttcatcttctctctattgatattccctgagccttaggggcaaggattgtgttgcagatgtatttcctggagctgggtatagcaaaattggttgatccccgaattttgatgagttgcagttttccgtgaaactctcagtgtgttgcaaaaatgaaaccactttgatgaggggtgaaagctacacttacctgtgtgtataagggcaagtgctagattacaagttaaggaaatatgctggctgagtaaagtggtaatctagaggtagatctcctctaagatatgcaacattattagccttgtgttcttgactagatttctaatactggacacaatttctttcttgttgagctggcctcaaatccaattagacggctatttattcttgccaagttatgaataccaccattggacctttagagatatctttccttggccgtcattgttgtagattctaggcaacaagactgggtaggactgttgatctcttcctctctcggcatcttgcatagcaatttctggtactataaaaactagacaccagggaggaagcttccagatcagatccagcacacatttgagtcatgtgtctggtgatgtcatcagtagtacttaccttcaacttctgggagacaaccaagagcaagagcaatagcctatgttgctttcagtgtctcttggacatccagtcactgaaaaggtttctcatgtctgatactagttttttgttcctcatatgtaacttcatatatgtagtccttctgcatcctatttctctgtagctcaagtcagtgtgtgtgtgtgtgtgtggtgtgcatgtgtaattttacgtaaaattaaataatattccttaaggcatctttgtcattgattgtctcatcctctccctctgtattgacctcccttcccctttccattttttccattcttcccattcatatcacctgtatcttgttattctcctttcttggccccctcatggtcaaagaatgaatttaattaatgaagaataagtataaggaggaccaagcaggcagagatggagacacacacacctggccagagccatttgccctgggcagggaagagaaaccacagcacacctgaggccacctaggtagtcaagtgccattatagtgaccaaatatattgtggggtatgggagagaagggaagaggcagaatggttcatttcctatggagagagacaaatctgaagaggtaaaggtggcgaggaatgggctcatgtggaaggcctacttaccagggcctgtgttaatgtccatggtcccttttgccaccaaaggtcacacagatgcctagatttctcagctgccacctatagccatattaggaaccaagggacttgctgcagccaggaccatgaagatctgagtggcctgcactgccacctatggttattgggtcaaccaggcccaaccaagctgctgccaagggccacatctgggtccatggccctcctgcagccagggcctgtgttgatgcccgtggctctggtaactacctggggtctagaacaacacctaaggctgtgttggtgcctgagggtcatgctgcaaccagcaccatgttaacatctgcccaagctggggggcagtgagcccacaggaaaactagcctaccgcccccctgagagctcccactttgagaaagctggtcccacccctcacctgagtgagcagaggtcccagcagcctattcagaacaatccagctactacccagacacacatacagggcactgggtgggcactccctaacatcgtcacattctatgacctgttggagtgcttaaagggactgatcctgtagaaacatagatgcaggatctccatgactacaggatatctgagagtagtttcagtgagggtccagtattgatggtgtcccagaagccagagtccttgaacctgaccaacaacacattacacaatgaacatttgcaagcaaagctgtgtgggcaaatataatggatgatacacagcagctcctactactgctaagacaaatgatgaggtaatagagagacagaaaaggaggagggaaacagtttggtggagttcttggtttttagattatttgccttttattttatttatttttaacttttatcttaagtttattttttttccattttccttttgtgtaaggatactacaagtttgaagggcagatacagagggactgggaagtaattgggttagggtgcatgatgtgaaattcccaaagaatcaattaaaagatatgttaataataaaaataagtataagaagaaaataaaattctctagcaaatatcaattttagagtattcaagactacataaccaatgctaaccacttttaagtactattttaatcattacacttgcaattgatgaattttgaaatgagaattttacattccattcaataaaattaaatctttgtttctatataaatgagggaagttgaatattctgcatccaaagtaaatgtctaccaatgcattgacttgatgtttttacttcagtgattattggcaagtgttcagcaccctcagagaaaatagcacatattatgacctgaggtaaaaaagagtaagcattaggaaaaggaagaaatcaaacgatatatattttgtgataaatccttcctattttgtgcatacaattaaaataaaaagtcagcatccttagaaacagatacagaggccttaactccttgaaacacaacattaagcctgctctggctggattccatagttgctagctccatgagcaggctgccttcataggattctgttgtacaaattcactctggttttaatgctctgttgtcatgtttcattttaaatggttttttaacacctcactcattttcactgggtaccacaaaccttgaagggaatcccatctccaggatcagtatgtgctgtggagagccagctagagggcatagaatcttctaaaacctgcttaagtggtccatgaagcatcactgagtagccacaaaatcccacctagcttaaggagaggggaattagtctaagtttctagagagtggggatatttttatagtcattatttgacacacattttgaaaatattcaaatatatagtgcattaattaccataactaagtctattcctcacaactcaagcaatggtaagaaatactgcatacagcagaaagtaggaaaggtagaggctttgcagccagataacttgatttgaatccagttgttgctgagatcagtgctgtgataattttcatagctgaattccttaactgtgaaacgatattaaatatagaaattacctgtcatgattattcatgaaagaattaaacatttgtgcatttaagactataacccattagtattttattatctgattaagttaacaaaatcttagagtgaagatataatgaaaaaaattagacatatattattgctttgcagtcccaatagcatgaacgccattcttggattcataatgataattacattagcattacagagaagagtgtattagtttgccagaactgctacaaattctatggcttacccagcacacatttattttcatgttctggaggcaaaagtctgaattacagtcagcagggtggctccttctgtgggctctgagggatggatctgttccaccctctctccttggcttacaaatggctgaattttcccaggggcattatattgtcttttttctatgtgcatttgcgtccagaatttttctttttaaaaggaagcagtcctttagaaagaaggcacacctgaatgacctcactttaacttaatcatctctaaaaaaaatcccaactgcagttctctttttacctcagtagatttccatcaaactacatgaggtctctgctgcccacccacaaagcaagcctatattcctaaactgaggtcccaatgaggccaaactccaaggaccctcctccaggctagcagtatattctgggggatgctgagcaggtggggttttggggaggcatggcccaccttgagaaatggagctggccaccacccccaagtgctcatgggaagtatcaaccccaggctggttgttgttacaaatctctttcaaatgtattcttttgatgacaaaaatgaaggagctttgtaaattctttttaattaagaatcatgttgattcagcctcaggaatttcttcagcctatgggcccttagcctgcgacaggtacctgaggagctacaggttaggccaagaatatccagaggtgtactgagtaccttggcaaatgcaacagtggtagttgggatttctcaggctgggaaagactccctccacgatggcagtggtgatggaggtgggaccttctagggaggtatgcaattatttggaacagagatcatttgcagctgtctgtgaaagctactggacctctaattgctacttcttcaggaccattcttcctctagtcatgcaggctattccacccatgcacaacttcttgtgcagtgcccctggggtcagacacatctcaattttgtctggcttgtgccttggaacctcccccacagttagcagaagtcatctgccagtactcaacagttttttttccacagacagtgtgagcagcttactatacacaacagcttccctttttatctccccttcccagagttaattttttccatgcttttgttagaagagaaatttagaagatacaggcacaaattaaacagattttattttctgtctgatggtaataggtcttgaggagaaaaattaagcaaaagtggataaaggtgaggaagacgctgagacaagatgatatttgagggaagtaaataacaaaggggtgaggaagacgctgagacaagatgatatttgagggaagtaaataacaaaggggtgaggaagacgctgagacaagatgatatttgagggaagtaaataacaaaggggtaagagaaacaatgagtatgtcaatgacaacagcatgaaatctatgagaaatgtccatggggagagcttgtggtttatcctgaggtaggaaataattattaggtcaagggcaacagcatagcatctgtaagagaaatatccatgaagagtttgtaatctatactgagatagcattatcgttagtatcctagaggatgtccttgtgcaagtggtgggtagataagaatgaaaatgatgagaacataaagccaacagcaaggaaataatgtgacttgtaaaccaccatgtatgatttctcatgtccctgttgaaaacagaacctcagaattcagaacaaagaaaggtgtaaggagagaagtggagaaggttaggaaggtctaaacataaactgagagtgtggtaaaagtaatggataagaggctataaagataattttctgagagtgcagtaacaataacataggcagggtggttaggtatggagtgttagcaatggctagatcctcagacaaacaggatttttcttaattttaaatttcaatgttttgataacttcaaatttgaatactcatttccagctctgcctctttgtcctctaactgattctgtgtcctccaactccttcttaagctcatggtctcttctgtggttcctttcctctacacacacacacacacacacacacacacacacacacacacacacacacacacacacacacacacacacacacacacacacacacacactgagcccatatagtgctgatcttatgtacaggtgtttaggaatgatcacttacttgggtttgagtaatctatcagtggctccttcctttagaagactgcttttccttttctcagtggccattgattgactgtagctcttcatctagggaatctctcctatctgtaattttgaacataatgtttcataacatctatccacttgactcattcggtagagtttgggcatcctttttatcaagtttgtcatatctatgactctgtcttgtaacaaacctttacagtattctgtaattttggattgtgtgctttctttcatagaattttatgttaagactcattcagccaaaactcatgaacctttctattatctcacacttgccactgctctttaggcaaatgtttcttttcatttcttgctataggaattagaacattatttggttaaagcaaactgaatccaaatgaagcagaaacaagcaaaataaacagtagatgctaatagacaaatatatcaggaagtttctaatatgcatcccatgtttctaatagattcagtaggctttggaggccaacatcagggaacgatcaagttatcaatttcacattatcaacaccagtaaaacattgcatatgttttgatccaaataaagaaaattagtcatagtcaccattaaggatacaaaaaatatgaattccaaactttcatagttggaattcagcatttaatttgcaaatactggtaaataaatgtaaaattctccaggcaaacaaagacatgaaaaagaatgatgtatatgggtaattgagaatctgttctatccatgaaaccagatttctggagctgagaactgacttttcattatacttattggacatcagatagatgacacggaaacaatatattctcaacaaagtagctgcagtaagtagccttgcaagtttcatgtccaggtcacaggcttatctgtgccctggcattctcaaagcagtttgtgacacattaaactctatgaaagttagaaactttcccagatttgattaagctgcagagaacacaaagcttggaaaaatataatttgatttgattttatcaatcatttttgaattgtatgcttgcttacattcagttttcaacacaaatatcaaagataatttcattccaacaagaaaaaatttttgactcactattaagaagaaccttataatttatttgcccatttaggaagccaagaatgtactatgtgagcaacaataaaaattgttacatcacatgcagcttcatttgagcttggtttatgattcagggaaacacataaagtagcaaggcaaggatgtgatttgccttatgctcaatggagtctatgtttggcacatctgtgttatatttaataaaacagtatatatttagttctatccaatagctacaattctagtattttcagtgtgttcattgtaactcaaattaacatactggagaatatatatttgaaacaagttttgattctgcatgacactaactaattatttcactgtttgtaatacttggatttgttgagatcacaaccataattaacaagattatgccataaatacagtgtagaggctaccaataaaagcatgctgacagttaaacagagtaccactgagttagtttcagaacagaaggataaaggaacattatccatgacagcccaagtaaattttaattttgttatatttactaacattttcatctccaattgagaaaatatgtattgtttcttagcttagtttctaccaaatgttatagattcttatataattttcaacttgttcatctattatttttgtcctgttagcaacaacctccttttcagtgactcttcctgtcaatgttacagatgatgctctaggttacctgacaagacagataaagactactgacttttccaaacatcatgaaacatatctggtttctaggctatcaacgtattaatcatgcaatttttgtgaatggaaaaggaggaaatatacaaagtagtcttccatatcttgtattttgcatgtgtataatttttgacacttgtagcttgtctataaagctatgctcaaatatttcgataattcaaaatatcatcacttcatatatattttaaaatttgagagtgaaaacattgctcaagcaaaacctagtttataaatctgagagtagtagctcacatctataattacagcactcaggaggtatgagaactatagccataagtttgagacaagtataggttagagtggattcctctttaaactgggctagaataagattctgcctcaaaagcaaataagtgaatattaatgagcaccacatttcagggatgaagtttttagtatttttgtgtggatatattcaatatatagaaacattaaattacattttcagatttaattctaagaattaaatattcttttcaatatttcttatagcttaaaagacaaaaaggtaacctaaaattaggttggaactatatttaataaaatgctttaatatcttggtaacaaagtaatttcttagacttatagctagaataagttctttgtcactttttccacacaattcttaacaagattgcacattggccaagatgacctttggcttcaccctgctgattgtcagtgttatctgaatcatttctataatgaagaaaaattacaatagttaaaattttcctttattatacttcagtttactttaattaataacgatttagctactaatttaaaacccagtcagctccataataattaagatgcccatggatgctgtataactatcttgctatagccaatcttttgtttcataatgattcatcttcaaattttttgttttcctctcagagaagccatctccattgcagcaataaattctaacctccaaaagcagtcattcccaagacaacactgtatttcttccacgatgtaaatgtcacatgctatagcatctagggtcaggcgttctaaaaacacagaaataccagctatatatcattttaatatgcttattgaaaattcaacattatatgaaatagaaattacttttatggaaatagaaagctttgatgaagaattgagctcaatttgaatgatgaaaagtagcaataacaagactgaagctatggcttagaaggacctgagtttagaggccaatcacccatataaaagtgaagtacactgggataggtttgtaacccagcactgtgtgaaaagacaagtgcatcctgggagcttgttggcaatcctatcagcctgaaactgcaagctccaggtccagtaagacattctgtctcacaaaacaagatagagaacaatagaggaagatactcttgtctggcctttatattagacacacacacacacacacacacacacacacacacacacacacacacacacgaggtcacaaatatcaaaggataaagaaagaaaggaaggaaggaataaaataataccaatatctaatatgctaatattcttcaatacaagtcataagaatatgactctctaagtctgaggagtcatactctagactgaaatgaagattttatgtacaatctttaaggcttgaccaaaagaaattacacggatttaactgacaggttcatgaagaaagctgctatccctacaccagactgttttcttgaaggagatgttctagcaaggaactccaggcccttggaccaagcatactcatggctattcctcatactaacctccaactggaggctgatatcaggaaataccactgaaatgcatttctagagccccagccaaggcttttgcatatctaagctacttttctcagttctggttcattacttaccactcttgttcctccctgtttccccccttcaacatcctggaatctgtaaatgagcaaagaggcaagtactggggcccctggccactaagacagtcccctctgcctaaacatgtgtcctgtctgcagcaggactggtgtttcagaggaaacaaaccacagtgaaccaatgcttatttccatgccttgcaaccctgtaacagcaggtcaataaagccctgagtcacatgacctctaatggggtgtcttaattaatcacaatgattatgaggacacaagattgttcacaatttcactttccacttagttgttttcctgctgcaataatgaatctaatgacaagtcagtagacatttgtgtaattggggaatttcctcatggaataggaaattattaaaacagagtttctttttaaattaaattaaaaacaatctgattttacacactgatccaagtcccctctcccctcctgacataaaatatcttggagtaactctaaccaaacaagtgaaagacctgtatgacacatcgttaagtctttaaagagagaaattaaagaagatatcagaaaatggtaagatctcccatgctcttggataggtaggatcaacatagtaaaaatggcaatcctatcaaaagcagtctacagattcaatgcaacccccatcaaaataccagcacaattcttcacagaccttgagagaacaagactcaactttatatggaaaaacaaaaaactcaggatagccaaaacaaccctgtacagtgaaggaacctctggaagcatcaccatccctgactttaagctctactatagagttatagtagtgaaaaaagcttggtaatggcacaaaaacagacaggtagaccaatgaaatctaactgaagaccccgttattgatccacatactatgaagacctgatttttgacaaagaaactaaaattatatgatgagaaaaataaagcatcttcaaccaatggtgctggcataactgtatgctgtcattagaagattgcagatagatccatatctatctccatgtacaaaacttaagacaaaatatagagtttctatggagatagagatagagatggatatatggatgaaaaggtgatagattagatagatgatgatgatagagagagatagatacatagatagatggatgatagacatgatagaatatcatgacagatagatagatagatggatagatagatagatagatagatagatagatagatagatagatagataggagagagttgttacatttcttttttaatgtgtacattagtatatttatattttctttttttgaaattacaaacaagattgaattacatgtagacacagaaatgatacctatcaaattgttatctttgaaaaggaaggaaagaaaatgatcatttatggaaacagtctttgtgatgccacaatggtgctaataatgcagtatttttgtgttcaaatttattaggtttttccattattatatattaaaatacatgatgctgcattgcttattgtcctagttacaccctaacaattaatataatgtaaatattgactcttccttcttgacattttaaacatccaattaatctctcatgagcaagaaattgttatcacccaagctacattagtaaagaggccaatatactgagcaggaaaacaaagtttcgtagtctaacagctgcttaattagggagtcgagcacttggatcaagtgaggcatggaaatggattacacagcatttccatgggcaacacattatttatcaataagggcagtaatgctactttgagggaaaactcaccaaagcttatttgaacttggagctgttcattcttctcattctttttaagtaatttacatggcaggatatgtaaccattatagcttctattaagttaaacaattcattatttccctagcagagcctaggggaacaccactcagtgaccataaaacttgattctagtaaagtttcattttcagaagcatgccattaattgcatgttttaatgaagaatctgtgaaatgctggagaaagaaggcaagtttgcagggaccactggaatctacagatgaggtgagttaaagagatgggaatgagggagatggaacatcccctaagcagcagctttattcagtgcatgcccccacaaaaaatagaagacatctacattctgttctcatctttatatcaaaataaaagagggaaaattccatatgggtagctgaactaaatatatcaatactactttcaatttcgtgaacaaataaactcttgccctataataacaatcaaaataatcacatttcagatgtgtttgtaagataacatgatcaacaaaaaagccattgttctaccatttaagaaatgtgtttgcatctgctccttgtagttgcatccagtctacaagctctctgttcctagttcatcaggaggtgccagattctctgtaccacctatgattccaattttgttttattgtgtagtactgtataaccataaactgtttcaaaaataacaaagtggatgtaatgatgtatccaaacaaaatgtaatgtgatgtgaaaaggaaatgaataaaacattttttgattcaaaaagaaaaaaaggaaatgttaggcgacatttatctaactttatgtagaggtgggggattcatctgaacaatagaagcaatgagataaaacatctttcataggtttagagacagtccagttttaccaattaagattttgctgaggtaaaacaaacaaaataaataaacataaacattactcttcaacctgaagtcctcacatatggcacatatatacaacatgtcctttgtttatcctctcattatgttaggcctccactttatttttcactttaacctatttttgaagaccttaattcatttatttcttacacaaactcacctcttttgaagtttctttcatgggtatttgtgtgtgtgtcatctgtaaatgtctttactgtcaggagtttaaagaaaaatatattgcctgtgagtataagattatattctagcagtgtagccaattcctggtaaagacataaactgaaccccccagaaaaaaaatataatccaggttaaacatccaacaaggttaattgactgctgagaacttcaatgagtatagaaaacttgaaggctacaggtctagacccaaaaaaccttctgttgtctcagccctaaatagccatgcactgcacacttctgggtgcgatttaacagtctgtgactacttaactcaaatcattttaggaatgtacaaacagacccataactttcaccaacccaaaggctaagaatgccatcagatagcatctgaggaacttaccgtagtttcctggcatcctgggacctgcttccctcatgaaaagttccctgatttaggacattctttgttctggtgtggatacatacatgtatgtatgtatgtattatgtatgtatgtatgtatcttacacctgttagccacattggagaataatatttgaggtaaccagaatctgggctatagaatatttatttatagaataaactttcttactccctttgaggtaagagcctttttttttttttttgtacaaacaattaaaactagcatttgcctctcaaaatatcacttgcaggatgtctggtgaaccaccaagattttctcttagaattaagtgtccatgggaacaataaacagcagataatgaaatgtgaataaattgtatttaagagtgcagaacagagtttaaaaggcatgcgatagcacccatcattgctatagttactaagacgcctggctcctaaagcttagaaccacttctctcgcttcaccgttaccttcggaaccctcaacccaagctgtggatactgacttcacctgaccttattctccctcacattggagcatcttccagcaaagggacgtgacacctaagaaggctcccagagttacatcttccattttataatggtgtagagggacagaaacgaaattagggaaaggacaacttaattcatcccattgcccatttcctgacggtttcctgctgtctgatcactgatggccttctagcacagttagaaagcctgggtctatcttgtagagttctctttggaagtcccaaggtgatgcccaggaatagtagttctgcttctaaggcagccgtagtagtactgtgtgaagcttatgccatttttgcccttgacaaagcttcagagtgctatctgggtttgttactagaagccgttttggaagtgaagtacatcaagtctcttcgtccttaggggtcagcccttgattccatttcaaaatagtctcactgaaagtttgtcttatttcataaggatttttcttttaaagtactctggtatagaccagagtactttattctagcagtgtagccaattcctggtaaagacataaactgaccaacagactgctgtggctctgaaaagggcagtgggtaaaagttgtgcagtgagaaacacagagccatgagtattaacagggaatttcaaggatccatttaattttccatgactgcttataatcacctacagacattgaaaatgaaggagttatgtcatttggatgtgtgtgtgtgtgtgtgtgtgtgtgtgtgtgtgtgtgtgtaaatatgtgaatctcactgcagagagacagacaagcaagagggggacagggtcatgggaaaagagggaaaaagtaaaaagaaaggtagatacacagaaagaaaaagcaagagtgaggcagaaaaacacacacagacacacatacacatgggggtggggttgcattatgtagcattaaggagtcataaaagtgatagaaccattcatggcaatggctctcaacctgtgagacatgacccctttgataaacctctatctccaaaaatgtttacattatgattcataacagcagcaatattacaattatgaagtagcaacaaaaatagccttatgatttgggatcagcatgaaatgaggaaccatattaaagggatgcagtattaggaaagttgagaaccactgatcaatgaactggtgtccaataaagatgcttttagctgagtattttcatttggagaacttaccagagtctacttcaaagttgagtgctagggtaactctcactgaatcataatgtaaattgaagacattgcaagtcagtttttcagagattgccaaatgcttcaaagaaactgaaatgaaaagtgatgggtttcaagatggatagacttatttttaatatactaaagtaggaataaaatacctgttacagagacagttaatcatctatcttaatgaaaatacttacggaaaagttgaaaatgaatggaatgtttaaattttgatcaagtatgtatgaaacatttttacaaactacaactggatatttttactttacataaaaagcaactgcatgtcttttatttgttattatatcctgtcctgctgtgcacaagaaaaaataatctctgaatttcctgtctgttcttctccccaaatttgcttcatctaaaaatctattcttggatagataaatacttactaatttacttcagccatgatctatatagacttttattccaaaaatgaagatattgtttaatttgcaaactcccttagcttcacttccctccttctagctctaataaagttatgtcattattcataactccattgtgagcagctttaactaaatttattggacaaatatagatagtataattgcagacttattttattctatcaattatgcagcctgtcatggcaggcactgttggcgggttatattgcatcaattttcctcatttctgtttacagaaatctaattgtatcttctaaaaactggggccttaatagcagacccctgtgaagttaaaggttacaagagttaaaatgtatataatccccaatagagtgtctgtatagaggaaatacctgcttgtgttcgctaatactgttggtgactcaatttctattgaaattattttggtctcagaggacgagaccaactccacagggcaaatgagagaatagcattcccctttgccaataattagctggtgaataaaatgttatgggatgtctgctttgaaagtaggactgcctctgggagtacacacagccttgtgaatgcacagccaactgcagtaaaattcaacttaaataaatgttataataggaaaatattccagatatagaaatatcttcacagggactagacagatggctcaaggttaagagcacttgctgctctttcagaaggcccgggtttggttcttagtatccacatgacagctcacaactaactgtaactccagctccagaagatctgatgtccctctcttgtctcttatactgacttgttttgtatcaccttgacacaagctagagtcatcatcgaggaaggaaccttagctgagaaaatgcttcaatgggatccagctgtaaggcattttctaaattagtgatcaatagggaaaagcccagagcatggtgggtgttgccatccctgggctggtaatcctaaattctataagaaagcagactgaggggctggagagatggctccatggttaagaacactagctggttttacagaggtcctgagttcaattcccagcaaccacatgatgactcacaaccatctgaaatgagatctggtgtcctcttcttgcctgcagggatatatgtgggcagaatactgtatacattataaataagtaaataaaatcttgttttaaaaaaagcatactgagcaagccagtaagcaacatctctccaaggcctctgtatcatctcctgcctccaggattcccgccctgcttgagttcttgtcctgactttctttggtgatgaacagcactgtggaaatataagccaaataaatcctttcctcatcaacttgttttcttggtcatggtgtttcatcacagcagtggaaatgctaactaagatatctctgtaggcacttccaaacatgtgacatacaaatacagacacatattcatacacatccatgaaaagtaaaataaatctttaataacaaaagaaatatttcagagtgtggagcaaggaaggaatccttaataaaaatcataaaaaaaaacataaaaccaccaaggaaacatttgacactttgacaactgtcaaatctaattaacgccttcccagtaaccaaatcagtgtcaacagcagtcaatccttgcacaagagaagatggcaacttctgtaagtggacacggagatgccacatataagaccctatgagactgtaaacaagaaacagataattaagcaaaccatattaaggaaaaataaagtacagcattcaaatgtactgacataggaatggtcagatttatggtaaactagagactctttcttttttctatcaacaccaaccatggtcctcatctacaagcaggcagcatccaagtgaaatgcctcgcttgtgttattcttctctgttacagcctagctgtagggttaagccttaggtcatatatacacaattaactttggtgcttccctactatcaggtaagttggattcatgttgctcagatgtgtttctcaagtctaattttgattgctaattcgtctacagaactgattcccttctccagtgaagagaaatggtccacttagccagctctccctacttcacaatgcaattggtgaagttctctctcccacttcccttagataggtgcattcttgtttaatgtagtacttcaactctgtttaaaatggctgcagacaatccagaagcaggagctttctcatatattgcaaatatcacttctatataaaagattctgtcatatatatctgagtctctgaaataaaagtatacaaaataaatgtgttgatgttcttaaaatatagtgaatatgaacttgtattgattttttattatataaaaaataattgcttttccatgaagtcatttttcttccagttcttctcttattgtaaacaaaaaattatagggtaaaataatattaactgagtgattaatagtttttgtgaattatcctcctctcttatagaaataggtaattctcaattgcaaaagttagtagcaaagtagaccatattttccaattctgaggaaatcttaatctccttcaagagctcaaatatgatggccacaaaacagagacatatggctcatctccactctgccaaaagatagtctcttggatgtaaatctgtagcagatgcactggaaaatttttattagaaataatagaggaggaatgttcagaaaaagccaatcttattattaggtgcaaattaagccacacagaagagtgaaaaatcagatactgggtatttattttctaggtacctttgttatacttaagttactcttacatgccatgcctatctgatgaaaatgtgccaaaaagacatcagacaacatcatgaagttttcaatgtttctgctttgtattttattagatccttatcataaacacacactctttggatatcatcctgctaatgtatctatcagtaatcacattgataaagctgagtaaaccaaatataaattataaaccaaaaaccacctttgttcattacttttgcttcactatgataaaatactaagagagaaataatttctttgggctcatggtttgaaagatttcagttcacatagttcttaggacctagattctggggcaaaatatagtaacagcaaaggcatacagtgaaggaactgatctcacagcagacaaggaatagagaaaaagaaagagacagggtaaagtcttcaaggcaggtcctagtctcctacttcctccagcaggctctaacatctccagaacctcctaaaaaagggggaccacaaacaagggagtaattgttcagcagataatactggggtgggaaatatttctagttaaatcataataccatttaagatctcatctgctctgtagctagtgttgaattttaactaggtttattgagacttgtgtatctatcgactattactaaatcctcattgagattttatttaactgtttcatcaaaagctgaaaaatatcaacattccttccaatagagagtgaaataattcagaaacagaactgaattcagatgctgaacagtgacatctaagctcaactcagaaagccattggtatctagcttctgagtaaatctaaacaaagaaacgggcttcatttataagtaagaggttaatttgatcaattataaaattttataaactaggagagttgaaaattttgaaggttagaatatagtacttctctggcataaatgaagttatagagcataacagtgctagtctagaagagtattgttttgcctgcatatgtatgagtgcagtacttgtgtgcctggtgtcccagagggcagaaggaagcactggattctctggaactggagttattgggctgtggacaccctagcagaacatgtcccaggtcctttgcaaacaagtactcttaaccactatgccattggccagccctccctgcacattttgataaatagttttattgatttccattgtctgttggttttgttaatatctttcacaaagtgaaaattttcaaaaccacttcccggacacaataatctaaaaaaaaaaaaaaaatcacttccttaagatacggctcctatagatatattgagttggaggaagaatagaggagagagagcaggatgagagataccatatcagagggagccaatataggtccgagaagagatctggaactaggaagatctccagagacctacaaggataacacgatctgacagtccgggcagtggaggagaggatggcctagaagcccttcccctagaatgagattgatgactactctctgtgctatcctagagtcctcatccagtggctgatggaagcagagacagacatccacagaaatacactgagctgaaatctggaacctagttgaagagagggaggaatgaagaatgaaggggtctgtaccaggttggagaaacccacagaaacagttggcctgaaaaagggaaagcatatcgaccccagacgctctttgggaggctagtaggggactaatccagccccctgatcatggatgccaatggggaggcccctgcactcctgggagcctcctgaggtggactggcgttttgccctggtgtgtgtgggggactttgagagcccatcctacttgaagggatgcgctctgtctctggacacatggggaggggcttaggctcagcacaggaagatttggtggacttggtggagcccaaaaaaaagatacggctcctaactcctatgtcagtcagcatcctttgatacccaagagacttctgtgaatccagagtgaacattccagacacatgggcttggcaactaccactccaacaatcattgttactcagtgggtgagcagcagtctcctcttgcccaactcatttctattaaagggctttattttcaacaacttataaactctccgttgttcaaaagtactttgtgcatttgaagtgccacacttcaacattacaggaaaaagttcaagaaaggtgagcttctttgtttttgatacaatttttaacttgctcaaagacagcaaggcctagaaagctcattagcaaaagaagaggaaagatgagccgaagaaatgactctatgtgagaaagaaacttttaaaaagaagataaacttccattgtgttttctcatttataaaatatgaatttagatatatcttgtttcttataagtttgggaatccagggcattcaatttagctgggctttgaatcagtacaaaatattgacaagccaatagccacaacacatcaggacatagatttttggattcaatttgtgagtcctgaagaagcatatgagaaataatgtaacacgaaaaataaatgacccagagactaatattgaggttcaaacttcatgctgaataccagaaaagcaaagcagcaggccactagcttcttacctctacctcaggctgagagggctgatccataagatcttcaccaagcccaaactgctgcctctcctcagtgtgcctagagaatggatgcatctctgagaccttgcttctgtcttatatactttcctaaagttcagattaaaggtgtgagctataattctcttttagactgatccactcttctgtagatatgggtgaccttgaactcagagagatccatctatctcttaacctgagtcctacgattgaaagtatgtaacacctcctcctagctttggactgctggtattaaaggtgtgtgcctggcttctaaggcttgtggctgaaattgcttttctgaatcctcagtcaagctttaataagtcataaataatatatcactacacttcccctttttgtcttatacaaaaagaaggctataactaacataagaaaaactatatacaataagtatatacaatatatctaggcaataagtttgtcaacaatgtctattctattttcatttgacaaattcagaaaaaatctagtccatttgcatttggcaaatctatcctaaattggtgaatccaaagtcttatacctaatttactttcgattttaatttgcattaccaaatatcttttactatctctcaaaccatttatactttacacatatatagtgagtttctttactgagtctggtaaacaatgaaaactacaactatactttctagtcttcaactccctcagagacacgagaagaaaataatattaactgagtaaacaggaagtgtgatcaagtaacttccaaaaaatgtgaaaaatgacaaaaacactgcgggcctgaacagtcacccaaggttcctctgcaacattggggcatccatcttttgggctataggcctggcatctgacagacttttctgcgaaatagaattttctgaagggctaccccactttgtcttggcaaggttttgctgccactctcttttgtgtattgcttgtccaatttggacagtatactgtcagcagtcaagacaagagtattttcttgtccagtggcttactttttccacaaagaaggcaaactccatgtgtattttctttgatgcccatcatcttctcctaagtagattggtgctgccaggagcagacacgtcttattgtcataaaaatacctatgttattaaaacattttaaatgtcatgttctgtagaacactgaagtgtttgaagacaacctatctttctaaaatatgtctgtctttgaaaacatacctaatgtgattacaagtttgattataataggtgactaattactcaccaacatttccttattatcttatataattggtaataataaatttcaagaactagaaatttgcattacattgataaatgagctgtataggtataataccttgaactaaattagaaacacatgttcagtatgttttaacaaattaatcttaaatttgtaccaatttacaatatttgtatacagcatacaacagtccaatcaaatgtaaaatacctaaaactaatagttgctttttaaaagtagaatcaataatcttccttttatctcatcatatctatgttttttagaagtggattcaataatctaccttttatcttatcatatctatatcctcccttttttcttttcaagaagagattcaataatctatccttatatcctatcatatctgtatcctttatttaaaaaataacaaccttgaatctaatcagtctcctttgttcaactttcttcctgactttaatcaacaagcttttgtaaccaatttccctaaacaatgacaaatatccataaaaatccattgaatgacaatacctcaaagccccattctctgccacccccacctcccccagggacacacttcctccaacaaggccatacctcctaatccttctaaaaagtaccactcctttatgactgagcattaaatatatgagtatatagggtcattcttattcaaaccacctcagtacatatgtgctatatattacctttatcatagtcctcatgtgtcaaaagaattcttatatcttataatttaaagattctcttaaatcaacatacacatgcatcacatatattaagtacaacatcattactaaggtatttatatattgctatactatgtatatattatgtactatttacagatttatttacatgaagttcagttgctaatgcagttatctagtagaatatgtttcttacatgctaaatatcaaatgtgtctccctctaactattttatgcaacatattatcatatattcataatgcacattcatatttctgtgtgtgtttgtgcacatttgagagattttctataactaaggatatatcctcaaagatgcccctaattggtagctgtatgacctgggttaatgtttctatgattctgtttcttggcaaaattaagataacattggtatactttaatattgtaagaaataaatgagtctatacaggcaaaattcttctgataaataatgttgactgcctcagtgcattgacatccaaggacattcttagaatccttccttcccaaacactatacatgttcctttagtgaataatattgagtaagtttattatttataaagtatcttatcaattttattgaattttgtatatacttttctcctagaaatctacagcatgcttgattccctttgttttcccaagtttaataatcatactaaccacatttatccattggctattgccttgcatatagccctcatgcttatttttattctctctatttcaagtagtatccattctattttgttctagtactgataaaggtttatttctgtggatttattttacactgtatatttcttagttttgctgtgttgttgcctgataacctttcttaaaaaaaagaaaagagggaagggagggagggagagagagagagagagagagagagagagagagaagaaagaaagaaagaaagaaagaaagaaagaaagaaaggaatgaaggaaggaagaaaggaagaaaagacagacaacacagagagaaagcagagagaaaagtagtactactgcataggtgttttgttttttactctggaggtccacacccatctcccaaataagtacatgaagatttatttttacttaggaatatctagccttagcttggcttgtttctagccagcttttctaacttaaattatctgatttctatttagctacattttgcctctgggcttttcaactttctttattctatatgtctttctttctttattactctgtggctaactgtgtagatgggtggctggttcctggcaccctcctctcctcctactcctccctcctctctcttctcttctctggagccaagatttctcctcctatttattctctcttcatgccatccctgcctatcctttctcctgcctagttattggtcattcaactcttaactagatcaaccaggcattttaggcagggaaaggaacacagcttcacagaattaaacaaatgccacaaaaaatgcaacacatctttgtatcattaaacaaatattccacaacataaatgaatataatacatcttaaattaatattccacaatgctactgtcttttataattttttaaattaatgtttaaattataaaacattttccttgtgcttaatatgatagattatgcctgtaatactagcaattgggaagctgaagcagtaggaatatgacagctgttttgagacctaccaggtcttcaaagcaagttctagagcagtcttggctagactgaaatcatctcaggaaaataaatgaatgaacatattaattaattaaatgtttctttatttaagagatgcatttgcaaattccttttgtaatcctgaaatacccattttcttcagcatgttattcttgtgaatttttattactatatttcctgctctttccttggagtctgtgcattccaagtgtatagatgtttttgcttctgagtttcttttgaataaagttacctgtgtctagggtggtttgctcagtagtaatgaaagcagcaggttgacatttgatccaggattgcaaagccagcaaaaaaaatgctgatccagtaacattttgcatttcttctctgaaggcaagccgccatctagacaggaggtactgatttccataacctttagtatttgggttgatacttcagctctgctcaaccaattcagtccatgactataaaatcaaaatcaactatgactcaatttctgttctccattatgatgtccaccatgatgcccttgatgtattgtaagtagaaactgaatattctctcaaacatctgtaatgtttcactgagtttcagagggtaacaatgtaacaacctaatacttttattttctccttcattttcaccattgactatctcttctttttgtaaattcaatctacatcacttaattttacatgatttcttccttggttggtgagatgatctgctttgattttgtagaggaacacgtgcttttcggttgtgaactctctgtgaagaattttaagattgagttgtgttctaggcacaagattggccctgaattttctcttttaattttaagaaattctactttgccaatggaaaaaaaagacatttgttggggaagctgtagccacgcctacttaggggctggctacagatgtgcctgaccatgcccttgcaagcttgtgtgtgtgtgtgtgtatagtgtatgtggtttacttacacatgtgtgtgcagagtccaggaaagggtgttgggtgatctcttctatcactctctgcattatccctttgaggaagagtctctctccaaacctagatatggtgttttagctaggatgaaaaccaaagttcccagcaatcctcctgactttgacccctaaaagtatggaagtctacaactgacttgctaaatggacggggagatacatatgccctcatagttgtacactaagcaatcttaactgctgaaccatctctccagtacccaatagtactttaaattccttcaataccaaagtttctgtgagtctttgattgtttcatatctacatggatgtatgaatgaaactgtgagagtatgtaaatgtttccaagttacttttcttcattttgtcaatggagaatttgatacacttatataatgtatttcagtcaagctcaccccatcgacttgtactctaatatcatacattctatgtcaacaacagagaaatgagaatactgatttaaaacatgaatgtcagacagtgattggttcattctcgcaaatactggccccattgagacatgccaatgcttctgatatttgttctcatggtgccatctatgctttcaccttccaagtttcctgcatcagtgcagaattctgtagtaagtgttcacaaagagaggcctacaagctaatggggccaaacaccggatactatatggcccatgagaaaagaactgtttgtgtattgacaaatggttggagaggaatcaaagtaaaagcaactttccctgacatgaaagaactatataaaatccagatgtctatgaccataagttcctgtggaatactgccatgcccacacatttcttatgctattcagcatagcagagtgtttgcaaaggaaaagcagaatagtataaatatttgctacagattgaatatttgttcagacaggtttaatggtttttgtcacggctaacgatgaactatccctgatggtctgccctcttttatattggtataagcttctttgtcattccagttttctttcataattaaaccggcacacagccctctctctagcaccatcctcatagatttcccaaactccagaaccaggagccaaaataaacttcctttctttgtaaattgcctcatcttaagtattctgccagagcaatggaagaccatgacagtatatctttatacccagcacatgtaatttattaattctcaatgattttctatattcagaaatcacttaaatttgtcttcttaaatttctaactgaatgaaaattctagttatctgtttttaattattgctttaaatattgtcatacatgatatgatagtttcaattcatagaaatagacatatatttcagtgagtgtacaatctgtttttacagataactactgaagaacatgctcttttctgcttatagtgtacatacaacaattgttctttaatttactaggaacattatagatttgggtgatggacctgttcaagaaaaacatgtcaaaatctattttgctgtgcatctgagagttttgctttgtaattctgtcagttgattcttatgttacaaaagactattgtttgaaagacagtataaaagtcttttcttgatggtgaattgaaatcatttgtcaatatatgattattttcattatattgtgctaaaatgttagttctctgtgtttatgaagcagtaaatttgttttgggtagattttgcatgatttatgtttgccaggcggttgtcagtgtaattatgtcattcagatgagactgggaatgtttgagtggttatggccatatatatattcttatggcagtgatggctatatttagatttattatatcatgttccttttggcttcacatatagtatctgaaattcccagtggagagcctttgttttagcccttcattcagcatgactttaacaatcacacagatgtaaggctcaaaaatatcccaccagactacctaaaactgttgacaatcagaagaaaaaaaagtggaaactgtgagtgaccctgaaaggttctctcttacatgagggttgctttgtgagctctaagaacttaactgaaaaatgttgggagaaggttgtggattagcatgcacacatgattttggggtagtgatatcttggacaagttttcatgggagacagagtttgactaattgtatttatgtgcaggatttgactcaggcccactgtttgtgctgaaatttccttggtgacactggacagggtgacactgcttcccagccattcttggacttgtggctgctacttggcccaggtttagagctgttctgctctgtgctgttacctctgctttcttcctttcttctgtgccaaaaatcacagctgttgctgtgtgttgcctgctttcccaggtgttgttttatattcagtatggcaacaggatttaaaaagtggtggcagtttgaatgtggatacccaagccagaaaagcaaagctggatgtgttccagctattacactctcctcttgttttgactatgcaagggggtaacattgtattggttaaccctggggatggtgtgatttctagatgtttacctccactcacttttatttctcaacttggtctcttttcattcacttcagaagcaaaaacttcaaaattgattgatagactacaaatctgaaatttactatagctggatactattaataacttttttttactttctctttttttaattttaaagtctaatctgttaaaatgaccagcaatccaaaatgtagcttgatgtatttctactgttttaaaacacacatctgtgtgtactccccacatagatcaagacaatggcttctcatctcttcagaagattgtccatgtttctttctgccttataccccatcatgccttaaaccccactattctgacgtttataacagctaattagttggcttgtgtgtatatttcctataaatgtgcaattattggaggtggaatttcttaagcatataaaatcacagtcctcatactaaagtatggaatgtgaaggaaaggggagaaataataacacacagccctaggatccagctttctaataagtgaataaaacaaaatcttcccagaaagcatgaacttgaattctatacatgagagtgtctatagatatgccatgagatataaatgtaaggaataactggaaaagaaatctacgactgccaaaatcccttaacctaaatactaaaagaactgatgcaactgcaaaagaaaagtcctgtgagtattagcccattattgaagagaaagtttaaaagcagagggaaaagtaaaatattggtatgcaaatacattgattgtttgaacattatttatgctaagtcaaactcatacctcactaaaaagaaatttaaaaaatgagtaatggaagctggtacttctaaatttcttttcttaaacatctaaggagccagcttacctaaagaactcttataaaaccttcagagcagttgcataaaccttgacccacttttcagcctgcctgggatttcatgcactggaaaattcttatttggctaatttaactgcattgcatgattcgtccattattgattattttgagttctgaacacatacaggaagaaaggcatggtgatgtcttctctcttgtggcattgggagtgtattatcttctattgtgcattgtaaggtttagccaagtaaattaaggcacatagatgtcatagacttgcaattttgtacaagctcagcatccacctttcagtggaaagatgttcttttcagctttcctctttgttatttttaacacttcacctgccatattaaaattaatcttgtttatcttttcctatccttaaaaaatattctgtgggatagaaagatggctctgctgttaagagtgtttcctgttcttcaacactagatttctgttcctagcacttacattggcagctcctgagcacatgaaactccatgtccagtggatttgatgccctcttctggcccctgaaggcctccacacaaatggcgtgtactcacatagatacagacacaggagaaaaataaagagaatttcaacgaaaaatgcttgctttgcccctatatgttaggttttatgtaggataacaactatttaaactttgtttttttattatttatgtgtgtgtgagtgtaagtgtatgcacatgtttgggaacacatggggaggccagaaaagcaacaagttctcttagccactgagctctatctgtaaccctggatactgctacaattcttacacctaggatggtgatatggctcaggaggtaagggtgatttcctgccaagtcccagtacctcagtttgacgcccannnnnnnnnnaagttttgataagagtcctctaaaattgtggtaaagatgctgaagtgtagcttttcactgttgatggtttctggtggagggagtaggaagaactcagttatctttaagggactgaccactaggagtttgacaataattgaatcaatatatgggcaacaaaaattgaacctgttgtgtttttttctttgggaggagaagtcacaagtctgggagggtgaacttgggaggaatgggaagtgagtttgatcagggtacataatatgaaattccgaaacaatcaataacaatattatgctggggaaaataataataaaacaagtcaggggcacatgcagaataataaaaaataaaatgcaatatcaaaatgaacaacataaaggtctttcaaccttatggaacactgtaatgatgattacagttagaatattgatgcaaaaaaagacactaagtacagatggtggttggaggaaccagtgcttctggcagatttataactgttaatagacattgcaaagtttgaggttcttttcttatagtacaggattctgcattttcttccttgcaaacattttattctgcagtatatcttaaaacaccataggcaagatataatgtgcaggtgtgtgtgcgtgtgtgtgtgtgtgtgtgtgtgtgtgtgtgtgtgtgtctgtctgtctgtctgtgtgtacatgcacacctgtatgcaagtgacaatacacatctgtatctgatccagtagaggcaagaagtcaacattaggcattttcttcaatcataatcagcctttgtttttgagacaagagatcttactgaactgtggagctcaccaattcagctagactggatgtccagcaagcctcttggatccacatttacatgaccagcactagggttactgatatgaagcagcatatctaccctattcacatggatgctgtgaatcaaaacttactgcctcgtgcttgcacagcaagcactttagtgcctaagccaactgaagatcccaaactgtcttttcattagcagttatcttttgatctgctagccttgagatgactaaaaggaataaaaatatattttaaattattgtttggcttcacatgactggtagtatgataaccataatggtttgcttaattcataaaaatacaccttactaacttactactttgtgcttttgtaataagactcatttggctattaatgaatgcccaagagtagagatacagttcagacctcattattttgaccattaaccaaagtcttatgctttcagttcctggtttacaagctgccaaaaattaagacaaacaaatatctttcaagcctgctcacagctgaatagctattctacagggcactttctctccactctgctggtaccattggaggattcttgcaccatgagcagccgaacctgaagcacccatggaagaatgctgttttaaagtcaattcttattctggaatcccatatacccagtctttgctttgcatacattaagcagaggaaattttaagatttcttttcagacaacactttctagcaaaaatgatgtcatttacctacaagactactttgacttagcccatcccataggcttctgtaaagcttcaaacatcatgatattgccaaacaattctctaaggggaaacactgcatgaaattgagctagattgagtagtatattttgcagactgcatcaaatgacttggtcagatcacaaaattcagatactgataaatataattactcgattcatttatttctcctcaatactaaaacatatgcatcaacatatccttagtgccatagctacttaggtgattatggctctcagttgcctagttgcacactagtatacagatattatctttcggtttcagcatatataatctgaccttcagttgtgagaaaacttctttcgtggtgaaaatgttacttgccacaaagcttcctcaacctgacttccccagtggagtgggagatgccttaagacccatacttgtcagtgaattctgtggagcagcccgaggcatttgacaaaatatgtactgtaccacacattaaaaaatgatgtgtagagtttgtaagtagtacaactaaaagtaaatacatacaaacaatgtgacaatagatgggcacagtgctgaggaaacaatattaaggtcaaggcttcaagacccagaggctatgattatcagtcactattctaaaaaagaaatattctcacccataacatctgaaggcagatacctattgcttctatgatcttatgtattagttacttttgtggttctgtgacaaaacaatgatgaagtaagttaaaagagaaaggcctcttctgccttatagttcaaggtccatcatggtagtcaggccaaagcagcagaagcctgaatatcacaactacagttgaaagatcacacagcaccaacagtcagaaagcagagtgaagaacacatggtcatgcttcatttcctataattcaggattccctgtctaagaaatgatgccttccacagttaagatgtgtctttccacatcaactaacctcatcaacatgccaagatggtgcatttttcttgttatcctggattctcaaatttacactaacctccaccacaagttgtaaacttattcatttagaaagattgtgcttagaccagaagagtggggagggagctaggagaataggaaggggagaagaggagggatgcagaggacatgagggagcagaaaggttgagtcaggggaagaattaacaagaatggagataccataatagagagagacattataggtttaaagagaaatcaggcactaggcaatgtctggacatttacaaatatgacaccaggtaacaatctaagcaacagaggagaggctaccttaaatgccctcccctgataatgagactgatgactgacttatatgccgcccaatagccctcatccagcagcttgtggaagtagaagcagacactcacaactaatcaccgaattgaactggaatccagatgcagaggaggagtgaagagcaaaaggtccagaccaggctggtaaaacccacagaaacaactgacctgaacatcggggacctcttgctccccagactggtagctgggataccaacatgggactgatccagactccaggaacatggatttcagtgaagaaacctcggaaatctacaggacctcctgtagttgttcagtacttatgcctagcacaggtggggactttgagagcccattccacatagaggaatactccctgagccaagacacatggatgtgggcctaggccctatcccaaaggatatgatagactctgaagacacccccccatggaaggcatcaccatccaggggaagcagaaagggtatgtgataggtagggttttagttggggggatagtaggggaggatgggagggacaagggaactgggattgtcatgtaaaacaattttctaattcaaataaaaaaataaaataaaataatttagacaaaaaaagaaaaaatgtcacaatgaaaaaaaaaaaaagaaagaaagattgtgcttagaaatgcattcaaggatccatgctctcatcatcataactcagatgtcttgaaccaggagatagctctgttgatttggtatttgtcttggcagaatgagaatggaagtgtacttccaagaacccatattaaacagccaggtggtggtgtgtacttgcaatcacagtgcaggggcagtgaggacacgatgccccatggtgctcattggcaatccagcatagccagcttgtcaaattctgggcctgtgacagacccttgctgaaaaaataaaggtgtctgacatcctaaagaagaatactgagacaatctatggctacacaaacacacacacacaaaagtgtacacacacacacaaaagtgtacacacacacacacacacacacacacacacacacacacatatgcaccatagacaatagataaatagatggtagatagatagatgacagatagttgataaacagacagatgatagatggtagaaaaaaagatgatctagctacctgataagtggatatataaaatgactataacacttactactttgaaggctagttaaatgctaaaccaaatgctttcatgcaccaatcctcagaggggccaatggttaatccatatactgatcatgggctacaatgcattacaagaaagtcctctagctctgagaccaaaagccttataactgaatctgataaacacctcaccgacatattacaccacatttctcactgttgatgcagaaaataagaatccttgaacaatgctggctattacaaaatgcttaatcaacagtttgtgtgctaataatattttactgtgtgcaaataaaatttctctatgaataccggcctcttagtccaggcagctaaatatacttctgaagagaagaaaaaaaaatgtgtaaggtcaaaatgttttccccagatttcttgctgatttaacaagaaaacttaatagaaattcctttgcttctcactttatgcacagcagagataaattcttataaagggaaggaaatgctacaagtgaagaaactaatgatttaaggagctattaacgattgtaaactgctttataggacagatgtccacagctgctaatagaaggcttgaaataggacttctcatgccatcctggttgttaaccccttttagagtgctcaacacactgttttgtgattaatacctaattggaatataccatagcagattcattgcagtgacttctgagaaggctttttggttgactcttttcaggccatacatttgaaatttgtcttctgatggttaaggataaacttaaacccgagaacatattcttatcccattcctgcaatgagtatgtccacatctactggggtgcattttcttcacatgtactcatgcatccatgtttatcctagcaattggggaattgccaataattgcaaaaggtcaggataaagcagaaaatttgtagattgctgtgtctgccatttgtcatcaaatttgccctataaatttcttcataatagagaggaatttttttattacaatatttaccttgcctttggcagagtttaaacaagatttgaaaaattactcatcgattttatcagcccttaaattaatactaaacattacaaaacattccggtctctaattgacctagtgtgttcaattcatgttgagatgtacccaaataatgtgattaggcattcaactaatatggcatggatatggtaagtagtctcttctcattctgtgtgttgggtttcatgtgttgtggtatgcatgtatgtatgtgtacacctgtgtagatcaaaggtagatgtctaatgtcttcatacaccactctttagtgtttgacaatctcttttcttgaacctacaccttgcaagattgactagactcgctgtccagcaaaccccaagtatcttcctctctgtctttccagttctggggttgtaagtacattctgatggtgtggtattttgattagtttagccaatgaattttgggacagcaagccctaaggtgtggtcttgtttgcctatgtgacaggttaaaagctgaggaagagggtctagcactctcactctcttgggtggtgggagcagagcaggtggcttgctgttggtggtcttcacccttgggcaggatgcctggaggaatgcagctgtatgagatcagcagcagcatgtaattggttttgtatcagtgagtgtttgtccctatcattcacctacataaattcttgagaccctttaacacattctcttgacttcctgctacattctggactttttaggtggatgctgtggactcgagtccttgtgcttgcacagcaagtaagcctttactgactgcatgaccattctcttctcatttttttcttatagatttatatgtttttattttatgtctgtgaaggctttacatgtgtgtgtgtgtgtgtgtgtgtgtgtgtgtgtgtgtgtgtgtgtatgtgtatgtaattcctgtcttctacagaggccagaaaatggcattggaacccttggaagtgaagttccagatggttctaagccaacatgtgggtgctgagagccaaacatgcactccttacaagaacagcaactactgctaactgttgagccatctcaccacttcctctcttctcaacctttacacacactattataattaaagtattttcaacctccattcctcctatttctatgtaagacagatgtaaacgggactgatgtccatgagttctgtccagtatgacttatttagcagtttcccttaagactagttctaatcaataaatatttacagtatttcatttgactaattcatatgtcaaactcaaagagcataatattttgacacattatgttcaatactgacttaaaatagattgagatttatgtttatcataaaacaatattttgcctgagccttgaatcatatcattagaaaattgaaagaacatttttctctggaactaaaatacacacttgttaatcaacatgggacacctaaaattgtcagaaacacaaggagtaaggtatactgttgtaaggtatactgctgttaactctatgcactaacttcctgcctcagcaccggtcagaataagttcaagtcagaaagtaacaaagtcctagaaatcatcattgaacagatagatctggcttagggtgtgtgtgtgtgtgtgtgtgtgtgtgtgtgtgtgtgtacctgaaaatataagaaagtacttaagaaaattactaaaagtttttctctcatttcaccaaaaatatattcacaaaaacataacataaagaaataccattgtctagtcccaggactgctaaagaatacctttatataaagcaatcatattttgtttctttgtattaaccttgaactaataaaacaatggaatttgaatatttatagttgcaataaaaattttggcaatgaagacaactaacttatatttacaaaaaaaaaaaaaagcacatggcacctggccctatcttgaggggatctgtactccagttcaatctgagttccttacagtagatccataaatccccaaacagctaatcataaaaatattaatgcaacaagcacatggtttatttatcagacttggcttgctagcctcttacaggattgccaggaaaagggaatattaaaataaacgatatatgtgttcagctctggcaataaatcaaaggaggtagagtccttgttagagtagattccagcacagtgtgttgctttgtcactttaaactgactagacattttcaatatttatagaattactatagtttgaaataattacctgggtagaattaaaaacccaaaatatattgaacattttaggatagtatatattttaagttatacagtcagcccaaagtaagatacatgttttagttttccaaaatgatttgttagagaatttacaaactaagacaccctttaataatttattaaaacatgcagttagaaccatttacaggaaaaactaacatgatttgtggtagtgccttatagcagctgaatttgcactgtgttctgtttttgtttggggggggagacactttctcactatgtcacccaggttggcttttaactcctaggctataatgggtctcctgccttactatctggggtagctgagaggaaaaggcgtgcattagcaaacacatctggacagatttacttccttagttcatcacttgctgaatgcaaacatttgacaaaaggaaaaaaaaaaaacaacaacaacaatcgtatgctgacagaattcggaaataccatccacactggatacttgaacattttgcagcccgcacaaccacatctgatcttaaacagagttactcccagggtctgtaccatccctatgtttggcatagtctgctttctttatttcttttttaaagtagtcattatttttcccattttattaaaattagatcctttactcacaccatatatcctaattatagtttctccttctactattcccagttcctcctcacctcctctcccatctggatcaactccctttctgtctatcattcaaaagaacaggcttctaagaggcaacaaaataaacataaaaagataaaccaaaaactatcacattgaagttggacaaagcaagccaacaaaggaaaagagccccaagagaatgaacaaaaatcagagacccattggttcacatacacagaagtccataaaaatactaaactggaagctataccatatatgcagagaaactgagggctggggtttcatggagatatcccatttagagctgtctctttctgtgtaatgtctggctatggtgaaaagagatggccagctgggactctgtctccctcattgcttagagacttcattcagattgccttcatatattttaggaagtttccatggcattaggtatacatgtcaccctccaaatgtccctcaaatctagcttttctccccaaattctgtccctcataacacatctacagtcttctttttttctccatttttttatttgaattagaaacaagattgttttacatgtcaatcccaggtccctctctctcacctcctcccctgcccccacacaactaacaccctacatatcccataccctttctgctccccaggaagggtgaggccttccataggggtttgtcagagtctttcatatcatttgggataggacctaggctcacccccttttgtctaggctcagggactatcgctgtatgtgggatgggctcccaaagtccattcctatgctagggataagtactgatctactacaaggggccctatagattacctaggtctcctacatgacacccacattcatggggtctggatcagtcccatgctggtttcccagctatcagtctggggacaaagagttctcacttgttcaggtcagctgtttctgtgggtttcatcagcctggtctggacccctttgctcatcactcctccttctcttcaactggattccagttcagttcagtgattagctgtgggtgtctgcttctactttcaccagctgctggatgaaggctataggatggcatataagttagtcatcaatctcattgtcaggggagggcatttaaggtagcctctcctgtattgcttagattgttcgttggtgtcatctttgtagatctccacacatttgcctagtgcctgatttctctttaaacctataatgtctccctctattatagtatctcttatcttgctttcctctattcttcccccaattcaaccttcctggtccctcatgtcctcctcccccctcttctccccttcttattctcctagctccctctccctcctcctatatgctcccaatttccagaggagatcttgtccctttccccttctccgagggaccatgcatgcatgacttctctggcagtgtggattgtaggctggtgatcctttgctctatgtctagaatccatatatgaatgagtacataccatatttgtctttttgtgattgggttactgagctcagaatggtttcttctagttccatccattttccttcgaatttcaagattccatttttttttcctgctgagtagtattccattgtgtaaatgtagcacattttctccatccattcctcagttgaggagcatctagattgcttccaggttctggctattacaaataattctccaatgaacatcgttgaacagatgtccttgtcatctacagtcttcttcccctcctgatcttatcatttctgccctccccaggctcagttcacccataaaatctattctatttctcccttctatgaagatttaattgttcctcttagtgtcttcctctatacctaccctctctggatcttcaggttgtagcatggttatcatttgtttaacagcacatgtaagttaatacataccatatttattttccttagtctgtgttacctcaattagaaacttttttttcttttttctttttttggtttttcgagacagggtttctctgtgtagctttggagcctgtcctggcactggctctggagatcaggctggaatcgaactcacagagatcagactgcctctgcctctgcctctgcctctgcctctgcctcctgagtgctgggattaaagtgtgtgccaccaacttccagctagaaacattttttttttttagttccatccatttgtctgcaaattttatgatgtcattttttaaagaactgagtaatataccattgtgtaaatgtaacacatttttgttatccattcttttattgaggggcatcatttctggctattatgaatagagcagcaataaatatgtttgagcaagtgtttctgtggtagaatgaagtgtcttttgggtatatgcccaagaatggtgtagttggatcttaatgtagatctagtccctttctgagaaaaagccacattaatttccatagcagctgtacaagtttgcacccctatgtgtaatgaatgagtgttccccttgtgccacaccctcactagcacaagctgtcacttgtgttattgatcttaaccattctggcagatgtaagatagaatctcaaagtagttttgatttgcatttccctggtgtttaaggatgttgaacatttcaagtgtttctcagctgtcagaagccagccttggtgactccccctgcctagctagccaccagctagcctagcatcccaccactcaggttctgggacctggcctgagaagcaactaacacctttccccatttccttagttgtgcttgagataaacataggagattccaaatacctggcctgagaagcaactaacacctatcccttcccccacttccttaacacaggagattccggatacctgcctgagagcaattagcattcattcctcctcccacctcctttttctctgcttccacctttctctttaaaaatccccttggtttcaataaagttgaccttgacaaggaaatctgcttggccttgctttttctttcccgcccattatttgcaggtgtgatccactcacaaattaccggagcccctccggacggggcactcagccattaaaacttcctctgttgagaattctctgcttacatctgtaccccatattttcattggattttggtttttgatatctaggttcttgagttctttatatattttggatgttaatcctctattggaaacaaaggtaaaaaaaaaaaaatcatcccattctgtaggctgctgctttatccatatgatgatgttctctaccttatagaagcttttcagtttcatgaggtcccatcccatttattaattgttgaagtaaatccctacattaaggttgttcagaagtattctcctgtaccagtgagttaaagattattccgcacattctcttctatcaaagtaaaatatatacagttttgttttgagctcttttatccatttggagatgagtttgtgcaaggtcatgagtaaagatctttttgcattcccgtatatgcagtcattcagttggattagcaccatttgttggagatgctgttttattttttccccaatgtgtatttctgccttctttatcaaaaatcaggtgttcataggcatatgggtttatatctgtgttttcgatttgattgcactgatcaacatatctatttttatgcaactattatgctgtttttgttgctatagctttgtagttcagcttaaaatcagaagggttttttgttgttgttgttgttgttgctttttttattgttcaggattattttaggtaaatcatggggtctttgtttttccagatgaaacttggaattgttctttcatggatctctgaaacaattttcatgagaattgcaatgcatctgtagattgctttcattatgacagccattttattgttagccctacccatttatgagcatgagaaatctttctatcacttgacatcttcttcaatttctttcttcaaagacttgaagtttttgttacaaaagtctttctcttgcttggttagaggctattttgaaaggtgttttttccctagtttctttctctgtcagtcatttgtatgtaggagggctactcatttttttttctttttagttaattttgtatccagctgtattgctgaatatgtgtatcagctgtaggagtttcacagtggagtttttaaggtcactcctataatactatcatatcatctgcaaagatatttgatttcttctatttgatttcttctattccaatctgtactctcttgatccctatgggttagtaggggtgcctgtaggattttgtggctggataaaggcaacaagtgtgggaagcaaagttaggagaggaaagtctgtgggaattacaggagaagtagacagggtggggagaaggaagactgaaggaggcattctgttgcagagctagggatgagactgggaattagatttggaggaaaagagggggggtgtgatgatggtcttcagttaatttacctgttttcctggtctgctaagcaggtatgttcttaggggatccctgctggaattggaagctaggataatggatgggttagcggaaggaaggttgcagaagatctttgtgatctactggggatgggtcaaagaggaaagggggatgttctattacagagctgtcaggagattatggggactggacctggaggaacaaaaggagagggggagatttgcatatttgcatacagcctacctgtttccctggtaggagtgccctttggatttacatgggatgcctgctggagttgaggggtagggaaagcacagagtcagggaagaggagttaggggtggaagatctgctagacccacaagagatgggatcagagagacagggaaggtagcagccagtgttctgctgcagatctgggggtgagactgaaggcttggatctggggaaacagagagagcagtgaagacctgcagtctgtctacctggttccctgacaggagtcatggttgctttcataaactttaaagaaatccttcaggaattctcaggtggtttgtcctctcttttcagtcaatggttcgtgttttgtgaaagttctcctatccctaattactttgcattggctgctgtgcctccttggagcccttttcccaccagaaacatttcaatcctctgtccctctagcaatgtgcaactttgaatagattaacctatctaatctctattttcacctggctgttttagacttggttaattcatacatatggcagcagccaaaatacaacaggaagtatatttagaactgtgaccaaaacaatggatggcctaagacaggaatgtcaagttcaatctgccacgcatttaccatgtctcacaaatgacccacaacagagttgcactctcatcaagaatgaccagttaattaaccttcgtataattcaaagtcattcactcattactgctagcaaagtcatcacaagggtggtgtgcttatccatccagtacacagaaactgcagccattatgtttcagaattccagtccttagagctcggtacaactatgctttgcctcaactgacagatttcctaaataatgaatttgttttgttgttttgtagacatcatttacaacaataccataacactcattgcttcatacccgtattataaatttattggactaaaattccacactttagactcttgaaaatactgagtttgtgtagctaaaatttattacttctttacaagttctgccaaatgacagttagtacaaactgatgacttgaaaacggctattgattttgtaaagtttccttctggtttataatgtctcccgcttactgacaaatcttttcaattcctttcctgcactccaaactcattttaacataaacttacctttcttttgtcctactgtgctactccataactgagtgcatagcactcccagtcttctaaccactgaggtgagaaatacagaggctaatctgttcttcttcccctctgtcagctttcaggagtaattacactttgagatatttccatcctgcatctactccatctccatgttctacacacacacacacacacacacacacacacacacacacacacacacacacacacacacagaaattccctttctcttgtgtcaaagcaaagacacagctctcaattcaaagagagacaggagacagattattctagagccaaactatgagtagatcacaaaaacatagatttaatgttccttggtcagctatgtagaacctgatttccttgctacttaaaatactcaggacagagtacaatccctaaaatcatactttaatcagagttcatgtcaggttgtgtcccacagttgaatcagaagagaggtgtcttgttactaatgttgaaatcttattgatttaaacttttaataattaaaacattagtttcttgatttcatttgatacaaattcaaagtttttcaaagacttaattatttttattttatatgtatgcatttttgcctgcatttttctaagtgtacccttttgtgcagtatccccagaggccagaggggggcatcaaatcctctgaagctggagttacctatgactgtatgctagctttgtggatgctagaaactcaaccagagtccttaacaaaagcagaaagttcctgtagacactgagcaatctctacactgtttgaacatgtttaaaacttattgtaattaaaatcatatgaacttggaaagcacattcattataaatatccaaaaggatcaagttcaagaaatttaaacattattctatgaactgactcaatctcaaaaaaaaaaaaaaaaaaaaaaaaaacctttcttaaaaccctttcattttcttttcctatattgcaacactgaaatatttacatcttgtcactttttggttgcatctaccaaaactgaaagttaagattgaacatattttgcatatccttccttgtatagtcttttaaccatagactggttttacactagctctaagaactaaatgattggatttcttattatttctattccatcataatctactgtgattatgaaatttcaatatcacatttctctggcatcctcattccaatttgtagcacttaagataataggacagatcgtatagaaatcatttcactgatgacatcttgctagcctaactgaagagtgtaactaacatcaactcagtatcattagcaagcttaacaggccacatatgatagcaaaaagatatcattatatttagggcattttcattttattatgtgaggaaaataatcagtatacaaaccataaaatcttattgtaaatatatttgtcaaatttatcaaagcatgtataaatagtcaagaagttaacaatatcagctgctctgccattgctcagggtttcagtggttcctggtacatgcaaagaagtttctaataatccctaaaacaggatgtaaggggagaagttggttctgataccttaataccattttccagaatgttcttggctacagcattactgatgagacaaattcttcactcaagggttaaacacatcagcatgactgtttcttatagtttcttgaagcagaaaaattatctctctgcagtgacttagaattgcatgatgtatttacagcaactgaacaactctgaacacttttgatcttctggaaaatatccacatttgtcatttgaactccatcaatagaacccacagggctttcttcctacaatgtggatctagctacaaggactgagatggtgaattcaagaccttagtatagacagaacaacaagagagaaaatctaaacagaatgtaatggcttgagggcagtcagagaggaagctggccatctgagaggctggggttgcaaaattgtcttcctcctcccagttgattccagcataggtgtcagtagtaggactgcctggctatggccttggatgatggagttgaagatgtttaagatctgcaagcccctgctgctgtattggtctgcacaatggtcactggttgtagcagctgtcatgagctacactttgggcactcctgaaagtccactcatagccccattcttctcaaagaaaagtccttccactccctccatcagattcagttatggttactattaggaccgtggtgaacattataatctggatatttgtgtacaacaccaaatgtccagagccaacctagaacaacatctagagatgttgaaaagaatgggagagaaagtacaacatacctaatttttttaactgctgttttcaagtgcaaatggtttctctgtgtggatttaagcatttaatacacagtatcttttaattttaatttaatttaatgacctaaaaatcattcaattttacaataccctgatagtatagccatgatacccttgaaaactctgatacagggtttattattcccaggttcttagtgctttttgctaactagtgtcctagcatgggttatatctggcttaccaaggctctttctgggagtcattcaagaagctgtgtgactttaaagcaatgatgcactgtatcgtctcaccgtccacatgactgattttgttcccagatggctataacaaaaatgaaagttctaagtgatctttggctctttcctgccactttcactccatgtttatctccaggcctcaagctctcgggagtgtaaggcctgtgtctgcactttaacacattaaacatcaactttcaaccttgccaggatgagtaggtttgacttctcttaaatgtcaacagagtcaaagtaatcctgggtcttttcttgtcagttagccaggacactcacagaatacagaccttcttttctggctcctttgtagaaggaataaagcatattgaagcaggagacatttcaaaatctgttgaaaatattgaaaaaaattatggaaattggcagggcagagtcttgatgcatcaaattattaaccttcatccctaaaaatatgtgactaaaagcagtgatcctcctataaactaaaatacttgcttcaaaaactgcatttaatacatttaatacttttatattcattttctttagaaaatattaatagctcctgaaaaactatgtcttcaaagctacttgaatgttgtgtttgtttcacaagaaaaaaacaataccttcaaagaggattattgcatggaaagtttttttttttttttaagaaatctaagtaaagaatgaaatatgccaaaaggaagagatgaaagaatgtggatggaatagacatacatgtagcttgctactctccaggaagtatctctgtttgcagacacttggctggagactgggccactcaatgtcatagctatttctctaaataacagaaaccaatatccagacaaaaaagtatcccttacttttaaatttcctttgcttgcgacttactttttttccccctgtttcagaaaagtatttaaataactgcttaaaaacaaatactaagtttaatggtactctttgtttcaaattacgtcccatacccctggcactctcttctaatagagatgtctgatgagaagtcatctgtgttagcttttctttggacgtttccactttggtgaggtcatagacagaaaaataaacccacccctaaaactacagttgtttgtggcagcaaatgtttcatcgggtcaggaaacttggagattcgacgccagagcctgaacaaaagtagacaaagaagacaacaaagatatcccctcacagccccaagcacactgaggtgatgggaagtttgacgaaaacatgtggacaacgaaagaaaagtgtgcagatggctgcttcttgtttgggaagacactgttaggagtttctcaagaggaccagtaaggcaaaggtgagaacccagggcctctattagtgacccaagccagcatctatttcggcatttcacccttaggcctctctcatcgctgtgagatgaagctttttcattctccaagacttggtctgtctttccacgaccttcaattctttgccagtgccagggagcaaattcagaaatcccctagacaaacatcagcgctcctattacaatgacgtatgtggttccccaccccataatattattaagtttttctaatgaatataatttttcaaaagttttttaaaagccgccgggtggtggaggcacacacctttaatcccagcattccggaggcagaggcaggcggatctctgtgagtttgagaccagcctggtctacaagcactagttccagagtaggctccaaagccacagagaaaccctgtctcgaacccacccccactcaaaaaaaaaaaaaaaagtttttaaaaagccattttttcaaagctacaaacatttaaaaatgaatgtttcctttcaaaaccctgtccacatggctaggattacttgtatatttatgtcattagacaaggaagggatttttacaatgtcttttatttaagaccctctttcatttattggtgataggaatgttactattatcattttgtaataaatcaccttaataaaactgcatataacttctaatagcattttatggatttattctatttttcctagtaaacaattacattatctgcaaagacatattaccacaccactttaattactacctaaaatgctaacaatttatgatatagcttaattctatagagcattgttccaaaacaatgctatttaacactgcagtcatcaattgcctttgtctctttttctagcacttctctgtccatttccttcctctgtcatctcccaggacctcaaagatgtcaagatggtcaccattcattgctacatattctccaccagccaatttatgtctgcaagagtatactcaatatgtgacagtctctctggacatatctaatgtgcattaattgtacaaaataatgggctcattaaaagatcatatacaggttccttgttcattcagtggttcccattttgcacctgtgtgttcagcaccatcctcttgtctcagcgctggagggtttcattcccactactgtcactttacttcatgttatcatcagtacctgagaagagacaagtgagagtctgttctcattattgatgctagaattcaaaagactaggggctttgctcattttttccctttttggtatccttattgctttctctttctttctttctttttttctttcttccttccttccttccttccttccttccttccttccttccttctttccttcttttcctttccttattctttacattccaatccaagttctctctcccttctcttctcctactcccccacatcccccactccacctcccatctgctcctcagagagggtaaggcctcccctaggaattgtaagtctgtcccatcatctcattgaggcaggaccaaagcacccagtcctgtgtctaagctaggcaaggtatctctcaatataaaatgggctcactaagtcagtttgtgcattagagttagatcttggacccactgtcagtcgcctcatatatcaccccagctgcaccattgtcacctatattcagggagttttgattacacagatgtctttatcactccaatgaacctgctcttcctactgaagagaaagcatgtcatctgccctctgctttcagagaacagggcacagattaagtgaagaaacacaaactgtaatttctgaattcacaagatgagaatcaaagagtaagtctgctgcatcaaatgccatgggagaggtatatgtggtgaatcttggtaatctataaatattcttgtacccattattcctgcagcttttgtttaaacattttattctgctttcagcttctgcttgggttcaagagttcattttggaattcattcttcgaccacatttctttatcttcatccttatcactataagcattcaacggctggaatatacagctagaaattaaagttggtttttgaaaagttttcatttgccagtaaaagtgtgccccttgagattaatatttcttactaatcaaaacccacaactgtgttcattgccataccaaggactgtcttcaaagataggcccccgaggttttaaggagaacagatctcagttaatccaagctttgaaaatatgcaatttagaaaaatagtattcaaatttgcactgagtaatattttattaatatggaggaaatacattttcttctcattcagtttctaattaaatggaagctcacatgtgaatacgaataaaccctgtttggttcatgctgcttaaattcttgtaaaataatcctgctccaactttgcaaagacacaaaccagcactggacattattttctcatttaattgtgtcaaggaaagacaaggttgtaccatttactcatttcagtattttaattcaaatactcaaagatgattcccttataatgtgaaaggaaacatgggaactaaattgtaattgcatccatcttttttcagttacaaaatgaaaaatgtccttgaaatgacgacacttgctctttagcaaaccaagtttcaatactagaaaattcatagataataaagtagtgggatgccattggttgaatttcattgccttccttcgtccatatatcaaagtcctggtctctctgtcatatattgtaaccatactttgagaaagggtccttaggagatgattaagttagaatgaagtggtacaacatgccttaatatttgactggtattccaataagaaggaaaaaaaaaacttataccatgatagagagaggagagatgacataaagacagaagatgctatctacaaatcaaggggccaggcatcaggatgcagctaaccctgttggcacctcagtcttagacctctagcctctaatgtagtgagaaaaaaaattactgtataagaaaccattacttgatagattgctcctaagctaatgccattgaccatgccacaagagcagtgaactgcaattgaaattgcaggtgtcagcccaccagaaggaaatcctctgatgggcaaatctcatttaagcaagagcacaagactgcagaccctgaatgtcttttgattgtgctgtgcctttacatgtttgtcacagttctctttctctggtatgtagcacgatgtgaatggacatggggacattgccactgcctttaatatagtgtacttatctcttggaaacatcgcattctatggggcatttttacctgcggattgtcaagaaggtgatcactccctaagcagtaccatctaatttgataataatgatagtttatgcagagttttaatgagtaaaaataaatacaatgatagccagggtctacaagtttcacccaaggagctgcatggatggtagctcaagttatgaatttaaaattgagtcccagtagcccagctagtttaaattcttttaaccttaatgttgtgggaatgtgttcacaggtctcagagtatatcacaactgaaacaaagcattggaaataacaaagttaaataactttgaggtgaaaaacccaagaagacaatctaaagttttagaaaggcacatagatgaatgcagaactcttcaagttcagggaataagaacgaaacagcccaattattactggttgatgtactctccttgctgggtttggttgatgaccaaaggtaatgattacttccatatacccatttctgccctcaatttcttgatgttataaaaaaactattaataaatggattatgtaacctaaagatttaaagtagagctgactgattttttcatatataaaagcttaaatttatgattcctttagtattgcttataagaaatatcacctttcaatataagtaataaagtaattggcctgccagtaaaagacctgacaagaagaccttgcttgcccacatagttaatctataacaagttgcttaggtaggaatgtatgtgagttcttgaaataatttgtttttcaactgtaatacataaaatgtttaatcatgtgaaagtgatgaaaactgtgttttatctatagtcatctacttgagaaatggaatgtaataattttgactcttgtactgcctgaaggttctgttggggtataaaagctttgaaaaaatgagaggatggagagataataaagggagagaaagaataaagaaacaagagaataaagaaggaaatcatcaagagagtttgtgagtgcctttttctcaagcccccctcagatagagaagtctagcctaaccaactccatggattcctattgaagccttgtgctcctggaggcaggcccctgagacagcaacaagctaatatgtaagcgttgtgagaaactaactcctagccataatcaaaataaccctgcttttgctccaacatgagtctttgagttcactcttcccaagttttcatactcttcatagaataacttcaaatgaatatattttatagagctggggagacagcttagttagtaagtcaaggacttgagctaaatcccttcaacccagggaacaaaataaataagacctaggtatggtggtatatactggtaatctcagtgcttagggaacaaagacacgtggatccctgggattcactgaccagttgagatttaaaaagaaaatttttcgccctttgcattatagtaaagatgcaaattatctcaatgactttgcaaatttctttgttttgttataggagatcttgttcagaattgtattctaggacccatgttgtcagaagacccatcctcataaaatgtatctcttgggctgaagaaacagctgagtgggtaaattgggtaccttgcaacaatgaaaactggagttcagtcttcagaatctatataaaacacaagcctgatgttgcaattgtaatcccaacctagcactgaggagatggagatggaaggatccctggggcttattggccagccagcctaggcacatcagcaagttcaagggcaatgattggagaaagcctgagaaagatcaccaaaggccagtctctggcctttacacatacatacaaatatatgtctgcctacacatgaacataaacacacacacagcaaattaataaactgcagtaaattacactctctgaatggatgagtactattttatcgttaattatataatttaactatttggacataatagaatcttataagttaccgagattagaaaaaaaattatattacatactcttcttgtcactactttaaggttaaatgaattatatcactattttaaaatgctataacatgcaacatggtaattttttttaatgtcaggcagctgatcactcatttaggttaattaataaaataaattatttaaataatcctctatcttgaccatgactccatgaaagacagaaacaacccagaataaatgattgactgactgacatagggtttctaaagttggaaccaatcatgcttcagattcccaatggggacagtctaaaactcattgtcatcagagaccaattccttgtttagcttcttggccctaattttctccttgtaccctttatttatctcctagagctcaccctcaataagtcaatgatgcaggaagtccagtgtaccttaggcattgacctcaaataagtaatatcagagagggtcagaggaagccaactctttagatatgagtctcaagttccttaactcctcaatcaaatgtcagtgagaacccttcactggtggtgggagaggactgataatgtctaccattttatactattgatacttgtcatgagccctgtatattcttcatccattatacaggatgagctaagacagggcataggtacaaggaaatggacaagttagtgcaatgacagttgaaagttgtaagcactgttgcaaagtgccctgttttgctgagagaatgtaagacactcagattgctttttattaaaaaaaaagtatttacctttcattttgcattccaacctccattctccctccctccccttctattgcaccctgcctccctcttttctacacccatccattcttcagaggaggtaaggccttccttggaaagtcaataaagtctggcatatcaagttgagggaggaccaagctcctccccactgtatcaaggctgagcaaggtatcccaccatagggaatgggctctaaaaagccacttcattttcctgcaatgggtcctggtgccactgactgcccctccaacccccttcatcagatcaaaccacattcaaagggcctagttccttcccatgcaggttccccagatgtcagtccatagcccgtgacctgagtttctactagctcaggtcagctgtctttgtggttttccccatcaggctcctgacccttcctttttcatatgatccctaatccctctcttcaactgaactccacaagctcagcccaatgctgaataattgcacctgcttccatcagttactgtatgtaggttttatgatagcaattagggtagccattaatctaattaaaggggaaggcccattcagacaccttctccactattgctaggagtcttagctggggacatccttgtggatttctgagtatatccctactatcgggttcctccctaaccccataatggctccctctatcaagataaaaatgctcgtatttaatcatgaatcaaaaggaatttttggtagcattcaaaatatccaggcatcaattcctgctgaagggaagtttaagccataaaagttttaaccataaaagtgaaagaacatttgaagaaagcttaaatcttgctctcgatctcaataacaaaccagaataatttctctcataagcaaaatatcaggattcctgtgattttggatgggcatattcccctgacctttgaatgaaacacaggaaagtgtgcacttttacactcacacagtctagaaaattccaggagttcaagcattccagggcacccatcttcttttaagtgatcaatgtggtcctgaatacacagataagcatgatggatgaaagaaaagaataaactgattcaagattgactccaactatcaccgactggtatttcagttttaataatttgattggatcatcccatggtatatagctattgatgagggcacttagcatgtatcctcagtgtttgtgcaataggttcatgagcaaagcagccatatcatcaacacaggctactcatgatctcagcaataggtattctcagtgaggttgatctagataatgtcatagataaatgttcagctaatcaataatagagaatatgttaaatattcatttgagtactattccttatgattagccgtccacaatgaaagataatgatatcagacaccttaatgcttagaactagcaattctggaaggtacagatgtgctggatagggttatgcctttcctgataacaatgactgaggaagcctcatcattagagatgggagacagtgtggcctgcaaagcatcaagccaaacagcattctgccagatgaatccattttaaccacagtagagctgtgatgatggccaggtgagcaatcatgcaacattgctgcagcacactgcactgtctgcaagttggcatctgtctgacagagttaagactcattggaatgtagctttgagaagatacacttagagctagcttgaaggagaataaaagtcatgtggtatgcatcctaaaccaatgggtagaatatatctttgaatcaccagtaggtaaatattacggagcaaaagatctctggagcaagggggacataatagctgccacttaaacttttttgagattagaatttagttacatttctccccttttgtcccttcaaaccctctcataaatccctccacactccccccttttcagtaataactgtaacagccagaaatgtcctctatctattaaccctcttctgatgtgtattctttagaaattatgaggagtcggaatcctaaatagaatggacatgaaaataatgtcccaaatgggagaagcaggaggatttgaattgcccaagcaaagactgtagtagatactatggtagcaggcactattgctacccccacctagataagtgctgtgatttttgcctgaagctgtcccactatctggagacctgtccttgctcaaaagctccctctgcttggaagttactcaatcagaaacatcagggacccagaggctacaatcgatgaacagcttggtaatgttatgtgatgtgtaatcgcaaatccatgctcctgaaagtccaggatagataaagattccagctgaacactgtagcctggtgttctcccaccaccactgtaaggtctctctgccttgttcccacgctccccccccccaccttccaaatgattccccttttaaaaactctaatctttacatctgcttgtgtgattgtgtgaaacccaacctattttcccagatttcccagggataaattctcttagagatgttttctttagatactgtttcagtgtaccatatataattgtattaatgaacaatatgcaacattatttaatatttatgaaatttatatctttctttgtgtctctctctcaaaatttatatgtgtgtgtatccctaatttattcatctcactcttatatgtcacttgatttattatgttgagttattttcaaagttttttgctgtttctaacagcaaaaatggtatagctatgagcatccttgtaggtgaaaaatgcttttgtaagttttaaatgtctgacttttctcaggcataagatgcttcttcaatctcttgctgaaatctcaaagaagaatgtgaaagtcattcatattttcacaaggaactttgatgtgtccacaatgccccatactttcataagcattagcactgtctggtaatgttccttaggactttaagggtttaaagatatcaccatggttcccagtttcgtctttctaattacttaagtgatttaaaaaatgttgctgatataactcagtggtgagagacatatttgggatgtttaaggcccagggttggatatctagtaccaaacacacacacaaaaaaattgtgtatgaatgagtatgtttttaatttttgtaaagagttttttctctcacagattcataggaattcttgtcaattctaagtatcaatcacattacctttgaaagtaccaaaaattttagatttagttaaattgaatttatcaaccgattcttaaagttttaatttttaatgtatttagaaaatacattgaagtcatgaagaattttccttctagttttagaattctgttttccagatgtttacctttaagccccctgttccaacatcatttgttgaatttcccctttattcgccctaagaagtggtgccagccctttcacatatgaactgtggggcctatacaattgtcttctacttcatttcattggtggcatactaatttatactgtattccaaaactgtgttgcttcattcttttattacagccaatactttttgaaagcataaggcaacattttctttgtcagtgctggcaattaaagtgaactagcctcgcaggtatcagtcaagggtattactacagagctgtatccccaggaaatgttttaactgtttattttgtaactgaatcggactggtggtgtacaggctggccttgaacctgtgatcatcatgcttcagcctcctggtaggtagaattaaaagcctactctactgggccaagccttcagccacttgtttcaaagttatattgttttctggtgagattctctgcactctcttctcccattcagtcttcctttccctggaagcatctaatgttacagaatttttaatgacctttcattaatatttcatgcctatattggaaagttcacccacttctttcctatattagtcagggacatggtcacaaagagtatgcatatgaaatgtatttattttcttttaaacaagataaataaccaagcactaagaactctttgttgccctgccatcgacctccagccatatgttcccatcatccactcgaggaacctgtggggttttgctctttagcagctcccataagaaaatccacatgatatttaatttgtctcaccaaagcccatagtcacacatattattgctttgcttgaaaagttcattgattttcttttcccctgcaaacatgtcaagcttttctccagtgatatctcctgtctttcttgtactggggtacatgctctgagcatgcccagatccctaatgtgattgtttcatgaacactgtcagctctgggcatcactcagcagtggctgtcagctggcatggaagcagggaatgcctccccagcctgtcaggtcaccggatgtaccggtttgaatctccatgttctccactttatttctgaaagcagtatttcacatttttcttctttcctgttgctgttatctttttggaggtaatgaatgagaatggtgactattagctcctcattaattttgctgttttcttttttctaagtagatgtttatactatttatcaggttgcatctctttgtactcagttatcctgtgccacagctggccaatattctgtaaaattcaaaattccttaagatgagatattgggtattttagtatttgttcctatatcaaaggaataaacatagtatttattaatatttggcacataaaactccaacatatctaagccatgcattctcaaaattaacatacatttcattttaaataaaaatatctagttttaataaatgctgttgcacattggttgaattttcttattggcttaataaacagtatttaaaacattaatcaattatatgacaacattctcaggtggcagatagaatggcctagtaatagcagttgctgcatttccagaggacccagtttggttctcagcacccataagcttccagctccctgacactctagttctgggatatctgacagcctctcctaacttctgagagcacatacatatgtgcatatgtacacatgcacacacacgcacataaacaaaatcaagcataatgaaataaggaatctcagacttcatgatgaaacctccattttcacaatatgctttaatatgttgttaatttcatttggccacttatgaatttaagtttttgcaccaagttcattgataaaagatagacaattgtgggtctttttaaagtttggaaaactcttttcagaataggtagtcttttgcaagaggaaaacttgagtgcctatttcagtttctttattgcttattgatccgttcgagttcttttttctcattcccagagagaaaagtaacttacccaattttctgtagccatttactggcagagaagaaagaaaatttagcttgggtctcattggttccattgcttctgtgcttagccactctgataagtactgtgtagtcatatcttgttttagaagatgcccctctaaattttagtataggaatacaaggaaatggacaaaatagtgaaaatcatgcatttagaagacagcgctgttctttagcttttagattgaaggcagacatgatgaaagaagaaaagcattacgttaccccaggcataacctgagtagtattgagtgctttgttgtggattggaaagtaaagaaaagagaacaagagatagacaaaacaatagaatgtagagtttcagggagtcaatataaacaaagcccctgaaatctgtgatgctgagattacatcgtgtctttggcatacaacaaaacacagcatgaaaaaaaaaaaacagaatgaaaagaagaatagaggaagatagacatggccacacatcctgcagggtaaggggctcctcttcctcatccttgtgtttctggtcctatggtgggaaggtcaaatactcagtgagcatgccagtctcttatccccctgtcatcactcccccagcactcatgccagataaaggagtgaaggaggcttatggaaacattggcatggacatctgcttccttccttccttccttccttccttccttccttccttccttccttccttccttcttttcttccttccttccttctgggatattctgctctgcctcacctatgagccccggtcttagatcaaatgtgtcctcctctcagtgaaacctctgaccctcactgctctgcgatggagaggagggttatatctagcttcctagactacagttaccatgtgcgttatttgaatattacttcagaactcaagaaccacaaaagtcctatttttttacttcctcaaatactccaaaatacataaacactcaaaagtcaaaaatgcatgaacactatagatttaagatgaatggttggttaacccatttaaagcacagataagaatttcttgaagcagacacataaaagtgcaggctaaaattctggaaacccatcaagcttggagtcggagctttgagaactccttgtagaggaagagagaaagcgagagagacagtatgcttcctggacttcacaaaccaatgagaaagcagtttcaaagaagcaagaggctcttgtcattgtcatgcactccttagcatttgctgtgaaagaagcaagacgcaaacactgcccttcaaaagctgtgtttctggctttgcagagatgagagccagggttgtttttccaggatttcagtgggcaggatagagggctaaaatgccctgtttttaattttctgtgaaattcactgttctaacacagaacacaaatatacttaacacagctccctttccttaatacaacttgcatctaaaaataaacaaaacatatggaaaagaattatgacgcataggctgacatgagttaatgaggcaccagttattcagaaatcatcattcaacgcattgtctgaacttgagcgggaatttcagatttctgttcttgtacccctctaggcccaaacacaaggaaatacacagagctcagtcatttcccctcttgactcttttctgtttcctgtgtgtcttctgctttttcccacccctcatcctcagtttgtttttcctttcagtttctgctttgtcaaatactttcattgtaattagtggaaaggcatgctagcagtaggttatgtttgagaaccaaaagtttgctttgctttgtttttttttttttccctcctgatttatcctcatctggaagttgtaagttgtaataaattaattctaacttaaaaaaatagagttcagtatcaatgcaggataaaattggttagtattttcagtgttgtctctacttgaagcagaaattcccactgctattaacctatattcaattttgcagacatggatcctcaaatgacacataaatgtactatcattgtcttgagacacttttcctctgaagaaacagaaaaggaatgctccacatttcacacattgtattacaaacatttagtgtcaggaagaaaataaactggacagtcaccaagtacttggataaaatctctggcccacctgctagtgttagacccccgaaaactcaagtatccggggtctcaggccaggttcgcggtcaccccaatcaccaggcggattcgagagcttgctgcaaactgcacgaggctttattgtaatttaacgaactaaccccatgttagctcgggtctttcacccacccgccatggcggacggctagaaaagacggctcctaaggtctccccaaagatcttatagggcagcgtaaggggagtgtctaggggtacgcacaggctcaggattggtgtgcttccaggcttggagggcttgccctgtgttgattggtcaactggttgttatggctcataggccctcccagggtggttgctatgctctctacgtcattgctgtgcgcttgtccgtaaagcacacccagagccataaagcatagcgccaccagctaacttctgattggttccttgtcacgagacaggcatctgactttctggtttctaggacaaggtcatagaagcacatgttcgaccattatggctgccaaaagggaagctggttccttcactagcacacagcagtctaaactaaagtcctccacccaaactgttttttcttgatccttttctgcagtgtaccaggaagctgcaccatgttggctgacaatttcaagtattaaatagaaagttgttcttaatgatgaccttggcagaagccagttctgaagtggacctgaaaagacattcacaccttctgcccatccctgaaaatggtgatctctaacctccttcatttcaataaaagtacaaacaaagactcctgcagcattgctttcagatccatgaataaatgcttttttcctaactttttaaatgcaaagttctcaagataagtacagcctttcctctttcccatttaaatcacggtctttggctttaacctacttaaaggttgtacaaatggcgacaaaagccacttcagcggctgacactgcattgataaatatagaggagaggaaggaaaggacaactcctgcagtactttccagtttaattaaaagagatttgttttttcttgcctctaagggtcatggttcaagactaaacctaatcaatagtgtattctttcattttattccttcatcagtgtgttagaaactatgaataatcttgattttacagaaggaaaatacaaagtgaaagtagctctgaactgcactttctttttgcaaaaggggggtcaagacccaaacctggttaaattgccacctaggtgggaaaatcacatcattcttatcctagcatatgtgatgactgtgccttcttccattggctgggatgtgactgagtattttccagatcaactcatttaaaggaaaaaaacaaaacaagcaaaacaaaaactatgcaaagaaaattaaagaaagagagaaagggtctagaaattctggccaccaaattctagaaaatggggagggagagttgtataaataaacatcttaccaggtgagggaaattaaaattttgtataaacgttttataaggtggaagagattaaaagttgagaggatttttggaattgtggtctttggcagggtaggtacctttcataaaataaagcaaatacttcttacatttgtgttctgaactctaatccatatttgggagagcccaagttcatggatatttcattttgctacatgcctgaatcaaaaaccatgtgagaacttggatcatacaggcctccatagcctatcatcggacactcaaggtttttctttgtttgattctgtgttggagctccatccacttcacttcctgggcgaaatgcctccccatggtcacccttgagaacctgtttttaagtgaatattttctcctgtgtgcatttaaaagatttcaagtgttatgccatatatttaggtattttaggcttattatacagctcagtatcattacttgtttactcaaaatcttttcaaaaagtgtattcaggttataacagcactgtatttgattgcttctcatgctgtattcatattgataccacttattcacttaccttccttgataagagttattgtagactacttctaagaattctactcctacaaataatgcgacattgaagatatttaatcttgacttcggtttgtgatctttcattgttgactccaaagagttgctaagtcaaacttgctatctcttaattaatacgtagccttaggcactaatggtttcttctctgtactcctgtcctgcagtgaatgactttcgtacatactgagagcatcactgttatttcaaccagtccttcggacttttcccagatcagctggagtgaaatgatatcttgctcttatgattttcattttcaaacacaagcaaagttgaataaataatttgtatttttataaactatcctaatgtccttctctggagctgcttactattctggtaaaagaaactccattttatttttttcctattgtttatgtgtaaacctccccatcctcccttgctctcttgtattttctttcccggattcattatcagtttcaatagtgtataccctcatacatgtttacatatgcccctttgttaccaaatagctacagacttctctgtgccgtttaatgttacaaaagtatctcttaaccagcaaatccaacatgtgtaaacactatgtcaatactccaataacttcagaaccatgtatctggatgaaagaacaagagaagatttcagggttatgggttccatatgctgagtgtagactctaaagtgtcagatactcctatgtgctgctttagcaatctagtggagaggagatgctatcgaggatattgaactctataggaactttcatgctgtaggactcaaataaggcctctatgtccaggttctaaatatgtccctgttctcatatactacatgcagatgtttgagagtaagtaagttgttttaattatgaactaatctgcacttgatgaatattattcattttgttctaaatataggagagtcaaaacccaatcaccactgcagtcagcaaagataatgactagttaagcattaatccaaaaagaactatttgtcagaattcaacataaagaaaaatagtagtaggaattgatagggatgccagacagcagttagagatttagttttcattgcatgctaaactaatgagcatagtagtttgcattttatataaagacaatatagaaaaaaaaaggaaattaaatgacttgtctgccatcctaccaagtggtaaacaagtggtaaccagagtctagatgcaaacattcaatgtctagagactagtaacagaagttatttttcctacatatagtgattcttcacatcataaatcttgtttttcaggctgaaattcattgaaaggagttaccatgaagtcactgtcatcataagagcgtgggataaaaccccagacaagtttaagtgtcttaatacacatttcatcataactaacaaagccaaacatggacttaattgtttcccagacccactcttctacagtatttagaccatactgtccaccagtgatggactcctgatttctctttttctctctttaatatttcaagaaagaaatatgaatcagtcatgtttgtgtttaaccaaatcataaatctcaagtatctaatcttgtagactgatttctcttgtaagttacaagctagtcaggtcagcaataagggtgagtggaaggggttttgtgtggtataaattttgctgctttcagtcttcaaaagacaagagcaagcaagagaagtagggcattcaatgcggtagtcaccagcattctaaccccttccccatgtacaatgtcatccatgtgtagctgcaatcttttactctgtcttaaagagacattagctccagttgatcctacactaataacgcaggtccatggtgtgagctgtttccaacacctcagaatcccgtgtcctataaatgttatcttgtatcctttgagataattacaaccttctgacaaaacatcaatatggaattatgtggaaagaagtcaataatcataactcaaatttttagaagaaaagtagttgctaagaactggaatttttactcaaatcttcactagacagtagattatttattcctttattcctactcatgatctgtaagcctgtatttctttcaagaatttcttttgacccaaatctattagccatgaatctaagtccataatgatttattctacaagatttatttcacctcataaaatagtggtgttgccaaacatattgggggttatttagaatctactgcttactctcattatgtgctggaatgttgttgaatatattgaaaatgagtctttatttatcccacaatacaatatgtccactttcaaaaatactcatttactcatgtaaaataaaggactgtaatttccaagattttacttccaatatactggaaccattacaacttgttacggtagcaaacttccagatgataagaactagcaaagagcttaagaaaaatctgaggtagttgataatatacatcatggtggaaagttcttaacagtgtcatagaatgtgctgtgacttccctgccttctttatttttcccttgcagaatctttgtgactgctgatgtcttaaagctcacctctgtcatttgttttctcacctgtaattcccagtcatttgtctgtctagagcacatgcagagtaatgtctgcttgttttcttcaaacagtgtttattcagtcttcttactaggttttttcagtttggtgttactctcaattctatttttgttggttttgcttaaagcaattttgcttttatatgtaaaattcatgcttgtgatttcaagatttctgattataattttaacaattactcaattcttcatatgatgaaaaaataaaatagttgcaaaatcataaacacagctgaacaggagagccaacattttaattctctgtaaccaaagtatcaaatagcaactatcttcagatagtggagtcttgacaaaaatctcaaatttggcaatgagagtgagtcattgcactttttgtggccatatataaaaatcagtgccaacatggtaaaagccagctccactaaaccatatcatcttatcacatcttccacgaggctatggtgccacagagataactctccagatgtcactgattctaatgacaaacaaatgaagaaggcccaaatatttagttccccgtattctaagacacttctggggaagctcactcctttctaatcacgtggaaaaattgacaacctaccaaaaaataaactagaaagtcaacctgagactagatagaacaaagtgtggagacaaactgacaaaatgcaaacaactggctttagtgaaagatctttgggtctgccagcagtgacactgtgttggacatccaagtccacagcacatcccacccaaagttgacatactgcttggattgaatcccaagaaagtcaacttccaatccactccacagcctgaggaaagccagaagaccacacagtgaatccgaagaacagggagatattaataatgccacacttgggagtttaagtagaaacctctgcctcctcaaaaccacctccaggccctgcccaagaagaagaaagaaccccacaggaaactacaacatcaagcagacattagttatgtcaccccttgaattttaagcagctttcttgggctcctcaaagcccactcctagaaaaagttgcatgaccacgtggtgagtaaggtcagtatatagacaacagttccaccatgcttgggagataagcctatactcaccccagactccaggttcattctctactactggaggaaaggattttaatctagcattcacactcaatctgtgaattatggtctgtttaaccctcttcaactaataatacaaacaatggtacattttgaccaagaaacatgtcattgtaattcccattccatataaaagccactaatagaaaaagaaaaaaaagtcacgataactgcctcacctgaatgcacagcaagagtggtaaataatccaatcatccagagaacataaaaatatctctgcttcctaaggacattgctagctgacccagtcacaatcataagctagaagaaactcttaaggtttactactacaaaaacatacatacaaaagccagaaaaagtagttttctctggaaatgtaaagatatcaccttcaagtcataggatagataacaaatactcaaaaaattactaggcattcataagactctaacaaagctctaataatggactccccaaaaatgtatagcagatgaggaaaataattcaggataacattttaaagtccatacacatatcaacaaaaaatatgaaaattggaaaatagcacatgaacaaactgagaagtctgtgagaaaacggaaattgttttttaagaacaccaatcctagagatggacaatgtaaggacctagaacaaaactgtcaaggaaaatttcaaaaattgtcccaagttgaagaaaggtcaacttgtagacagaacacctgaaatcactcaactgtaagaggagaaaagggaaaaaaagtaacaaaataattgtgtaaattagcgaacataaccagttgtagaatggttgcctagcataagcaaagcctctgttttgattacaaaggcagggggaggaagaggaggaagagagagaaattagagaaggcaaagataaagggccaaaactgatttttaacaagacaatagatgaaaattcactagtctgaaagggaagccaacatctaggtctaataagtacagtgatctcccatcaaatacaaagcaatgagaaatttattgcaacataccaacctgtcaaaaatgaaatacagagggaaaacattaaagcagcaagagataagaaaataccacatagaaaggagtcatacaataatttgcagacttctcagcagaaatgtggcagtccaagagagaacatgtaaaactggagttttcttttccaccctggtcctgcagcccttcagccccaaataaacacatagatattatattaattataaaattgttggccaatggctagggcttcttattggctaactctgtcttaattattaacccatttctataaatctaaatatttccatgtgatcttggcttactgaagaatgcccggatctattactcctttggcagctacatctctttaaggtctttctctgcctacctttacccagcaaagatattcttcaggaatgaatgggctcttaggaggcttaagtaggtcaagacaaccctggtgacctgagttcaatccctgcatgctacaaaagaaggacaatcattgcctataagttatcctctgacttccatgtgcacaccagagcacatgtgtgggcacacacacacacacacacacacacacacacacacacacagagagagagagagagagagagaataataataagaataataaatattttaatattaaagaaatgcttaaaactgaaagagaataatggaaattgtaacaggccctccaaagttctaaagataataaaatatacagacaaagtaaatattcagataaatttgaaatgctatgatactacgaaatagatcattaatattggaaattgaaaaatcaaaatatgcaaacaaaaagttaaaggataagcagttttaaaattcacaattatgatattaaattgaaatcttttagagaatgaagttaaattgtaatagttttcattttctatataaatatatctctctccactcaccttaggactacatgcccactcagagatccatctgccactgacccctgagtgctgggattaaaagtgtgagcctggctacgcacattcttaataaccttatcaggaaagagagaaaaccaacagcaaacagactccagtttccagttagtttcactgtgttttcaaagccttttccaatagcttagaagaatgcactaggttttagcctgttccagcctgtgtgtcagtgtaattcctaagtatatggccaaaggtgagccaaattatttatttcatgttttttttttcttttttgagacaatcttaccatgtagccctgggtatcatagaatttactatgtacactatgctaagctcaaactcacagaaatccacctgcctcttttcccaaaggctgtttgtaaagatgtgtgcaaccatgcctggctttttagttgagtctttgtttcctaaaaatagtcaaacatttttcttttcgggtttttctttgagatccaaatccaatttaatgaggtctcttttgttgtatttaattacttattttggtatagagtgtgtgtgtgtgtgtgtgtgtgtgtgtgtgtgtgtgtgtgtgtgggtgggtctgttgtggacagaggttaagctatcttcctcaattggtcttcatgttagtttttgacccaggatctctcactaagtaggagccagccagcaaaacccagtgatcctcctgcctgtgccttcccagggataagattcatgcttgggctgaatgctgagaatctgaactcagggcctcctccttgaatgacaggtgccttattgactgggccatctccctagcctacaggctcttctttgtctgttttaaataataacagccgaatgtctgtaacacaaactcaatatgctggctagttttatgtcaacatgacacaatctagagtcataatttcagaggaggcctcagaaaatacctctatgagattggtttgcaggcaagcctcaggcattttctcaactagtgatttgtggaggaaaatatagcctaatgtatgtagatgttctccctgtcctgttctgtgctaccacctaaagtcatattgatgtccacgagctgtgacatgaccaagttggtgactgtggtcctactgtggcctggggcaatgttgatgtccatggccagtgcagccactgagggctagatggtgtctgtggtctgtagtgccactagaaaccatgctgaagtccatagtccagactgccactggaggccatgtggatgtccatgatacatgctgttgccaaaaaccacttagaagtccatgaccagtgctgctgctgactgtaaatgcaaggaatcttcttttgcagtggtattgatgactgctgagttatagttgagaatgagagacacagaaggcttctgtaacaacttccctatcctccccaaaaagaaatagtctagacaggaagtcattaaagaacactcttaaaaattgagacagggatgctgaagtgtagctcttcatagttgatgacttctggtggtgtgggggtggggaaggagtcaattttcttcaagaggctgggcactgcactaggagtttgaccatgtatatgggcaacacaaagtggtctttgtatgactttttttcttttttttttttcaagaggaggtcacaagctttgtggggtggaacttggaggactggaaagtgagtgtaatctggtacattgtgtgaatttcccaaataatcaataaaaatattatactggaaaaaaagaactcagtttgaaagagctatggacagcaagctagtaagcagcacccctccatggcctttgcataaagtactgcctccaggtttctacctcacttgaattcctgctgactctgattttgataataaactgtttcatagaactggtgagtgaaataaacccttcctttccaagtttctattggtcattgcattttatcacagcaatagtaaccctaaggaagatagtaagtaatgtaagaccccccgagggaagatcctcactcaagcactcaagtctcgggatgatgcaaccccctaagaactcacgagagatcgtccttgctgcaatcgcacgaggtttattgacaggaaccagagcgctggggcagagactcatatcccacacaggggtagaggagtttcgaccctgaatggctgggaataggggtttttaaaggaaaatttcacaacccaaaataccaaaaataccagtgaggaaagaaaccccaacccaaaataccaagaatatcagtgacaggtcccgagggaaatcataaggggaaactccctgttccttaaaattgtttgtaagattctaatctaactttttatggctagccttttcctggaacagagttgctgaaccagctagctaccctatatcctaggccttattttgtctgctgagggggtcttctttatcctggcctttcagtaacacattcttgtaattataacatttgcaaattttcaaccacatcatgtaaggaccagctccctacatttcagcagccataacagccgaacacgtatttgtctgaccttgtcttagtcactaaggtcagatgcctgcccctttcggcagccatgacagtaacgagtgcttttctgaccttgccttggtcactagaggttaggtgcctgcctcgtggcaaggaaccaatcagaagttagctggtggtgctatgctttacagctctggtgtgctttacggacaagtgcacagcagagcatagcaaccaccctgatagggcctatgggccataacaaccagttgaccaatcaacacagggcaagccctccaagactggaggcacaccaatcgtgagcctgtgcgtacccctagacactccccttacgctgccctataagatctcttgggaggccctaggagctgtcttttgctagccatccgccatggcgggtgggtgaaagacccgagctaacatggggttagctcattaaattacaataaagcctcgtgcagtttgcagcaagctctcgaatcagcctggtgattggggtgaatgcagtcgtggcctgggaccccggatacctgagttttccgggggtctaacaaaaccacggaagccatgaggttccacctgagtgggggaacgtggacttggaaattcctagtaacccaacatcgataaagaccagacataggcatcttgtcatctttagagagctctcagtgccatgctacaaaactggagtctcgtctttattcagcatcttcctggctgtttcctaactgtgcttccttgaccctgagactgcttctcttccattttcctagaccctatctggagatatctctcaaccatctcccttcctgtagactgatagttcctaactatctgtcctcaccagacttagacttagccctccgccctggtgcaggcctattcaaatgcttagttctatagagattcaaactaggggacattctccactgaggctatgccatccaatagcagattagctaacatctgcaatacaattgtagaccagagctcctggttactagaactagaggttttttggaccccagacactttctaatagaatcattcttggctcccgacagctgtgccgctttgcttgaatataataagtaagaaaatgctgtgtcttggctattgagttcaccttgtccaccagagaacttctgaacactgtggccacgaggcttgatcacaacccctggagcaatatggtagcctcctgactgtaacaagctctgaagttcttcagattttctacagccttgctacagccactgccctaaaacagaaggtttcttatgccttggaaagttgagcattgctgcttccaagtatgcaaagctggagactctagaagctatagtggtattgaaaggccaggataaagaagacccccctcagcagacaaaataaggcctagaatatagggtggctagctggttcagcaactctgttccaggaaaaggttagccataaaaagttaagattagaatcttacaaacaatcttaaggaatagggagtttccctttgtgttttccctcgagacccttcactggtattcttggtattttgggttgtggtttctttctttctttaaaaaaccctattcccagccattcggggtcaaaattcctctacccctgtgtgggatatgagtctcggccccagcgcgctggttcctgtcaataaacctcgtgcgattgcagcaaggacagtctctcgtgagtacttggggggtcgcgtcatcccgagacttgagtgaggatcttccctttcgggggtaggccttacagtatttgtctctccttgaagcattttgaattctgcaaaagatacatgaaaactaatggtaaaaaaatttaaaatcactttaagaaaaaaaacaaggacatcaaatctacactgtcaatttgctcagagatatatgtttggctgaggcagaattggactgtatatcccatgcagatgcttcagtagagacaaactttggtctcaaaaatgctggctatatgtatgtaggtgaagatgagggaagagttttgtgtctgtaatactgggagacctgatggaggtgctctccatcagtgagaatcaatgcccttttactgcattgaggtatgtattacgattaaagtctctttattcaagaagacaccagggcaaaacacaggccagaactaggttatagaacccagcaagcacgaccagaacaaaaagggcccgggtccccacgtgcagccccttaagaagctcccttacgtcaccccggctttccttcaccacgcccttatgggcgagtcccgggtccacctggtacctgtcccaggactattgggtggggctagggtgtctccctacaattccccttttagtctaaaagaggattaaaacttaatagtataaaatatccaaaactaacaatcataagggtgaaatacaagaagatacaataatctgctatggtacatcctatgtctatgtctaacttgaacnnnnnnnnnnnnnnnnnnnnnnnnnnnnnnnnnnnnnnnnnnnnnnnnnnattcttaactagacttacactaccctaatacacaataatggggaatggggacgtagcatcttttaggttatttcctgctgaaatgggacgatgatagtcatgtgggggccctgtagaaaaaaaaatgccagtacagggaaagtctctaatgagttatgtctagtccatgttagatgagatttgtttgattgaagatctacgttgaaatcctcaacttgattgaagtcattacaatgagttgaatccagtgcagtcggggaggtgtagtccaattctttttctggagcatgtagggattgctgtcaggctggttcttgttggctgtatgggactcaaacgtaagtgtcatcagagaaatgtttgcttgttgaaaggcaaaccttgacaaacaacgattatgagagggtgtgaaagaaaaagccaagaaaagacacaaacactcggacatagaagttgaggctgactctatatgaaggaggaatgggaacattttcaaaacaaatgggaacacctgggagtctattaggttcagacaagaattataccagagcagaaccgacaggtattaccttccttcactattcctcaagatcagaattcactgataaacaagtggtacttgggattggcaaagcagtttgagttatgccccacttgctgttctcactttagcttgacttagctcaaagagtgctgactcaaaggtaatttgaatttgtattcccattgcaccgaaccagtcctatgaagtcattaacagattctctggtctatcaaaattaggactacagaacttttgaaactaatttccacgagtgatgagatatactttgctgattttaatcaagacaggctaatagtaggcaggacatttaaagactcaagttgaaaatattaaaaatgtattaactattagctaaagaataaacaaataagtattttaaagatcatatcatatttggattttaattaatgttagtgttagagtcatcactttcattaacatttcttcttgggtatggagagacagttctgcagcctgtaacctcagatccaggggtgcaactccctcttctggcctcagtgggcatctgtgaacacatgtgcataaaataaaaatgaagtaaatctttttaaaaccttttttggcacccacgcaaagcagttgaggtcattaaaaaaaaaaatcagactctacttgtctgcaggtctccttgctgatatttgatgttaggttatttttaatccccaatgagagcaaaaactagactctcaaaggaaagattgaaagtttttaacgtatttacatttctgaaataagttgctttctatggtaattgccaggatttaagacattttcttgacagctgctgacttcagactcaagaaatgttccaacaggtaatacagagaaagaaaggaagaggaaacgtaatgaggcatgctttagtaagacatctgtagtctttttctgtttgggcttttcccttgtcagtttgattaatgggatgtctttaaatgtatctccttttggatatcttacatctcaacaagtccatttcatgttcttgccaccaacatttccagtagatttcttctaacatgtcagaatgacagataagtttcagtgttggcctcagagagaactcattattgtttcaaaccagtgcaaatacccagaaggtcccctggccagggggcctgtggagagccatgtcattcccagaaaccttgtctagtaaagatggtagtgggtttaaaataagggtgtacatcaccagtcaaggtcaagtgttggttttgtcagcatataataacctcctgagttaataagaaatagaaatgcaacttccaaagtgcattgtaaggtttttaaacctctttttagacagaaggctgccagtgatttcctaggatttgactagaaagtgtaaacttcagataatactgaatatagcccaatacactttttattcatggtgaaatatttgaaagaaacctccattctttaaagcataacttcagtgcagtgtgatgttgtctctttttcccaggaaaaatttaataaaaatataaccacacattgaaagacttaaaaattagcaaagaaatatagcccagataaagaaactctccaaactgaatgtagggcagcctaacccagaaactaaggccactactatgacatagggcctggaatttaccagcttacaaggccataagataactgggtaccaagaattcccagatggccaccctccccgaggagctcatggaggaaacagattgccccactggccaatgtgtcaataattaacaattaagggtccctatgaaacaaagagatagctaccatttgctgaagcaagataagcatatcctgaggtctgcaggttttacaactggtgggtcaggaggccatctgattcccagccctctcctcaagacaaaggagttcctcctaggaactcatgactctggtcacacccctccctaagcttgtggttttgcctttaaaaacacctgtgcctgggggacagggctgctctctagcctgcctgctgagagagactgtttgtacaaatgtccacctttcattaaagccccttgctgtttgcatcaagtttctgcctcctcatggtgagtggggtggctgcagtcctgggaaaagattctggaggcctgagcttctgggggtcttacaacatgtattattcctttctaaaattatttttttggatcacccttgaattgtttctttttgtttaacacttatttttaaaatatgtgtgtatgataaaaagaaaagtttaacttttcagtagaaggatacggaaaacttgtatgtgaaaaaacttggtaaagtgtttgtatgctgattacatggtattttacatattgttagtagtcctctcattaaaatttgaaactaatgatcaatattaattgataaaagcactattgaaagtgatgaattgataaacagcctgccctaaccacttcagcaatggggccaagagggatgatttcactagctgcattaaacttaaagatatcaataataatttttattagttttgaattctgagcccttagcattgagtcattctttcattgacttggctcctttgtgttttcttcagtacaatttaaacccaaaacaatgctactagatcaattcaaatatagattttgggtaggatcattttctcaggtaagagaattattcaagtcattgttaacctacatacaaaacaaacaaagcattttgaaagatatttaatgtgtctcagtgaattgaaaatcaactagcagatgaggagcttcctaacacaggttttatctccttaaaattcctatttgcttaagcatcttatcaaaaagttcatttctcctcaagaagtttataaattctgttgtataaaaagatcctgttccagatatttaagatgtaaaaatcatctttatgttacactgtgttattacaaaagccatgtcatgctacgaatgatatagatgtgttatctaattcacatgtccttttttattcctttattatatatagcatgtgaaaacaatcaggagaagttttcctgagacaagggagagggcactgtgtaaacttagggcatgcccagtgcccatattaaaaagccaggtgcaaggacatgcatttgtattcccagcactggaaggcatgacaggttgatctttgaagcttgttggccaggcagactagccaaaccattgaactaaagtctactgggagacactatcttaaaaaatgaggtagagagaagctgagggaatagtgattgaagaagacctctggtcgccacaggtatgtacgcactctttcatgcacacctattcacaagtattcataacaagcatgtatacacacacattatgtacacacacaccctcttaaacacacaccaatattactatggaggatccccttttaggagtattaagatatgattgaagatgataacgacaaatgttttaaagtctgtcaatgaaaacaaccaaagattagattaagtcttattctaataattaagagtgaattcagcattcttaaatatgtaaatattcatttgagtgctagaactatatccaaaaggaacaattggccctcttgcgggcaaataccaaatgtgagcaggcagccttagggcttaaggacaccttgttatgtttccctataaaaaaacaagtcacccattattgatgacattggccattccacagtgaaggggttgctttgatgaaataataatgtatacaaaccaatggagaagagattaaaatatttattttattttaaacttcagcatgttacttcagaaaaaaatacacacaaaaatgactgtgattgtacctatgtgtatgagtctcattattgtaaaaagaggagggagtgttgaatcctgtgcctgtgtcaaatactgtactgttctgaaaatgcaacacattaatttagagtgaaaagaaatactatggacctatatttaaagggggctgttattttacatgagttgtagataatcatatttaagtgtatattcactttttgaaacaaagacttttatgtacatgcatgtgtgtaagcacacacgtgtgtgtgtgtgtgtgtgtgtgtgtgggtgtgtgtgtgtgtgtgtgtgtgtgtgtgtgcgcgtgcgtgtgtttatgcttgtagaagccagactagtcactggattttctactgcattttctcaagctgagtaactgacaattgtgagttttcagatgtgggtgaaccaatacctaacctctgaatcattgatccaaaccctgtgtacagtcactttttaatggtgtttcaaggtaggtttaaaggagtccacaagacccagataaatgattaacaggtatttattagggaagtacttacacaattaatagtaaatagctgccacggtcttcctgctcctgaagatgcagtctttgtccttctggaactacctttgagagagtgccaacccctcctcttccttataaggggtcacatctgcacgcctgaagccatgcccctaggatatgtccaccaccacaaggccactggtgaaacaagttgccactggaggtgtttgctgtgtaaatgtttacttcataatagttttatctcatattcattgaaatttcaaatagttacttattggtttcccaaataaatgtgcagagaaattacatagtgtaggattcacaatgtaacaaatcagaagacacttgtgtgtcattttgaaagaaaatcattaagttaatcaataataaatcatagtaactcattttcatctctcttagtagcagtcacgatgtctcaataatcttaaataactataaaacaatgcttataaatgaaatattataattttaacattttaatatgtcaaagtgcagaaatcatattatgtttttcatgttttttcaacaattttaaaaattgccacacaaagtaatagatttccgtatgggattttcatacatatttctttttggttggttccacgctcccatttccttcctccactctactaatcacccctagttttccttctttcaatttagttctattgctttccccaaagccttccttaagctttctttttcagttacatggactcccatctagtttcttggtttttaccgtatctacaaccacctgcatgcatatagttaagttggaggctaagacccacacatgagagagaacactgtctacttttcttcctgaacctaggtcacttccctgaacagtttcttttccaataccatctgttttccaggcattttcagaaattcactttttatataactgaataaaatcctattgcatacataagaaacatttttattatctactagtctgatggtagacatctaggctgatcccattcctttgttattgtaaaaagggtattattacatgaatgcgtgtatacacgccatttacatgctttttaaagagtgagttcctgtttgttaatacaacctcatacaagcaataacccactgaattatcaggaacctttcacagttcctactattggggaatcatatatgaattaataaaactaacatgtgcaagaatgttatagtttgattaaatgaaaaagaagtattttctcacctgtggaaaatttgatgaaatctagaacacatattcctattttatgtcactcacacttatctgtataatgccatttggctaccatttaacttcctaatttttgcatgtattttgagaaatttattatatagtatgtgtgcatacatactgacccacaaccataaaattattttcattgctatttcataactgtttttactactgttatgaatcataatgtaaatatctgtgttttctgatggtcctacgtgacccttatacaaaggttgttcaacccccaaaggtttcatgacccacaggtttagaaacactgacttatactttagtttttattttatacctcagctcaagttcatgagcagaagcagtgaactgcagatgataccagcagaaaacaaatttgtagaatttgtatgagtatgaagaggattcaagggaggctagacaacagacttcagaaattttccacaaaccacctcttcatgttcgatttctgcaccatcatcatgtcttagcttacatatatgctttcttcaaattcaaagcctaagaacagtgtatcacctgcctttagtgactacagaaaaaaaaattagttatctcagttccaatattgtgggtgatggagccttgacttccaaagctgcttatttcacatggcttttgtgtgcatgcttaaatgatccaagtagatgaaactaaatttctgagaggtatgtttggtgttttttttttaaatttatattgtaaatgtaataaggttttggatctgtatgtttttctgcttaaaaataatgttggttagacatcaccaaacccatgttccactttctgatttctagttaatcagagtcatttacaggctataaacattaagggaaaattttcaaaatagaattcagaaggagttgtttcacaatatatattataaataaagaactttatacttaaaatttatacattaaaaagctttagaaatcattttaagacatttttgtctcaaataatataaaaaattttaagtcactggaaattattttgataaggtatttgttaaaatatttcacctagccagagtgaaaattacataacaattacctgaaaatatttttataaaatctatattaaacttttgctatacaaaacaaaaagtgcttagcacacctaatattctatgtactttgtagtccggattatgatgggttttcacggtgttgtaacttgcagattttcctcttcaaatgtaattaataagaataactaatctcagcttttcttaagtcatgggaaaaaagaaaaattataatatattgcagtacatatgtatgcatgtatatgtatgtatatattcatctgtccaatatgtataggtgagagtctatgattttttagaaagtcactgaaagtcttggcacagatccctgtcaagagaaaacccacagtgttatttatttgaagatggctaatgtgcttgtatagagaactaagtacaggacagctctcttttaagactaaaatttcatgtttctgaagctcaattcaaataattattcttatgctccctgggactactataatcagagaattcagcacatgtaacaaaatagcattaatcacagggatcaatcaacaaacagggtgagagtaaaattctctctcacagcttgagagaatcctaaagaagtgtgtgacaccatccatgagccaaagacattagtcctaattcagagttaaaagtttattgtgagaaagaactagaaaacaagtccaaggcattcataagcagtacatatgatgtattggggactctctcatagacattaggaaataccaagtaacaaaaaagatgaatgtgtgcagtgcttacttcaagatcacgagtatcacttgatttatacagcccaactcaaggacagatagcactcccaaaataggagtctgatgggaataataattctgctaatctgtgtggcttatgcatagacaaacaccccctaaaatatgttgttgagatacacattttattatcagtggtcaaggctgcaaccgcaggtattagcttttcattttttaaattttaggaagtagacctgattttatttgtctgaaaactacaatgagctagcattttgaaactggcatattttgttcattaattttgatatctgtgggcatctcccactgaaagatgctgcttcatataatgcacgagtatggcattctttttgataaatgcacttgtagcgaagacacaggcaggagggaaaaattttttactgaatgacaaattcttttgtctttacatcattcatttgaaaaaaataaaaataaaagctccttggagtaaaatacagtcttaaaggggttattatttctcctcaagtagctcttaaaattatcacgtcaagttgtaatctcttggagaagttttatgttttgatgcaatagtaaaagagaagaaaagaaaaagagatgtttcctcatttctttgaggatcctggccatattttccttcatggagtgagagctcagacaggcagaagttactggtaccccattgtctccttgaaaataatgtttgactggaatgtattgcatagtttataaaatattcccagtgtattaagactaagacccattctgtgaaatcaatttcattggaactcagaacattcaatttggagtcagtatttagggtttaatgtcttctatatcctcacaactgaaatctaggcttgacatgaatgttcaaagataatctggacattgtaataaatgcctgccatcctagcacggaagtcagaagataaccaggacagccttgtctgcaagatcctgtatcaaactaaaggagcaggtggaggaggagaaaagaatcagtggatggatattaatcagtattttctgcaagtctaaaattatactaaacattatttgcaactttttcttttttgggtttttgagacaaagtttctctctgtagccttggctgtcctagaactagatctgcagaccaggatggctgtgaaccctcagagatttgcctgatctgcctctcaagtgctgggattaaaggcaatgtgtgcaccaccactgcctggccattatttgcatatgaatattgaaaaactttcataaacattactgaaatctatcttgtgtgggtagaatagaaaataaactaacctctacttaagataatcctaaaaggcttaaacaatgtgcccataaacaattacatggggcattcctcagagaaatcatcagaggttgcacaggagcccagtggtgttaccatgtctccatggcaaggtatggggaatagggaaatgatacaagaaagaaatgtcattctagttgtgaatgtcactccaagggaatgcagctatctctctatcccctttccatctgctgtgaggtttgggttttccattgatcagaccatactagagaccagtaatgttactcattagctcagccttggagaggcagagaaaaggatgcaaagtaggaaagagctgagatggaggctcaaatgataatctagcttgtaaacccccatgttaagttctgttctagattcttaccctgttgtctggtaacaaatgtactttttaaaaatattatattataaagtaaagcattcacattacaaagatttgtggaaatcttgaatttgactaaacagataaccagataagaatagcagataagaaaaaaaaaagaatagcagataagagattaactatgagccaaagcataggtgtgtgtggtgtgtgtgtgtgtgtgtgtgtgtgtgtgtgtgtgtgtgtgtgtgtgtgtgtgtgtgagttctacattttaaagatctttagtcagaatgactagaatagaaacatgacaacaaatgctagtgtggatgtgaggagaaggggacatttattcacagttggtgggagtgaaaactggtgcaggcacgatgaaaactactatgcagttcctccaaatgctaaaaatagttttaccacatgatcaagctatatcactgtactagttacttttctattactgtgatcaaatgccataaccaaggcacttataaaagaaagttttcaattgggcttccaatttcaggggattaggatccacaaagacagagtgaaggcatggcagccggaagagctgagagcttgaaatctccaaccagaagcaagtggtaaagagtgaactgaaggtgacctgagattcttaaacctcaagctttctgccagtgatacccatctccctaaaagaccacacatcctaacctttttccaaactggaaccaaggaccaagtagtcaaatgcccaagaattatgagcgacatctcatccaaatgagcacagccactcttgcttgatagactccacgctgtacaaaagtatactagctctttcatgttgatttctactttatgctcaaaagccagaaaatggaaccaacctaggtgtctaataactcatgagtggatactgaaactgttatacacatacacaatggaacgttgttcaactgcaaagaaaaatgaaacgtgtagggagaaaaagggatggagctggaaataactattctgaatgaggcaacctatacccagaagtacaaacctcatatgctcactcttactcatggatgtcagatttgaatctttagttatgcatgcttagactgttgaaaccagaaggcaggaaaatggcaaagggaggaatccaggtgatataaagagagaaaggaaatcattgaagaggaatggtaaatgggggagaatgggggtgaatggcagaggaggaggtgagtgaggggttacagattctaagttagtaaatcttatatttctttacttatcattcaaccaaaactaatgtaagtctctggtatgttgaccttctaggcctcttatactttggtaattctgtgtagataacaggcattaaggaaagcaaatttctataaacaaagcaaggccacttaaagactgatttgatggaacttctttttttctttctttctgtttattcttttgaagggaccagcttcccttttggcagccataatggctgaacacgtgcttctatgaccttgtcctagacactagaaagtcaaatgcctgcctcgtgacaaggaaccaatcagaagttagctggtggcgatatgctttacagacaagcgcacagcaatgacacacaaagcatagcaaccaccctgggagggcctatgggccataacaaccaattggccaatcaacacagggcaagccctccaagcctggaggcactccaatagtgagcctgtgcgtacccctagatactccccttacgctgccctataagatctcttgggaggccctaggagctgtcttttgctagccatccgccatggcgggtgggtgaaagacccgagctaacatagggttagctcgttaaattacaataaagcctcgtgcagtttgcagcaagctctcgaatcagcctggtgattggggtgactgaagtcgtggcctgggaccctggatacctgagttttccgggggtctaatactttgtgtcttatacatcatgtctcccgatcctacccatatccccagaatgaaacaaagaaaaatttaagagaaaaaaaaaaaaaaaaggagaaaggaaaaaaatctcatcatggaagctgcaatatgatacagagtgagtcatgcagtaaacctctttattccacacgcttttacatgcaggcttcactgcaaacaatcattggtctggtttgagacccctggtctctgatacacttctgaggacattgggccctcgttgggactcttcctggacattccattgctgcccagtatggtggagatcctacagccccgggtctgtagaaccaaccttccccacccttcccatcctctgtgctccagcaaatcacagatggattgggcgaacatgtaaccctggctctgggcctgaatagttgcagggttgggcaggctgccagctctcctgtgtcatcaccaccggggtgagatttctagcagcattaccctggctagttcacctcttgcagccatgagcaaggggtggatcagttctcccactttcacatcctcaggttcggttctcccccacctgagcctttaagaccagttctactggcattgcccagtgagggtgtaggggccactctcctgagcgctgcagctgatgaggagcaaggccagttctcccttgtgactgcagggccagctcttccacctgcccctggagatgataggggaggggagtgcatatcttccctgtccatgctgccacatgacagatgagtaatggggacagctctcccatgctcacatcagggctgcctcacccacaccttcatcaacagagtcagttctacattgctgccctggaaaggtacagggcccactttcctgagtgctacagatagtaagagggagggtactttgccttgtctgtcacaggtggtgaagggcaagggataagggagacatctctcttcctacccacaccaccacatgacagatgagtagagtgttatggatagttctcccaagttaacaacttcaaggctgtctcacccatacctttaccaacagtgttggctctctcatgatgcccaggtgaggtgcagggccggttctccctaagtgatgcagctggtgggaggcagggacagctctttcactcttatgacctcagtcagggccagctcttccaccttccccgggcattgatggggttggggagggacttctcttccccacccattcagccatataacagatgagtggtcaggctaggtctcccatgctcacattctaggttagctcatctgtaccctcatcagcaggatcagaggagattcagggcccactttcttgagtgctgcaactgggaaactccctcacaagctggagttgggagggacaagtgggaagggcatcttttcccccattcccaccactgtatgcaggcaagggaggtgtaccagccctgcccctctcataccctcagggctgtctcacccacaccatccatgtttgcacagtcaaccttactgtgctggctaggcatggttcagggtcctttctccccttgctgcagctggtgaggggttgtgatggaactacttaagtgcaaggtcagttattcaaatcaattgccatttacagagaaataggccatttcctttccctctctatttacagcagctgccttgatctgtgttagaaagaaatcaccatttcaaggaactgctatgtttatggctttatttttttttaagacaaacatgctgaattatttggacggcataacttcagaaggttggaagatccatcaaattgcaaatttctcaaggtcaggaaatcatggtctctattttgctggaaactttatatgagcctattaaaagcttctaaacagagcagttactttgtgcatgaagtttcaggtcccacatttaggttaaatacttatcttactgtcagggctatggcaattgaattgggctataccttatattttctgcacatattaaaacaccaagcttacattgccaaatgcttcatcctgattatatatgcccatttaaaatggggttcaatctttctctttcttatagtgttcagctataataacatggccattaaatttgtagaaaacatatttttagacactccaatgctatatatttttcctgcagaacagctttaagacaatatggctgaattgtctttatccccaaggcttaatttattattggatttagaatagtgattaaattgaacattctacacccatgagtggtctctgagaacaaaagctggagtaaaaaactcccaatgtatctcagaacaagtgagccacttgtagacacatgatgtctaagctcaaatgtcatctgcttaaaagtatttcaaatcctggaacacaaaacccttaaaaactccaaaccaactgattacagagctttgaaaggattcctatttactatagaaaaacatgatgatgatttttatggcacactgactttgtttcagtgatgtatggatttaatatcaagactgtagactcggagtaacaaaatatctcatccctttgctctagaactagatgtattaggcagttgcctttcagggtgttttgtttttctttgtttggtttgtttttcatgttggtgctgcgtgttgaacattcacctcacagaagtgctcacagctgagctatatccagctcatctctcctgagaaatgaactgaagaaaagagtcctcatggttcatggagaacacagagaaggggacaggggtccagaagccatctgtgacattcctggaaaggaaatgcctcactaaatcttctcctgccacaaccagaaaaacagttaagggaacacacagcattctggaagaaagaatgcagcctttgtgatgcctgtccactttccacttgattaaagttctttgtcaaatatgattcaggtttaaatgctatagggatgtgctccatgcaccccaaacagaagggatataattatacctaattaccataactcatctagccagaagttctccatgacttgcttgagtgtacgcaatgtcatttcagcaatgaaaaagaacattattttctaagaaaaccaaccttataatccatgtatttaataggctaaactacttggaaagaacattgattcttgtttcatagtaaaacaggcctctcctcctcacagtcaatgtttaaggacacaagagagtttcatgtaacaagatgtgtatggtcacctacaagtaactttagaattctcctgcatcaagaaattcttttatttttattcaaggaattacctcagaaatacttaaacagtagatggaaattccagaattttatttatggatctggctgtaatctccttttgttgtttggaactgtgaagtttcccttacaatctgtgatttacaaaaaaagaaaaaaagtagaaacatgacctacagacattttcctttgtacttagaaaatatcctatttaaaatgagtaaaattttaaagccacaagagacagaaatacacgttaccccaggggaaacctgcattgttcttacattgtagttattagaataaaagaataaaatgacaataaaagacagtcaaacatggggaaatatattgtacccatggaaatgagctacatattaaaattaaaacaggtagaaatttctacttttgagtatatcatttaaaaataaatagtactttgcattgcaagacacaatgcagatagatgtggaatgtatgaaattaaaatgaaaatttgagtcgggctagggagatagttcagtcaataaagtgcttgctaggcaaacatgaggacccgagtttcaatgctcagaacccatacaaaagctgtgcacagaggcaagcttatgcaattacagacattgggaggcagagacgggtgaattcaacatgtctccccactttccatttatgtgtgtacgtacatattcatgtgtgtcagtgagggtgcatgtgtgtgtatgttgggaggggtacatatgcatatatgagcatgtatgtagagattggggacaacattaaatgctagtctttcagggcacagtattccagttacctttctaaataaagtacttttgtacagaatgttacaagagttctgtaactatgtttagaaccctcttttaatctgagtaatgttatcaaactgtgggggaccgattatgtggggtcccaggttctggctgtcagcagctgtggtgccagaaaactctggcccactattgtattgttaattaacaccaggctgcaactttacctggcctgatgggaatgtgcctcttattttgcatctgtatgtgcctaagcatctgaataggcccttacctggaaggaggggctgggggtatgttgagtgaggacagagaggaatgaagctggagagggccagagggagagaggaggacaaagagagaaatggttgctttgtagtgttagcatggtggttaagggacaccagaaaagatgattaataaaggaatggctctagttccacagcatggaactgagagctctctgaagatgacaagatgcctgtgtttggtcgttatcgccgttgggttactagcagcttccaagtccacacacccccactcaggtagaacctcatggctgtcgtgggttaaagctgagacaagcggggccacgacatcaaacatttcttaatatcatttaagcatcactattctttgacttataatactcatctcttttataattaaaagattttttatctttttgggagaaataaatttactgttgttggtatttagagtgcttctaatttttattttaaatactttttcttgaaattacttcctttgaagtaaaattacgtttatagcctaaagtacattgtaaagcacattgatttcgctgtcctcaaaatgcttatactatgtatctgctcattgtattttattaatttttttaaattatcaactaattcaagaatgaatctttatcctaaaatagcatgcttatgctaagagtgtatgttgggtaaaggaaaacatactttgtaagcatcaaagtagtacaagacacagaagagtgagtgaaaaatgttaaatttctactaatatctaagttaagaagcaaatgtaaataaaattaagagaaaatattcatatatgcaaggtatatggcaataagagtgctaaaatgaaagaaccttacaattcttaaagaaaatgaagaaagaacaagctctggctgcccaagcatgaacttctgagttggatccacagaaccatgtaaaatgttggacacagtgcacatgcttgttatcccagcactggagaggaaaaaaaaaaaaaaaaaaataggtggttaggtgggtctccattcagttttagactactttgagagcctcaaccctcagtgatgtactctgtcacaaacaaacaagcaacaaaaaaaagttctaattttgaggaagctcgatttcattttatagatcttggttttaatgtcacagctgagaaatgtttgtttagctcaaagtagctatcataacttttacaggaatcctttgtagttgcagttctgaggttcattcttagttaatttttacatatggtttaaggcatagatcactagttgcttattactatcgtattattctatcatcattcattgatgatgatagctttcttcccaagaagttggttttatagtttttatgaaaatcaattgttagtatttatgtgggtctatttctggatgctttcatctaattcactgatctgtctctctttaagaaaatatgcaggtgtcttgataactgaaaaattcagtgtccttcaattgaggagaattagtcctcaggtttcattttgtatttttaatttttcttggttaatgcatatagtgtacatgcttatgattcttaaattttctaattgtgaaaagttcttgattttagttgtgattccttggaatctaggaattatgtgaaggaagattaaggcattgcatattaattacttttgaggggtttgaatcaactcaatgcttccttagtgaccatactatttatggttggcattgtttagagaacccaagatatcccagtaagtaaaaagcacaaaatcccatcctttgtggccttagcactgtagctgggtaagcagtgatggtagcttagtttccatttctgttcctgtgataaaaacttcctgatgaaagtgacttctgaaatatgcggtttgttttaattcatgtcagagcagggaaattggggcagcagaaacatgaagctgatggtcacacacacagccaagagtagacagagaaggaacacattcatgcttgctgctcagcccattcttctctttccattcagtctcgtacccacacagtccgtgaaatgctcctgcccacatccagggtgagttgtcctacctaccttgatgaacccagctaagcaaacccctccctggcatccccaacagccaacaaatccacacggttaccatcaagacttcttcccaggtgattaaaggatttgctgagttgacagttaggccaaacatcccaaatgggaatcagttattgacattataaataatagttatataatatactagaaggggtaaatttggtggtgaaaactagaacgagagaaggagctatgatgtcagtcatggatgcagattaaaaaggggtcttggggagacatgatgaagaaagtgacatttggacaaaaatttgatgaaagtagtatagttgccatggaaatatctggaagaaaaggtttcaaggtagaaggggagatgtgcgctcagtgtgcacagtaatatttgaaaaggaatgttacccttctttttatttagacagaaaagaggagataatttgggaggtccttctgtgtatatgtttgtcttattggatgataaataaagtactgttggccaatagggaagaaaattaggcgggactaggagtcgaggaggattctgggaaatatagtaaagagaagtcttgtgatccaggcaggaagtaacatagcaggcggactcagaatataatcaggacaaacaggaaatcacttgcttcctcctcctctcttctctgtggagtcatcatgtgatcccagcaagagaagacgcctgccactggtgtccttgataagataagtctttataaaatatatagattaatagttatggttgatacttaagatagagctagcaattaagaaatcctagtcattggccagcagcattgtacctaatataagtctctgtgtgttattttgggtgtccacatggcattggggcttgggcagcagacagaaagatttatcattacgataaaaggtttcaacacagaaggggagatgtgtgcacaggaatatttgaaaaggagaactctgtggctatggaggtgaggtgagagagaatagacacccttcaaaacacatccatcccttaagaactttggcttttgatggtcaatgaaggggtatacagtaatacagtagaaagagaaatccaagaaacacatgtggaaccaaagatgaataaagaatgataagggaacatttgctcccagctctcacagctggatgctaacagcaacctctctagaaagtttcaaatgaaatgattacaatacagacaagtgatgtagatgtccatatactaagagagatgccagcaaaaaatatctttttagatgcacctatgttttaaagagcaaaagtacaggggctggctgcaaggtggctagtaggtaaagtgcttactgcacatgcataggacaggagcttggtttgtcagttctgtattggctgggtgggtggcctgcctgcaatcccagcactggggagacaaaggcaggggatctctggagcaagctggctatccagatgatctgtaacagcagctcaaggtgcagctagggagggacactgtataagatggagatcgaggaagttacccatgtccctcttaggcctccacacacatgcacacacacctgcacactcaggtgtactcacatacatgcaaacacacaaacatacatgcaaagcatccttttatacatatgcaaaagaatataggtccaaattcaatgatgtatattacattaatatggaatacattatttacaaattatagccaattttactagtgcctttcacatgctgttatcacattaaataggactgctccacaaacagagaaaatggttcaggatagatgtttcctcagcacagtggtcctgctcattgaattcagacttgcaaggctgattgtgtgaagggatcaatgaggaatgagagctccatccgatgaactgatggaggcaaaggcatgtaaagatatgtcagtgacttactggggcaagacctggagtagtgtattgtgctcaggcaatgacaacagtctcagctgagagactgtggagttaggaagcaatcaaccatggagttaattcattttagaaaaatctgtgttttgctaacagaaaaaaaaaaatgacattatgttcaaaagtaggacatctaactgaaaatccaagactgtaatcatagaaaataatctcttggcatagcattctggaggtgacactgggttaataattatagttatgccattagtccatctgcatgcataagcagaaatgttttgtaagaagaatttaaattatgaaaagacctcaaattctaatgttacgccattatagctagttccccatacttctaataagcatgttatccactaagcaactatgcaacattttcatttcaagaacttcaagggcaataaataaaaaggtgcagatgtgtgttctggagctgctcatgaaatattaaattgggtggttttccatgtgaaatgtaatcagtatgatttccaagcattttggcattttacactttggtgttcaaatttacatctggcatatcctgattaacatgaaaactttgtaatttcacagttaaaaaaattcacggctatgtgtgagaagtctctgaaccaggtaatgtaattctctgaatctagtcaaggttgttattttttgtataccatgtgtgtcattagacacattttaaaagtaagctttctactcatgaaggaaaaagaataaaattcaaaacttagatgtggagagctgtttatggattggtttttattgctaatctatccacaaataaaacaactgtgctcagaaaaagcatctaaacagtgattcctcctcccatttaatgtctctctaactcaaagcccaaataaccacaaaataaaactataaatttaatatgaccataatgttaaaagtctctaaagctgagagtttctcttctgcccagaataccaacaggcttagtatgttggtattgttgtatatatgttgtctaatgataattaaatgtgtatttttctttcttgacattttaaattaggtcaagtcttataataaataaaaaagcatatattatggtcacacatcccataagatgagtggatcactttatattttaagctagtagaaaataattggaacattgacaaagctgagacagcctaagataccaaaaagaggagtgctaaaataacatatataacacagaaatgtcagagaaatacttctagtcttcttcagacatgctattcagtgtataaatgagagaaagtgctatctggtgggtatcagaggtaaactttcctaacaaacttgttattgcacaggaaactaaacattatgttcacttagattcttcagattctttgaaagttcaacttctatgcttttaagtcaaatatttctgccctaccttgcatcttttgaaaaatgaaactggaatagtttagccttttttgcctttagaggaatcaaaatcaatgttatcatagtgaagagtttgtttatttgtttgtcgtattttttttttttgagacagggtttctctgtgtaacagtgctggctatcctggaattacctctgtaaaccaagctggcttcaaactcacagagatctgcctgcctctgcctcccaaattctgggattaaaggcatgcaccaacactgcctgactactaaagaggttttaaagccattttctacttttcatttctgttgtcgtgataaaatactcaggaaaaaagcaacttaaaagagaaagggcttatttggcaggttacaattcatcactacaggaaaagtcatagtggcaggcgctggaggcaactagtcatattataaccgcagtcaagaatagagaaaaataaatgcatgcatgcttacatgtgctcaaacccatctttccttgcctagggaatggttccacccacagtgggttgtgtcttcccacatcaattaactagtacttaagacaatcccccatagacttgcccataggccaacctaattgaacatatacaaaaagtattcatagcctggagttcaagtttttgattcaatcaactatagataagaactacatcagatttaaatcaaccccccccacacactcctcaatgagtttctacaaatgtcagctggattgaacattatgctttatgctaaagtaaaaattggtttaatgtaaggctagagagatggctcagaagtaaatgcccttgctcctctatcagagagtcaggattcagttcccaacatccacatgtttgctcagaaccatccataagtccatttctagagatctattgaaccttttgtctttgtagtcaccaagacacatacatggcacacataattccatgaaggcaaacactgagacatataaagtaaaaataagtaagtttctttttaagaaatggttatcaagtcttcagagggttaatgtattgaagatgatgttccttgtcatggagtgacatagaaactggtctgagacagccattattacacagtggtgctcagtagaaatcaaggagaaaggcatccttacaagtataaggaattcaaactgaatcctaatgtgtctgaaaagaagttattggagttttaaaggtatgtaattttcatactaacttaaacatacattgagtaaactgggggcttttaaaaattatcatctgaccaaaggataaatatgttaaatttatttctagtaatagacaagattgaagaactaaaacaaaagttcattatcagataaaatagaagtttaccacattatcaatgagacaggtaacagagtagctgagactgaaacttataatagctatcaagaacaactttatgaatgaaaatcaactttatgaatgggcataggtcatatggtcaaacagattagataatgtggctcaaagtccctcattcaattaaaggtcatctaattttaaaatagtttcaaagattaaattgctagaaatgacaagtgataaaagtcttaatatggctgggcatggtggctaatgcctttaatcccagcattcaggaggcagaggcaggcagatctctgtgagtttggtttacaaaagctagttccaggacatcctccaaagccacagaggaacccggtctcgaaaaacaaaaaacaaaaaacaaaaaaaagttttaatatgaattttgataatattacttgccttattaaaacaaagaaatagatatcctgagctgcttctaattgttttattatctcttgtttaattctcctcaacataccactgggagatggtttctctataaggggtactattaaaacaacgtggtagaaaggttggatcgtataaattaacaagcaagaagataacagttgatcacatttaaaactttatatattgataagcacaggagttactcaaagtattcacatgggatatttaacaggggggggttattgcttataaaagctctgttagctacagttacagaacagtagttgcaagcatactgctaaattatctctaagaacagtttcaattaaaactgtattgtttggatatgccatttgtttttcctatgtattagttacttttctattcctgtgataaaatgccatgaccaagcaaaccttcagaagagagagtgtatttgtgattaggttaggattcacaacagcaatgacagcatgataacaggtggcagacatgacaagtggagttggaagctaaggactcacatggtttttgtttgttgtttgtttgtcttgttgttgttctctctctttgaggggtcttttttgagatagggtttctctatttagccctggatctcctggtactctttctgtataccaggttggcctcaaactcagaggtccctcagtctctccctccctagctccctagggctgggattaaagactaaagttgtatgcctaccacacccagaattaagactcattttgaaaagccaagcaggaaaagttaactaacaaggctgcaagcctttaagttctcaaaggctgctctcaatgtcatagttcttctagcaagacaactccttaactgcccaaacagtgccaccaactggggaccaagtgttcaagtaactgagattaaagaggacatcttattctaactatcataccctgtattttagttttatcatgtttattctgtatgtagaacatgttacatatgagtaaggaatctgatgtgaacataataggaatagtggaggaatgaccacaaagagacaaaagcagaaattccactagtacacaaaacttttccgtaccttaaccttattggttaaatgatgcatgtgataaattacacaacattatacatgcatacacacaccacatacatacacccacacatgcataatacacacatacacacaatcaaaacatatgtaatacacaacacaatatagcacacatacacacatacaatacacacagcatacacacaattgctgaaatagaaataaacttgcaacatgttatatggccagtttccagattgtactgtcatattataaattatgatcattggacaaagattgataaggagcacctgaattaattcctgtaattataatgaatctaccatttcatgttgacagaagtttctttcccacccagtcctgcagctatttagtcccaaataaacaaacagagacttatattaattataaactctttggcccattgctcaggctacatccagcatgtccattggccaagacagttttatccatcaaccaataaaagaaacatatattcacagcatacaaaaggacatctcccattatctcctcttctctatttaaataaaaaggaaagttttaattttaacataggaaaattatatataacaaaacagttatcaagcaagaactatagttaaaaacaatatttagtccactaacatttggcaaaattaaaagaaaatattctatcatctatcctttgtaattttaaagttttatatgtaacttatcttttatcataactaaagaaaaaccataactatatgtcttcaactctatcaaagacaccaggaagataatatagaaattctaaagttgacagagacatctgcctgcctggacagtcacccaaagttcctctgtaacttggggcatacttctttagcctataggcccagaatgtctagcaaactttttgatgaagcaggaaatttgaagatctatattggcaaagttcactagatgctttcttctataagcaggaactctgaaagaccaccctgtctcttggcaagttcagcagtactttactttgtaaactgcttgtccagtttgaacagtgtgcttactgtcaacaattgagacaagagcagttctttgcccaataagccagttttgccacattgaaggcaaaccccataatgagtttctttgatgcccatcttcctctctgatgtaattggtattgccaggagcaattgtgtctcattgttatgaacaaccctaataaaccattttaaatgccatattctgtgagtctttgaaaggtatttaagactacctattcatttgaaatatatctctgaatatctagaaaatccaaccaacataactataagttttgactattataggtgactatctacaatctgtatttaattatacattacattttcaaaaaagctgtacaaacacaatacctaaacaagagtaggaatatacatataacaaaattgaccttaaatttgtataaataaacccaaatgcaaagtattcatttctgtatcgtttccttttttgtttcagaagggaatgactgtgattattaaccatttataaccaacacagtttaaatgaaaacaaacatttacaaacaatatttggaaatgtgggcatagttctcttcaaaatgcttccttctgtttgaagacactgtcaatcttaaggggatcctgagaaaactaagaacccttcccaaatcctggctgtagtggtttgtgagactgcatggtctcagccatttttggatgctggattacctgggccactgtttcaggggatcttgcttgatcgaactgtattagtcctgaaggaatccacagcttttcaacttctgtggaaagaaaagcagaacctctttttcaaagtaacatgtccttaggcttaaattttgaagtcaagtcattttcaaaatacataggttggattaatccagcaaagcagttacaattcagtgtgttttagcagctgttactccttccttagcaatcaaaaaatttaaagacacatgatagcataaagtatccagactccctgtgtatttttcatctttacatggctttttaattattttatttcttttagttttatttgtttcatctcttgatacagggtttctctgtatctttggctgtcctggaactcattttgtacaccaggatggccttgaaatcatagccatctgtttgctctgcctcctaaatgctaggattaaaggcctacactaccacacccagctactctattttttaaaggacattttctttccttttttcttttctctccccagcctacatatatttttaaacacattgtatactgtttagagttttttttttcccctatgaatctgtgtttacctgtatctctatctttttctgaccacatgagtctttaatcttctaaacaggattgctgagattaaagtggaatttttggctgctggcttcattcagttaggctttccagcatggcaggaatatgtttacaatcagctctgggagctgtgttcaccacctcagctctggtctatgacaccatcaggcagcttgtagcacactgctacttttttgtctgtatgagtaaaagctaaatcttccttgcagcatgctgtatggcttggagacagcctctgtataccatagaaggaatccaccatgctgtggtcaaacccaactgccatagcatctctacaccatcgcctgcatgaaactgtgagactaggaaatcccagtgcagctctgtttctgtgtgttcagaaccctttttaagcttttgtcaggttttatgtggaaattcttgtcaaacctttgggcaccacatatagatggaaatttttttcctgcccaagtcccacagccatttagtcccaaataaacacacagagacttacattaattataaactgtttggctcaggaatattactaacaaactcttacaacttaagttaacccatattcttatctatatttagctacatgataccttttctcagtagtaaggcattttcatcttgcttcctcttcatttgaccggcagctgcgtatctctagagactcactctctgcatcctcttcccagctttctcctatttaggtagccctgcctatacttcctacctggctacattttgcctgtccattagccaaagcagctttatacatcaaccaataagagcaacatatattcacaggatacaaaaaaaaaaaaaaaaaccatcatcttcaaaataaaagatctttaaaaaaaggacttttatgataaaagtaatttggtcaggtgagaaaggaactttcagagacggtgggaacaatcaaggcaaagaggcaggtacatcaagacaaactgtattgagatatgcctactgtgataattttagcaataatgttctgatccattataaacacaatgttttaatttcacagtcaatcattcattagtgtgtgtgtcccacttgtagctaggacaccttgaaacgcaacagcagtgtcagaatctgctcttgagatgttggacagtgatggaaactaacctcttcctgaagaacctcttcaactcatacatgatttacagattgaaatattgtactcatcatggatcagaatattattgttgaaattgtcccagtaggcatctacctagaagacttgactcccaatgtagtttgtctgtttcaacatacattttgtctaacttctgtcttgcttttttgactcttgatttttttcaacaatataataaggaagacacttaaagagctattgagtaattaaagaacagcttgtgtctagcagcaagaaagtatttgttaaaaataacttcataaacaaaaaaattcctaaatgaaaatgctatatgagtgaatcaaagtgaatttttttacattgaaaatatcagtttactactaaaataaaagtaaaaataggcattaaatttaataaatgaaacagttccaagaaatgtaagatttacttgaactttaacaaaaaagaaatatccaattcaacaatacagtaatttaggagagtgaaaagtaataattttagagtcaatttgtaataatcagtttgttaattaatatatttggaggtttttaatgttattcatttggcaacaacttttctcactatactatggctgcagtactgtaaatctcccttgatagtgaatattcaacttgaagtaactatagtgacagccaatatatggatgtttctcaaataccacatttacaaaatagttcagagaaaagaaaaatacaaccatcactcatgttgagagtaatttttaaaatataattagcaattggttgtagtataaaatgttaagtaaataagaaagtaaaatataaataacatgaaaaaatcaattatccttctcttgaacaatcaatagttctattgcatagatctggaatacaaatccattagttataatctgacttaaagggagattccttgaaacatataggattttaattatatcctccaaataaggataatggccaaaggggcttaagagcaaatatgaggaccacgagtctttgatgtaatgcaaaaaaccttcacgcactgaattgaaaatttatttgaaatccctttacgttaagtttccatgttccccaaattctttcaaagtaaaccgttgtttcacagtaacaatcattctaacctaagctgcctctctgttgtgattatacaagtagtcaagcccacacttcacatatctgcttataaactgggctcataacacaaatctttaattgggtcttgggaccaagtctgaaatcaagaaactctagctattttaaaatattaattccaaccattttgtttatattaattggcttggagtcagtagaaagcgtagaaataaatataaaaatatgaaaacaagtgagaatagtactagtaactatagtaagcttagcaacacattggcaaactcacttttcctttgttttgtcatgtaaacatttggaaaacatgaaaagaaaaactaatttagaatcagggctcgagagatggctcttacagaacactcacgttgtgtccatgttgtatacaggatgactcacaactgtctgtaactccacctctagatctggagctcctctttggaatccatgaatacctgcacacaattggcatacaattacacaaatatacatgcattcacataataattttttaatcttaaaaaataagcaatacaattaggctatggatttccttttaaatatataggacaattagctcaggttatcgaagtatgcctcatttgaaatagaatctgaaatacaatgtctaaaatttttgtctaatttgaggcttaagagagtactcatattttgttattcttacaagaatttacaaattttgttgtaatttaaatatagaagatttttcctactatctcctctttcgtgaggtcatgtggaacctacccaattagaggcattgtttcaaggggttataaaacatttaaggggtggggcctaacagaagaaagtggatcacaaaggtaaggtgtgtagtcttgggctttatagtcatgcccctgtgagtcccagctttctgcttctttgtccactgaaatgtaactaccacaaacccagacctgccatcacccaattcctaccatatgtattttctcatactctgagtcctcaagttggtcttgtttgtactccctcagcctagacacacaagggagggcctaggccctataccaaagaatatgatagactctgaaaaaccccccattaaaggccttactctccctgggaagcagaaatgatgtgggataggttgggtgttagtggggggcaggggaggaggagaggcagaggcaactgggattgacatgtaaaataatcttgtttctaatttaaataaaaatggagaggaaaaaaaagaatcttattcaaaatcattcccaaagaaaaaaacttgcctgggtcaaacaagtcgacaggaagtactaacctcaaaagtgtggaaggcattgctaaaagtttagctggaagaaaagggcatatacaactgtattagattaatgttatcttcaaataagtaatgagaaaacaatgaagttgattttctatctaatgctgtttgggaaaccatggcaatgttaggtattcccagcagaagcaaattcatctcaatcattcagctcaaatctgtccttataaagtagttgagaatttctttcattcaagcaagaattttattcatttcagaattataggggctatgtgttaaaataaaaataatatcaacacatcagtaggtggctgatatctatcatagctccctccagtgacttcactatgagaacacactcgtcactcaaactcttggggactcactcatcacatctcacattcaggattaataccttgccagcctgaggccatgaagcaagacaggattgatgccaatctcttcaaagttttgggtcaataatctgtcataatcattttctctttctttgattacccacctcacaccttgactgtatcaatcctcaggcagtctggtatggaaagaaatctgcagaatnnnnnnnnnnnnnnnnnnnnnnnnnnnnnnnnnnnnnnnnnnnnnnnnnnnnnnngactcacaaacactgaattttcttggaaaataatagttgacttgaagtcccatgtgaagatgaaattaaagtgattttcagtaacatagtggaagtcattcattctctgaaaaagaaaaattaaataactggggttcctgtaatattcaaagatcaagaaaagtattacctaaaattctgtagacattcttgatctataaaggtaataaaggtaatatctccccctctctgtgtgtatgtacagatgaactgaatcatgtcatggcatttatgaaaaggtgatatttcactatgattctgtgttctaatcatgtatgccacattccaattttttacagcacagagccatattcttggaccgcatacaactaggctttacagctagaaaacactggatgtcattagttggcttgagtgcttgagttcatatttcattgccttcacattctaccatatagagcaattttgtgtggctaaagatgaattttatggtgtttttctaaaactcctaattataaggtagtgtgcaatgactgcttaaagttatagctccagcatttgatttattttacaattctttcctcactgttctttactaaatagacattctttgtgttttattagagatttctcccattgcatcatgctctcagtgggatggctgctggtgttttattttacttctgccattaattacctgtggctcagtatcatgtctcttacagacccatttatcataatagtgcccgccggtgtccctgcagtgagcagcctgtcagactttccattggaaaccccacttctcaagggctttagcgtctgctgtaaaactgtgctttaatacatacatgttgaaagtgcatggaatgatctatggctctctttacttttagccacaaaaagacatatttgggaaaacaattacttcaaaattgatgtgcatgaacattgtggtagagaaccttgtgtgaaaacaatgtagcttaaaaatatttattgttctgtgttttttttttcatgaaaacatgcttctttgcagtagataggtaaccataaatagaaatacacatattttcatggatgttctctattttaatttcacaaaaatgtgcacgattgctacatttcttgggaactttgaataagagaaattgaagcatccagtcacaaatggcacgtcgttaacacattcctcaccttaatgcttcagggatgtatgcagaagaggaggccaaaagactttaagaaccaaatgtggcataaggactccagggaaatagtgtcttccagacaaaacaggaatgatacacatatgaaatcacatatggaaaaacgaaagatccaggatggccaaaacaaccctatacagtagagaaatgtctggaggcatcaccatccctgacttcaagctctattatagagctgtagtactgaaaacagcctggtattgacacaaaaatagacaggtagatcaatggaatctaactgaaaaccctgatattaacccacacacctatgaacaccagatttttgacaaagaagctaaaattatacattggaaaaatgaaagcatcttcaacaaatggtgctggcataactagatgctgatatgtagaagactgcagatagatccatatctatcaccatgcacaaaacttaagtctaagtggatcaaagatttcaacataaattcacccacactgaacctcttagaagagaaagtgagaggtacccttgaaagaattgatataggagaccgcttcctgaatataacaccagtagcacagacactgagattgacaattaataaatgggacctcctgaaactgagaagcttctgtaagccaaaggacaccgtcaacaagacaaaatggcagcccacagaatgggaaaagagcttcagcaaccccacatcggacagaggactgatctccaaaatatacaaagaactcaagaagctagtctccaaaacaccaaaaaatcaaattaaaaagagggatactgacctaaatagagaattctcaatagaggaatataaaatggctgaaagacacttaagaaagtgctcgacatccttagccatcagggaaaccacaactcaaaaacaattctgagataccatcttgctcctgtcagaatgactaaaataaaaaataccaatgacaatttttgctggagaggatgtagagaaaggggaacactcctccactgctgatgggagtgcaaacttgtacagcctctttggaaatcagtattgtgattactcaggaatatgggaatcattctacctcaaattccagcaattccactcttaggcatatatccaaaggatgcacattcatacaacaaggacatctgttcaactatgttcatagcagcattatttgtaatagccagaacctggaagcaacttggatgcccctcagctaaagaatggataaagaaaatgtggtatatttatacaattgattactactactcagtagaaaaaacaatggaatcttgaaatttgcaggaaaatggatggaaatagaagaaaccatcctgagtgaggtaaccagtcacaaaaatacaacatggtatgaagttactcattatggctattagatatatagcaaacgattatcagaatacaatccacactgcttcagtagctaggaaacaaggaggaccccaagagagacattcaggttcccctggagaaggggaaatggacaagatctcctgagcaaattgggagcatggggggaggggtgaagcatttaggagaaagagaaggggagaaggggagggaaaaggaggcaatgagtgagaatgatgattgagtcaggagaataggggagagaaagaaaagagatactataatagggggagccattataggtttaaagagaaatctggcactagggaaatatccagagatctacaaggataaccccaaccaagaatctaagcaatagtggagaggctacctgaaatgcccttcccctataatgagattgatatctaccttatatgccatcctagtgccttcatccagtagctgttggaagcagaagcagacacccacagctaagtactgagcggaactcctggaatccagatgcagagaggaatggtgagcaaaggggtcaagaccaggctggagaaacccacagaaacagctgaccttaacaaaggggagttcatggatcccagactgctagctacctacccagacctcaagaatatgggtgtcagttaggaggcctacgtaatctatggggcctctggtagtggatcagtaattatccctagtatttgaatagactttgggagcccattccatatagagggatactctctcagcctagacacatggggaagagcctaagtcctgctgcaaatgatgtgagaaatttgaagatccccatggaaggcctcaccttccctggggagcagaaaagggatgggatagggggttggtggggagcaggggaagatagaagggggagggaactgggattgacatgtaaaagaagattgtttctaatttaaataaataaaaaagtgaaaaaataaacagaataaagaatgttcttcaaaccaatctacttattgatgcttgattagctagtattaaaacagagaaggaaggtatgacttccataatgctcagttcagagcgatgactttctcagcatgactttgccagccatggattttgtctccaggcaaagaaaggaacagaaaacagtcaagagagatcttcgttcactgaattccagaaagagatatacctctcctccaaaaaaatccttgggctggggaacattacaggtctttcctgtttgctgaaaggtgttcacataaggttttgtgatgcttaacccataaatcttagggcacgaccaaggagaatgattgtctgtttccatgactcagaaatctgaacctatggtactgatttgggccaaataatacttttcatcacctgtgtcttggtttcattcatttgaatgtgcagaagattaaggttatcattgtggtcagtggtattagtggaaataaagaaaggatagatgctggacttgcagattatagtgaaacactaacctagagttggtgtgattgtcttcattctctcccttggtagttacagcacagcacagctcaagtttatgtgaaagcaaagtgcagcctatgaggcatttggacataaaagaatcaaggattagcttccatatgtaaattttttatattatatctgtaaacaatagccatttttctctttattgttttattttcctcctaggggcatctgctttcttatttattctcactacaaaaacaaagatagcatcacaagaataacaattccccattctgaaaaattaaatggcatgtcaagaaatttaacacagtatcaatactcaaaatattagccagaacattctgctctactaaaaataagtcatataacaaaaatattgttaaattttaacaccatacaaatgtctagcagaataaaccttgcttcagtacatttgtttttctatagatgtaaaactaaaattgtttaaattattctccttttgtaacttaatgtatacatttcttatgtgctctttattgatattgtaagaccctcagaaagctgaggcttccagaatcttagtccaggacggcggccaccccaaacacagaatggaggcgaaagcttgatgcaaactgcatgaggctttattgtagtttaacaagctaaccccatgttagctcgggtctttcacccacccgctatggcggatggctagaaaagacggcttgaagctgctgcgcatagatctttatagggcagcgtaaggggagtgtctaggggtacgcactggctcacgattggtgtgcctccaggcttggagggcttgccctgtgttgattggtcaactggttgttatggcccataggccctcccagagtggttgctatgctctctacgtcattgctgtgcgctagtccgtaaagcacacccagggtcgtaaagcatagcaccaccagctaacctctgattggctccctgtcacgaggcaggcatctgactttctagtgtctaggtcaaggtcatagaagcacatgttcggctgttatggctgccaaaagggaagctggttccttcaatataacatctatgctatttgagaatttttatccttcacatcaattctgtagactgtttctaaaaatggctgcctggcagtaactgcttatcagcagttagcaactatgtgcttgtaaccaagaacaaaaccatcagatcatttcatatggagaatcattctgtttttcttcaaatacccatctgccagcaattagttaacatgagaaaacatattatagcagattacatctgtgtgtctacttaaatttgataaggactaactacatatcttttattatttgttgaatctaatcagaggtagcaccaatggtaggattgctcatcaattgtctcaaatgcaaccagttgaattctgataagcaaaacttcattaaaccaatcagtataattactctttacatttgtaatcaaactcagtaatatttacaatacatatatttatttatgtcaatcttttattacaaatctaccaagatttaaatggtgcatgacttaagaaaacaaataccaattctttttttaggtgaaatagcacaaattttagcagaagtttcctgagggtctgaggactccctcccttcccttttcagtcctagctccatcacagtgagaaccaacttaacccacccaggaaatgctgtggccttcttgaatcaaactggagctccttttgttatgcaaacaccatagccataaatacctcatgcacatgacttgttttttaattaggtaaaccttacatcaagactcctttctctatgtgactataaagacttctatcttacctataaatttttaaccagttatatcttcttaataatccccagtaactagttaactgaatcatttatttacattcactcaacttgcaaaaataaagtttttaacagttttaaaaactatactttgagaacagattaaggtggaagaaacaatgtttctgttgtccacgcgacatttctggtgatgaagacgaaggtatgtcttggtcttatgtcttaatattttgaaattatttttgaggttatgctttatgtaagcatataaatgatgcccaggaatgagtgtgaagcaaacacagtatctgcaattcttaggataaattatctgatttcattaagcaagaaaattgtctgtaagagcagattttcgtattctctttacaaagagtcctcaaatgaaaagtgttgataggtcttgctgttaggagagtcaagctggtggaagccttctactggaaacattaaatatttaaatatcttatttattttggagtgtatagtgaaagatcccagtcatcattcgaaatacttaaaaatttaaacaatttattgttttgctccttacaatttaaatttggaaaagtcttaaccttcctcttatttaatgacaaaggccatccactggaagcaagcttattatctagaaaggaacaatacaaagaaaggagaaatcagattccatttctaacactgactgaaactcatctcttcctttgggcatgcagagaactgaaaagtagaataaactttgattttatgcatttcctgagcaatacaaagaagaaaattagaggttcattttgatggcatttttctgtgttattttaagaattctgccaaaacctccggctgtcaccttcaatgacaactaatggcattgaaagaagttgcacattccagaagccatttgactaatgattatctggtgaaactgaaaccttaaaaagagagcattccacaggaccactggctttcttaattctagaatgtagagataaagtggccattatctgtagtttatgtaaatcatgtgtgtttttatcttctggttgttttataggaaagtagtctaaaaagtaaatttaagggcttcagagaaatcgaagcatatccactgttctggcatcctttatgcctgattacccttcagtcatgtattaactccccgagtatctgcaccctttaatccagtataataaatcatgaaatgatttttctgtgagagacaaagggggaattacttgaaatgctagcacactactgaagtggaggggaaggctgatgcaattatctagatagtctatttattccttctccattcctctgtatatgaggaagggaattattattccacacagttactgtcagaactgcatcaggagagagattagaaaatactgatttataacaagaattacaggtagcttaaggaaatcatataaaatgactttaaggatttcttatattttctctatttttaactcatctctagtcctttatgtctattgttttgaatcatataacaattagtatcatattaggatttttactatttatctgtccccaagcatataactttgcattcagttgttgtatcatctttgaagcaggagaattctaatatgtgggcatataaatcattgtgttgcatgataaatgtgccatagaacattaggtctcatgtccagggagggaaatgaatagctgtgctcttagagcacacagtgagagctgggagtccttagctagttcttatcttttcaatgtgagtaaacttcacctacttcccctgaaacacatgaactcaattattaaacatttcattaatttctttccgtaaacaagccaagtagaaactattacagattggaatccatgcaacagagtggcacacaaatctgctgaaatgcacatccctttttattctcatcattgatgggtccttttatttcaggctattagcttttaggtgcagaataattttttagcagagcagtgccatattgtcaatctggccaatttcgattgaaaaaagtattttgtattgttcttcatgtaatctacagaaagagacaggcagagtggaacaggtgcagggattcatacaataaacacatgcgtattttctctgcatactaattaccagccaaattgctagcaagtaaaaacatagatgagcaaaggggtgatacacttgaggaatattccagagattacagtgtttaagcccagtaggtaggcagaaagtagtagtcaagtgtatttgctacactcaggcaaagcagtaacttgtgagcagtttggttccaggcaaatcacattaacagatgactatcttctgatcctattttataaaaccactggatttgaggcatagatctatagcccaaaggagacaaacttttcctcagaaagctgagggagacttaaaacatgctggttaaggtgtactgtagctagtcaactcatactattcataagtctgcaactaggggtttggagaaacacctccgctctctgtgcaagcatggtgtgagggtctcagttcagatcccaatacccaagtttaagaaacaaacaaaaaggctggttgtagtcacatgttgggaaaaaaaaaaaaaaaacgggaacttataggagttgctgaccaccaaattagctgcaagtggagttagagactcactctgcaaagaataaagaagacagagaaagagcaggagagtaggccttcacatgtgtgtgcacagcctcagatctacatgcagacacatagttacgcactatacacatacacactcacacacaggcttatgcacacaaaagaatcactacacatggaataattacagttaaataagaaatagtgtatatttcaattttactatatatatgcaaatcccagagtttccaactttgaccagtagcagctacataaaatctttattaaatgctttattctaaaataaaccttggtaactcaacataaaaaataacagttccctactaataaaagcatgataaaataaaagtataacagtagccaaaaataccattcatcaatgttatttttatataattgattgtaggtttcaagttagatagaaaaaagagtccagtgcctgtatctgaattttactggcagacaccaagaagcattatattgttattttctggtatatgtgaagaaggagatctcaagcatataagtgactgaatttaggataaatgaactttagacatcattgagtccaatcctcttaaattgcaccaaatgtttaaattggcaaaaacatagggcatttaaacatctaagtaattttagcagcatcagcattgaaaacaaagaaaagaaatccttccatattttaaaacaaaactgcatttggcaagtcattttggtctgatagcaaatgtgttgaacatatttcctgttgatcagtaaagatgactttgcagtacctataatctgcatgacaggaataatgaatcacctcatttgcataggaacgaagctatacttaaagggtttgcaaacaagactgaatgttgccaaaccttatagatgaggacagaggaatgaagaacaaaggggtgcttgttaaccctaaaacagctgagcaagtctctactcatggctctgacttgtatcaaaacttcctaaatcttgtggtgggagtagtggcaccaggaaaggaaattcagagaatgctgaattaaaataaggaacagaaatcatggagattaatgtaggagaaaaggagattaaaacagcttcagttcttcaaaaagtatctaagatgtagaaaacttaccaaccattaagtaccagtggtaagaggcactagaagggtgggttctagaattcctttagctgtattctattgaggcaggcattgtaatctggacatgtgagtttaattcttttgaggacactacacgtgaaatgcatgtttatgatatgtagttgacctttctattccagtattcacagatctcccaagtagccatttctgaagaacagaaatgttctggtgccaggccacatgggtccagtgctggttcttcagctctctgactacacatccttgactgcagaaaaggctgatggtaaggtggcaagttaacatctcagcattcagcaacctgcatgagtaagattacagccttcagctgttaataatgtttctaatctttccagcagagggagtgataatcctatgaaaaccggattcttcagggcccaactgttcactgttgacaagccacacaatagtggtagaattttgataataactggctcaaattttatattctttagaaccacttgacagactacaaaaaccaaggtgttcaagcagctcccccaatctcttcaagtaaagtgaggttaaactcatgttcctgttccttataggttttgaaaatatgcctttcatggtaccaggatacaccacaaagttagttttcacttattgcattgaggaacgatgacatactaggactcattgttgatctatctctttttttcatcagtgaagtcccaagtatggtcagattggcctcagcgagtagaaatgaaagcatgacttctacccttgatctcatggccactgtgttaatgtgctcacagccaccaagcaaatcattctatctccaattctggggccattctttggtgtgaattcacctaggactccaatatctcctgattcatttaatacctgaaaatattagctgcagcctataaatttctataaatcaatagtcttttataaaaaaatctctcatttcaaaattaatgtaaaactatacctatatctgactatgcctactgagagatttctttttgcaagtttcccccaggacatgacagagtgaggctgcagtactgtagccataaccacccatattgaagaagtccctacattttcattcctcaggcagttgagtacactggctatcccatgagtccccaggttgaggttgagaaagagaagacatgtctgatgcagaagtgacaaatgtttgatcaatgttcttatctaactgatttgtgccttcaggacatgtgccacttgatatttagtactggtgcttgggtctcagtatggtatgatgctaccgtaaactgttcttcaaaatgttcaggtcacatgacctcatggcaggacatagtaaggtggtttctactaagatctagtagcaagccaaaagctgttctctaaagaggattaaaaccttttacaaaggaaggtgtaaagccaggcatcatgatagaaccatttaacctcaaaatttaggaaccataagcagggttatatctgagttccaggtcagcctggtgtacattgcaagttctaggccagccagagatacactgtgggacttatctcagaaacaaacaaaaagaaaatcttagagacagactttgttctaatatctaaagtactgtgttattacctttgggttctgtgaaggtttcaaatagttaaataatttccctctatgtctttaacatttctaccaccaccagatttcttccatcccatggtcacagtgacaaatggcatcataactggatattttgtgaagtgtcctattgttctcaggcatcaattaagctcttagccataagcaatgggtcagaaaagcatactatgagatacacactgctttcaaagttcaaagctgtcagagatattgtttctttttctttgtggttgaatagatcctattcaagtaacttgaccttcacctcaaaaggcatatcccagaatagcccataccactggatagccataaatttgactaagtgagaaagccacattattcttgtggatttatttctcatcatctgtcatgttcctcaccaaagcatctagtggatatgtcctatatagtgaagccaaacaagtttatacaatcaatgtaatagaaaagagagttgttctgtagaataaaagcatggtcaaaggctctaagattagggctgggtgagtagttcaatgatggatcactttcctagcatacatgaagagccctgagttcagtccctgtgctgattagttttatgtcaacacaagctagagttatctgaaaacaggtaactttaattgaaaaatacttccgtaagaaccagcaccacctccataagagccagcaccaccttgggttagggatcctcagttctataagaaaacaggttgagcaagccaataccagataccctccactgcctctgcatcagttcctgcctacagtttcaagccctgctgagttcctgtcttgacttcctttggtaatggactatgatatagacatgttaaccaaataatataataaccaaataaccaaataaccaaatatgcacacactcatacacatatacacacacacacacactgaactcctccctgccttgcttttggtcatagtgtttcaccacagcaataggaaccctaagtgagacagtccccaaatgcacataaagtgggtatagctgtgcatagctgtaacctagcactgcatagctgtaacctagcactaaaaatagaggcaggaggatcagaagttcaaggtcatctttgtctacatgataagtttcataccaacctagggtacgtgtaagagtgtctcagaaaaaaaatatttatagagaccaaaaagaaaatggtgctgaagaaatgactcagcccataaagtaatatcccaagaacaaaacccaacatccacataaaaactggaggcatgtctataatcccagaataggggtaggagaaacaagaggatccctgaggctatatggtcagtcagtatagcacaattagtgagctctgggtttagattaaaaaccttgtctgaaaaaataagatggagaaaattagaggaagacaccagacatcaatccttggactcttcatgtgtatataagcatgtccatgcaaatatgcacacactcatacatatatatatatacacacacactgaactctgtggttactacttgagagtaggagttgatagattcataaagtagatacaaagcatattatttgctttttcagctaaaattacactgcttcttgtggcttttatgcaggtcagtagccatatcccagggagcacaaacatatttgatgagatgccatctcaaacttcagtctccatctctttcaatttatagtaattcactgttattctcctagaccactatttctcggcatatgccaaattagccaatcctgcatagatgcggtgggaagcaaatacctacatctaagaaacactgttagattttacgagtgcattgcctgcatgtatgtttgtacattacatgcatatagtgctgacagaggtcagaagatgtgtgatgccctggagctggtgttgtggatggttatgaggcacatgccaatgatggaaacccaacctgggatttgcaggagcatcaagtgctcttagccactaagtcatctcccccgccctccatctttgaagtttcaccaatcagcaaccctcacagcaatatagaacactcctgctgcaaccctctcagcaatatagaccattcccacttcatggtcagtcagtgagtaaaaaaccctctgggtccactgtgtgggaacctaagccaacatctagagatcacatgatgtgcaccaggccatctctaaacaaaaaccacagtgacattttgaatatctaaaaagtagtgtgatctcagacccagttgcctaaaatcccacaagtgtgggaaaagtttgacttccgggtactggtctcattcaggagagctgggcatgccatcttccctcaagaagccgcagcctccccttcagtcaggggtataaggtagttcaagtgtgggaaacaatgacttcatttccatgtctcaagttccctgggtagaaattcctactcagatgcaacaagaaccaccatgtcagtcattagcagtgagctgattctccccattcacagtagcctttctccttgtgtggcttctcataaagccacatgagcacccacttagcaaatactgaacctgctctcccaggggcatctcaggctggttccctgagctgtgcccatggtactcttgtcaactgctcaactcacaaacttctgggatctacacatttctctttaaaaattccttctttaataaacatcatttatactttcatgataaatttactgcccaaggcattgttcctgcttgctgaacagtgcttttctggcatatgtatcttctctgtaaggcacaccacaaccacattgtgtccattcccagcacaggacattaataccataattcggggctgctttgaacactgaatccagtcatgagcacaaaaggcagaaaatgtgtcactatgtaaagtgtgaaacataagtatgcttgtaatataacagctgggataaaaaggactattacctcgtaagacagcagctgtaaatattttcttttagtttgtttcttgctattctgtacaattgcatatccataaaaggtgtcaaaggtaccgaacaatttcatttgggggttaaaagtaagttttatgatatgtaaattcttaaatatggagcgtattactaacaagagttgattgtattctagttcatgaaacagtgagtctaattatccaggacaaaaagttctatggtcacaatattgtgacaatagttttggctctgctgttctttacaataagtgtagtaagccatcatagcatctccaaggacatattttccagggctgcgtgatgcctatcattggtagtctcaacacttggggctgtaaatgatacctatatttacagctgcagtcttataaggtaatattctttcttattccagctttattactgatgtgatgctattctgagctccatgctgagactgttaaattcatattttcagtcaacggttttctttgtttctttttgtttggtttggtattggttggttgtaccttttggttttcatagtgctgtgggtagaacacacagccttgagcattgtaagcaaacatccaaccattgggcagcaccccatcctcagcacaagttttgatgctagcaaatacttggttacccagagctgtgtatctatgggtaaatgactatgagtgtctacagatggtcatttatattaatgcttccactttatctgacatggcctcttcttctaatccaatactgaaaacagtattatttatggcatttacatttagtcaaaccaaagacataatttcagaataaaaagcagaaataaaaagcaattatttagattctgttcttgagccatttctgttaccaaattgataccaaggttgtattagagaagcaggtgccatgcacagcatgaagcaaggccccagcagcactggtaactaccagatggccctgctccacccccaatatctaaatcaccagaaagaaactctcttgacctcacccaacttgaaacatacttggcagttttaagaacattgtttatccctgtcaaatttggtatattacatagccatcacagtatcattaaaactctgctctgaatggagcaatattcagaccagagtaagattgctgggaatactgaaaatacatgagaatgaggcaagctggttaaatttaaaggactaggcaggttttaaaatagggctcctgaaacggtgagagcccaaagaagatacttctgtctctaactcaaatagtctccactccaactccatctaatctgagaaaggagttatgtctattatcaaatgtgagtgtcaattaaaatggtctgattaaatacgaatattttctcatctgcatctgccagttctccctcagaaagccacatttttctccttagaatatcagtatgtctagacatcaaatacatttattattcacctgagttttgggttatttcgggtaaagggatgacactgtatgtttttcaacctccagaagttctgtaacacaattaggacacaacatgctctcatcttatggagagggccactgcatttgtggcctccaagacaggccattagcatgatgcaatgttttccacactatcaggtaatcttatgctcatagcagtgattttactagggaaagattcctacagacaggaaaaaatcaagttaaagtacttagtccatagagcccttagatctgggtcataagagatctgacaatagataaagaaacaaaggccttgccaaatagcatttctgagcatagtgtcttgacccattttccatttttgctaatgtagtggcaagagaggccgtgggatcagcatggatacttaagacattaggacgtaaatggtattatctgcaaagttacagaaccaaaaacaatttagacatactacttagaaagtcttctatctatgggaaccaaaagagtacaacacaaatctggtttaatatctgtaaggagtgaacattactgaaggaaagataaaacaaatttgacattccaagagagaactgtaacaaatgagaacttactggacatgtttttgtcagagcactttatcaaacttaaccattgatagtgggcatgatattctgtcctatacagttagtcagcattgtagcacgaattctagttggtaacaagaaaaacccagagacagatattggagttaaagctgaagatctgagaagcaaagcggctatccactatagagttctcacctctaccaatactcagacagaaggctgatcttgtactcagactgcatcaccaaaggtactacacctcagactgcaatgttctccaccaaagctcagactgccttctgctcttgtctcctcctaccttatatttctctctaatgctgggattaagggtgtgtcatccccttagctctgttactcttttagactgattaaccctcatgtagcccagggtggccttgaactcacagaaacccatctgcctctgtctcccaagtgctgggatttaaagtatctcccccactgcctgtcctctatggctaacaaatggcttaggtgtgtggctaactagtggcttagctctgcactctgatcttcaggcaaagctttattagatcataaacaaaatatcaccaaacggcttcatgcttagacaccaaaaaacaatgccagtttgcagggctgcttttggagctacttaaagaatgagttataagcctcatgactactttccattatgtatttcacctgcagttgagcaggaaaaatttaaaaaaaataaaaataaaaggtaccaccaagagaggaatggctggatcttgaggtagactgattaccatttttccgagttataattatgttcatagcaggattgtttgtcatagccagaacctggaagcaacctagatgcccctcaactgaagaatggattgaaaaaatgtggtacatgtatacaatggagtactactcagcagaaaaaagcaatggaatcttgaaattcacaggcaaattgatggaactagaagaaaccatcctgagtgaggtaacccagtcacaaaaagacaaacatggtatatactcactcatatatgaattttagacatagagtaaaggattaccagcctataattctcttcaccaaagaaactagggaacatgaaggactctaagggataaatggtccccaggaatgggaagtggaatgaactcctgagctaattgggagcatgagggtaggggaaagggagctgccacaataagagcaagagaagaggagtagaggagaggaaatggaggaatagaaatattgagttaggggaataagagaggagagagagcaggatgagagataccatatcagagggagccactataggtccgagaagagatctggaaccagggagatctccagagacctacaaggatgacacgatctgacaatccaggcaatggtggagaggataacctaaaagcccttcccctaaaatgagattgatgatttctctttatgccatcctagagccctcatccagtggcggatggaagcagagacagacatccacagatatccattgagctgaaatcgggaatttagttgaagagagggaggaatgaagagcaaaggggtctgtaccaggttggagaaacccacaggaacaattggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgagggccctaccctgcctggggagtggtgggtggatggggtggaggaggtaggttgggggttggggaagaaggatgggagtgaggggagggagaggaagaagggacttacatgtgaaacaagcttgttccctaacttgaactaataaataaaacaaacaaacaaacaaaaaaccaaagctaccaccaaatttagagccagtcattccaactatccagatacatcaccttgatccatgactacaaaatagtttttatggctttcatactcatgaaagtgatttgagaagcaaagatactggtttggggctgcttgtcaatacccttcttcaaactcatcaacaagatttaaaagagtcgttcccatccaagctggccttccctttcatcacattagagcacctagttaaacagcaaggacttgtaagggaacattcagcaatctgttccacacacatttcttttgcagccaaattacacctgtaaagacaaagcagaaactctttggtttccaaacagacaagcgctgaatgttttatggtttatgcaatagctactgtgtgttgctgttttttaattagcatatatatggatccctttcttccatcacatgtaattgtggtggtggtaactcaaggaaagtatcctgagcatttacattgtggggcattgtgatgatttatgtcttgggaatgggacatactgtgctttacatctgctcccaagttatccctgtacttcataatcccattgcttttaagaactagaaacactgtgagttttggagcttggcttttgttgttgttattagtgtttttaccacactaggaatttctttcttttaagtgctctgttccccactatgaaactcaaatcaattctactgaatggtagcaattttctcctaaaatctgtccttacaataatgaattgtccacttaatccactcctgcaaatccattgggtgtttattgctgaaaacaacaaacaatatttcctctcatttggtcagtaactaggcttgcactctgcctcttaaaatgtctcatgaatagttaagggtgacagtctttattagagaaactaaacacacatttgatgagtaacctgtataatttctccatgctacaatattttggcaaaccacaaggttcaactgaacgaagtcatcatgcagataatgtccttaccttctgaagatgctctctgtcttacttagggtttctattgcatccaagattgagcaaagtaatataaaaaaagtaataccaagaattactcaaggcagccaggagttggtggcacacgccattaatcctagcacttgggcggcagaggcaggcagatctctgtgagttcaaggtcagcctggtctacagatcgagttccaggacaacctccaaagcaatacagagaaaccctgtctggggggtgcggggaaataattactcacaggctggagagatggctcagccattaaagcctaggctcataaccaaaaaaataagaattactcacattcacaaaaataaatgtttaaatttatcaagactgttaaaaaagagttttgtatgtgtgtgttcagtcaattaccccatctcattttcttatctcatttaaactaatgggggaaatgattactgtcttttcacagatttgtaaattggggaattgtgggcaccctgtgagctgatctttgaaaggggtgctgatgtaatgtgtgcattaatgctacaacttctgaggcagaagagaggggaggcttcagtgtttacgtctctgacctcttcagaaagtgttcaaaagtgttcctctccagtgttactgctgttgttactcacaagtatatccttgactctatctctccagtctgcaatgaaaaccaaggagcagaggtagcaaacaaaaagttactaggtaatctggtgaacagttcagggccaactatgctcccatcctgtctttcatgtattaatgcatccaaatgcattgaacaggataacttctctttcttttcttctgctctggttgtgcctacaagcaatgacagagtccaaggtacagccagatccacatgtccacttcctttcccagagaaagccatcatcccatgtgcttgtgaaagtccatacccttgggacttgcttcttagtcacaaaatgattaagaatgtagaaagaagtacacagtccaggtcatttgctactaaactacaaaggttaattagttattttatactaattagatattagtcatactaattaggtaattattatttccaccttcagtagttgttagtgttcatggcaaaaatcttttaatatgaaatgaaaatctcagttttaccaaaatggtatgctgataatttagtatttaatacaatggtttttgtttgtatgtttattgggacaggatgatacatttcccagactggcctcaaatttactatgtaaattgaggttgatcttaaacttctggtccttttgcctccaccacccaactgctaaggcatatgccacaccctatgttaagtacttttttcagtaacatttaaggataatcaagttgagtcacataaataaccatcttcaaaagaccttgggatttacacaaattttcagtaatgtctaaggaaaaaatgtacatgtaaagaataatccccaagtgaactaattctgccaatcttaaatgccaattatatgtgtgtggtcagcatataacaaataaaatgctcacaaagagttaagttcccccagagcaggtatttactggtcagtgaccacaatggctataaatagaagcatggtaaatgtttatgctcttttatgaaggaggtggccttgtggacctgaaatataaataaatctacattccattccctcatttttctttacattacctgatttgaagacacagtgtcctaaaggtcactgggtgattcatatgtaaacagggaatggttaagcctgaacatctacttcctaagagattcaactagttacgatccaggctctgtaatcattaagaaagtactggagtcttgaattcattaaagtcttttaaaattcggccagtgtagccctagctgtgcaggctacattgcttttcccctgatgtgccaggtctcctgggagctgacatagagtggctgctccacacttagaaagggaagtaccacctgccaaatccaaaaattgctgctgggattagaagaaattcccaaactgcaccacagcagaaacaaacaactagtctgctctgttaaaatagcaagatgagctaaaagagctcaaaacttttttactccatggaatctgccacagcaactgctgggtaacatggatgtgatttaaaattaacgaaatttagctgaaaattgcagctgggtggaaagtttaaaggatgaaaagtaggacaacgcagatgagctgcttggcaattttctgaagttttggaagcgcctttaattggtaagtcactcttactgtacctcgaagtacacacggcctcgtggctgagctgcatctgcagtgtttctgttcaacagtggctgccactcacatgaagattgccacttctcagtatgccttgctcatctttgtgtccctaaagatccccaagatgctctacctatgagacatacttaattgaatactaaaagctgataaaaataatttctgtcatcatcttaaatataccagggctttgagtttaggtgacatagcaaatcagacagtggccagatggatattttgaaaattacaaactcatatattattgccatcctgtggggaataatcagtcactggatgtcactacagatgacaggacttttccctggcctctatcttccaatccacaatgctgtcccttcccacacaaatgagaatcctgatttatccactggactccagggaagaaagaaacatagtgcttttcagtaaccatttcattgccatcattagcctgtattaaaaccgcatggaccaatttattaaccacttgtaaacatgttaatggaaacatttatggtgcttttacaaggcagcacacttgagaatttcctcccaaatactcagaagtctgttgattctattaagatccagccaaaggctgggagggtagtagttgagttggtggtgtttgccaacaaagcatgaggcttaagtttgaaccttagaaacacacacacacacacacacacacacacacacacacacacaccctgtcatgatggtgcacagttgtaatctcagaactgtggaggtggagataggcagatctttaatcagcctttctagcttacttgacaagtcccaagtcagccagaaaaagaagtgaacacctgagaaacgaactcttattttggcctctagcctccacatgcatatgaagtcccaccccaaaccccactccacccccacacaaatttactcaaaaatttgcaaggcaaacagaaaagcacatagctccctctatgaatactttgaggactgcgatcacaatacttaaaagtcaagcccagtgtagaaaaattaaagtccagttaaggtccattaattataatgcaattcctcagccaaacaagagtttggccttaaatcaatagtcaattacatacttcctgcagttctagtcattaattgctctgcagcttagaaaataacattctaactgcttgtagaaaggtaatcaaaatcggtgtctaatgcttaagcttgattctgttgtgatcatctttcctcaacaaggaaaattaacttcttcggtgacttggggccaaacacttccaatgcactcataactgttaaaaactgaggacaatggcaagtaacagattctgggtggtagaataatatttaatgtatcttaagggacaagcaagacaaaaatagcatccttggtcttcacaaaagaaatgcctctgagaaatgccatcacttctctatcgggtgtttagctggagacacacagaaaatttgctgtccaggagatattggatgggaaatgtttacaggataacatctcctagctgctgctggcaagggagcatttaatggtaaaaaggacatgctatctggctccgcaatgaggaatcactttcgagctcagttctcagcacagtgagactccttccgtcaaaggtgatttacaatgatcccccttgtgagcttcacccagcatatacatcgcccagtgggagacttaggattaaggatatccacattaaacatagagcctcagaacctagacaactctcagaaatcaccactgtagtgaaggatggggagagaggagaatataattgagagacacaatagaaatataaatgccgtgcagttgggggaatactttaatgcattactaatactttaaatgcatttgaactagggactaggaatttacaaagcccatatgtagtatgaagctctacctcagccttccacagtcaggggaaggatgctctgagagtgagcagaggagccacagggcagagaccctggaagaagaccccattgctttcattgcacattcatggcttactgtgcattgcttagaagcatgaaatgcaaggtgctcgaaatgattttatttgtaccgatttgaaatgatcttttatgtgtgtgactggcagggatgtgttcttctaagtttccccactatagatccgctatctcctctgagcctcctttatttttatttattaatttatatttatttgtgctaagctttgcatcccaggactcatgcaggctaaacccaagttctccactgaagtcggcctccagttccatcggacatactttttaggagcatggacaggctttctctatgtaattcagtctcatgggattggaaagcttcctggaggggtggatatctcatgaatcaagatacagagctcaaatatttttccaacagtagcagtgaggcatagccaatattattctgtgcctgttctcatccttgtccttgtggtccctgacagagtgtttgaaacaaagcatcagctagcatagcagagggagtggagggagccctgagggaatgtgcaaagttgacgtggaaacagtgatgaagaggaccaaggcctcagaccattgaaaacaaaaactaaaacaaaaacaaaaacaaacaaacaaacaaacaaacaaaaaactggcaactataggcacctcgtggaagaccagctaagtatgcctgctgtgctgcaccaaagaaacaccctgagtttccagtttgcagccatggaagtatggcttactgtcagagcacacaccccccacatggccccagtttttctcctgtgtctctgtgtggctgtcatttcttcagtgcccagctcctagtgaggtttccctagccaagacttgtgagtcacggcagagtgggagagaggcagggtgtttcttatgaggactgagtcttcgggttccagggaaactgatatttcccagaagtttctagtgacttttaagtagctggtcagaacttaacagaaagattttctggctagatcttttcctcatattcagcagcttataaaaccaaggataagagcttcatgattctaattactggtcacaagaatgggtcctgagtcatatctctggccctgggaggagacatgatagacaatccgaactgcccagaggccattagttgataactatctaaatcaggtttcaggagctttaaaccttttacaactgctgtagagcacgaagcttcctgataaacaacgaggacatgccattgcccctcctgtaagactcgacccaaatgagtctgtcaatcacttagacatggaagtgcccctcaggaaagctgtctgctctggagacattacacatagtataagacctgcttataaatgaaggctggcacaaagatcttttctggtcatgtgagtgttttcctcccagaagtcccttcagtcaagtcaatctctcaacccctgagaggggtccatttggttctgtaacaaactctgtccatcttctacattaacctctgtgtctcatatgaattctttggctggacatcacaattttaggggaatcaagacaagtccagagtgagaccatggtaacaaagactatgtcagtccattttgtctggcaaaggtagttcttccttgcctctgcactatgctagcagcctcgatgatgccaagagcccattgcagggccatgatttatgctggagttctggcatgagaggagatattctaaagagaggtacttgttcccatcttgtcactatcagagtatcaccaatctttttcacttacaatattagtgtgtttagaggaatgctggagttaaggagcagggggtttattcgtaaagaaaggttacaacagatctctcttcatccccagaaagaattgccttatatacctgccaggcctgggatgcatgggatcctacatttcacaaaacattcttttctccttcaactttaagagccccttttcggggagcacattagccccagactgctgtctgggaggccaacatgggactgatccagaccattgatcatggatgtcaaggaggaggctttcgtactctatggggcccctggtagtggattagtatttttcctggtgtaagaagggactttgagagcccatcccatgtgaagggatgaactctgggcctggacacaggatgacatggtggactttggggagcccccattaagggccctatcctccatggggagtggagaggggatggggtgagggtcaggttgagggctgggggagagggctggggggaggggagggagagggagaaggcattgacatatgaagcaagcttgttcctaatttgaactaataatttttttttaaagagccctttttcttggactctcacttcaacaaaacctatatcgggaacagagaatagagacaacctgttgctcaggttctccctacctaccccagtacctcagagagaacaagttagtctgtctcatggttaaactgacatgtgcatgcttcctggcttttgtttcatcttttctataaaactgtcagatcactgtaggaaaggcagggagaaatccggagtccttctctctgatatgagcaaggtaaacataaatctattttctttactgatttctgtaaaagtacaccttggaattctaaggctagagatgtacctcaattggcagagtgcttgtctagcatgcctatagcccttagtttgatccccaggattgcataaactgagcatgatggtacatgcctggaaccccaggactagggagatagaagccggcaaagcagaggttcaaagtcacctttatctacatggagagtttgaagccagcagacactagagaccatgctctcaacgaataaaatggaacataaaatcataaaataatattacatagaaactaaactgtagtaccactatgctcttgatgtttgacccttatcttagttgcctgtggtttgccaacattcttttaggacgtcccatggtttattaagtcaggatataacttctctattgtcctttgcactaactgggtccttcagaactctgggatgcagttgcaaggggattttgttgttgttgttgcctgaaaatacaaatactttatactcctgtggacattccattcaggagccattatggaattttgcctcccagagaacagcaactacactgtttcttcctcaaatcagcagctaacatggaagggctcctcacaagcctggaagcatgcatgtccctcatctcaacactgcctgcatccgtgctccatcccatcctcattacagggacattgcctggcctcacccatccttcctacgctacagtacaggtttatgctcagtcttctaatcttttttattccagatgattataactttgaaaactataatttaaaaagctgttctcaagtatgtgttttgttcaatcaaaagcacagacctgggcttggggagatgactcacttggtaaaaggtttgccattcaggcacaaagactcatgttcagattcctcagcacttaggagttagactccctggtaggcaggtggatggggagagtagccatgactaggaatggaactttcaagatggctagcttccatcttctctctgattggagcctggcagcttaaaacaaaggccttgcaggcttttgtctcccatcagcagactgcctgttaacagactggcttaacaagttcaaggccagctcaagacgtgttacacaacagttgtgagccaatcaactatcctgtgtttcttcaaactgactaatgataaattaggagaggcaaactcttcagggtcttaaaaaacccaccccctgagaagagaccagagttcttggcttcctgaggccccagccccccaccctgattcccaaccccatccccatccctgcattttgcagaggatctttttctttgtctactgcatgcctgtgtttcttcacccttaataaataaatgtctgtctcaactggtgatcctgtttgctgttgtctgttgtgtttgagttttctctgctgttatctgttgagtataagaattttcctgcctttttaattgtcagagacaataaatcccatcaaggaccctaaactgtgtcatcttgtgcctgtaatcccagagctgggaagaccaaaactgaaggatccctgggacaactgattaactattctatctgaatcagaatcccaaggttcggtgagaaaggtaaccaatgttaatgtctggcctccatacatgaacacacacacatgtgtacacagaggcggagggagagggagagaggagatccaggttttaatagcatgatgtctacgatggcctttcagaatccattttaggacaatatatattatttattgttttgtgctctagtcttgtttggaaggagtctggtactgcaatggacctgagcatatgcatgcattatccattggtacttaccaaaggggatactaaggttcaggaagattaatgtctacaaggctgcacagttaatcacaggaacagggagtggaggcagaaagcatccatgcagagtccacactcagcttatcgggttatgatgcctacagactcctatactgatgggacataataacatacacaaggaaatgagcaacacctccttccaatgagttatatgaatacgtatattatcactttgtagtgcctgatttaatgtgtagtagcctgcatagctctaatcccactgggattttcaaaaaccctcctcaggatatcttaatgctaaagaactctccaactttctctcagtgtgtcacctgtttcacctgggggaatgtttgaagaggcagatcttctctcctatactgctattttgttttcacacatcatctctgtgtgtaattatgtggacaacttctaaaaatgcctaatggataatactgcaaactcatgtaactcagtggagaaataagctctaaaagttcaaatataatcagagagcacaatgcctgctaatggattcactgtaatgggtcacacaaattaagaagtttgacttgaaacccattaagttagactagggcagagagtctagtctaaaagtataattataattttttctctagacataccaatattgaattttcagcagaaaggagattaatcgtacgattctgattctaagtcacattgttactgatattcaactaactgtattctagaacccaggcatggtgcaccacaccattagtcccagcactaaggacactgaaacaggaggattgccactagctacagtctggactctgtagagagtgccaagacagaccctgtcttaaacaaacaaatacaacaaaaattaattccaggaagatagtatattttaatatacccatgtaacaatatttatttaatataccaattaatgcaaaatttctctctcgatgtgatgatttgatttgagatatattttattttgtagttgttaaatattttatgcctgtactaaatcagtgatcatttgttctgcatatatcatattcaaattaagtgatactcaaattaaatttgagtttgggtatgtttaatttgggtctgtaatgtttttatttgcttgcaagtctttttaataataaaattcacacaattaggagagattttgagccaatatgcaaagaaagatgggggggggcttatttttgtctacagcactgcttttccagcatgcatcattcactgcccagtcaggaaagcaaaaaaagttcaactactgctttgtataggaaatttaatacaaagatttaattacaaaagggtcccgaagggctggagcagccaggaggaaaatgttgagttccattgcactagtctccaccatgccagtgctgaggtacagaaaagccctctctgccagcacactgcgctgcccagacagagttcctgaggccacaatgcttctatgacttggaatcattgacaaacgtgtttcacagacatccagggtccattttcctgctgaacagagcagaaaccctgaggtgcaggttatctgcagatgtcaaaaacagcaatggcatctggggcagagttcaggcaggtctggtgaagcacctgtagtgcttagatgtgcccaatacaaccatggttgtcctgcaaacacactgcctaaacaggcagtaagtgctcagacaatggctgctgaagttagtgctacatgcacacctatgtacatgtacacatacccatacatacctgcatgtgcacacacacacacacacacacacacacacacacacacacacacacacacacacacacacacacaccagggtgactggctctttctttcttcttaagccttcaatcacttgccagttgctccctattgcaaatgtctaatatagtgagtggttctcaactttcctgatgttgctaccctttaacacagttccttgtgctacagtgacccaccacaagattgttttaatgctacttaataagtccaattatcctatgttatgaactgtaatgtaaatatctgatatgcaggatatttgatacgagacccctgtgaaagggttattggacacccctgaaggggtctcgattcacaagttgagaaacactggtataaaggaagacatttggcatggaaatttctggagtatatccccacaaggtgtaggcagcatgcaggaatctatctacctcccaagtcctaactacttttaccttcttgacaacagcctttggaaatctccagactctattctctatcctctttctcttctgttagttttgaaatcagaacatatgtatcccttcttctagtagttatctgtacaattataacccattcttgcataactatttcccacacattccaaaatttaatacctctaccctctttaaagaggacaaaacatactctgtcttcaatcttctgtttccatcttccccactattagtgtcctaaattttagtgtcatagtttaatatctttttaaaaattcaccatttcaatctgttttatgtacaatttggtggcattaattacattcacagtagtgtactgtcatcaatgatatcaatttctgacatatttttatatccctaagaagaaacctttagagctaccaagcaatagctttccattttttcctacttcttacttctcttaaacgctaatctagtttttttaaataaattttactattgtgtatatgtcctacaagtgacattatgcaatatttgtctggtttattttacttagcgtgctgcagacctgtgcaagtcctgtgattactttagtctccatgagttcatatgagctttgctcagttaatttagagggccttgtcctccgggtgttctccatcccctctgactcacacattccttctgcttcctcttccatgagcatccctgaactctgaggggagggaattggtggagacatcccacttagtgctgacagttccaatgtctccctctctgtataatgtctggcagtgggtctctgcttctgtttccatctgctacaaaaggaagcctttcttatgatgtctgagcaaggcactgatctgtgagtgtagcagaacataattagggatcattttattgttacttttttttctttttcagaagagtagaatttggttttaccctaggtctctgggctatctagtgtctggttcttggtcacccaagcagagtcatgtaactctagcacgagcaagtgatctcactaggaattttgaaaagctgtttcacttacatatgcaaatagaggaggtccccccttacgttcagagatgataaattcatatattttcatcaaagattattctaattttctctattaatctgctgtctctattgatctcaatttgatgtctatgttaatctcacatacctaatagtttagttttatttggttttactggataaataagaatgtttctgtgtagccagctgctcttaacatttattttaaatatgtaatctttaaagctccatttttatatctgtgcctcctaattttatatattgcctatttcttcattgttattttccaaaacattgtaatttagatgctatatgttatgtgcctttctcaaatagaatatcaatttttagtttgcctctgttggtctattattattattagtttatcatgactggtatttgcaataacaatttattaaactatttcaaattggctggcttgatttctctatcgttttccaactaaagatgattgaataagacatataataacattttctattatgatattttcccagttggttggacagtgctctatcattacctttcaattcacttcaattcagtctcagccaaactaaagcactgccaagtgatattatacaaatgaaacggcagataaaaataaactcaggtacattttattcacttaaatatatgtgactattagtgctatcctctactatcatctatttctaaataaaacccacattgttgattaaaatgttttaattgtctattcattccactatatatatgtatatgagcagaatacatttttatttcctaagtatataacttcattaaatttactccaaaaactctacccaaatccacctaccaccagagaacattttttctttcttatgagtagcacaatctggtagacaatatattttcttatattttaatgcttatgattttttgcaggtctttgcattctcccatcaaaatgcaatacccatgaagatatttttgactgagtattctatgtaagattgtccttggctctgatgaataattcaacatgtattgactattggctacttctaaggccatggaattaggtggtaaagaaaagagtttatcataacttccaaaatgtagagattttaaaatgtatgctataaacttagcctttaaaatcctattataataagatgtcaaattaattaaagatttgcaatatagcttacaccaggaaaataaccattgtatctgtctgatgagatcaaagttaacaacaggactaggattatttcacaataatcaccacactgatcccctagactatattccaaatacatgtctgagaaataagttgtatgtccaagtgggatgataaaattggccctttttcatccagggggtaagtcctggcaccaaacaggagcaggaacttagtcacatctaaagcatttttaagtgcatggaggagaggagaggagaggagaggagaggagaggagaggagagggacagaattagaggaattagagagagggatagctcacatggcaatccctgaaagactgtgtgccatgtataaagttatgcacgtagaacccttaggtaggacaacattatgaaatgcagaatctattacccatgtaagtctcccaagtccttgaaatgtcgctaacacagtttaagcctagaaagaaatattaacaatgaattttcaagtaaataccccataccctttctacataactcagatttatccttggaagtctaaaatagcttgcagagactgcaaaaaccaatgcaattaaaataggctgaactagaacataatttctaaagcttgtggtaaaatttttgtctactattggttacatcttcgaatgtattaagaataaataaaagtaccaacactgaactaaacaattttaagacatgtgatagttacagtatgcatgctgtgacatctggtctaatgtttcttgtagagtatgctggtttttatttaagcagcaacctacagaaaaataaaaataagcaagtcccagagagtcactaatagtaacattaaacacaacttcattctagatgaggaaagagtggcatcagaaactaacatgttaaaaaaaaaatcaagctgacaattcctcagcacatatctaccaccaatgtgtcccttcatctcctaagatatccagaaagacaatgtcatggaacagaagataaaacaaaaacatgaaattggtttaactggaagttataaaattggagcatcctcagaggcaagtgaggtaaactcctaagcaaaacagtatgctccctctcttcacccttcctgagtagctgtgtgacaattcactgccagtccacaaagccctgggcctctcaagtcggccaaatcttccctgatcattgttcacatcttctttatattgagctcccatttctcaacctgaagcttccagcctgctcccaatttttctccttagtccccttgaaagtgcttcaaataaatttaacttatctcttgtgagaaagtgcttcaaatgtgtctcatgttatgaatatcctctctccttatcccttccacatctcttagaatcatcttctccaagttaaatatccatcattctgtcaaagcttcttcgtctgagttgaccacatgcatatctaggatgcaacaattgagtttctgagcttcaccctcaatccaatcagaatccaaagctgtagatttagatattttattttaaatgtactgaattttttcagacaatatattttcatcatatacatattgatgggtcaaaatttcattactctacttcataccaacagtcacaattggtaggagaattagcaagctatcagctacatggaccaaaacccctgatggagtctgatctcttcagtctcttccacaagcattcctagtctaaatccaaaaccccggagtatacttgcatgtaaagaattctagatcatctccacatccctacaacttcatatgttctctctcccttgctctctttccccctctctctttcctctctccttcaaaaaacaattaaaaaaaaaactaaaaaaatgcctctcccaaccccaccccatgccataaaaccatgaagtttattctgtgttagccacctactcgtggttatgaggccttctctagggcatgattgatatgcccagtgacatcccattggagaaaactagtattcccttttccagcaggtgagagagtgaacatggggtcccacatataatcaataagctattccagttagttttattttctggatctaagtggtaggtttgcttatttctattcagtttgccgtgtttattgtaagagattctcctatttattttagagtttccttttgaatactgcctttatcagatgattaaatttagctactaccctagtttttacaattcgtagactttattcaactttcttctctatatttctaagctgttgctaacaatgatgaatagataagccaataaccaagaatctaggtaaattatcatagtactagaaatttttcattagactgacaaggttacatgctcattccaagtaagcagtttaaaacttgtaagacaaaaatctagtatgcattgacttcacgtatatttttatgtagtagtaactttaaaaaaaaaaaaacatgaaggctaaactgaattttaaaaagcataagacattgtactatggagaaaccattcatgttgtcataggttagagagaaaaataaaataaataaccgcacactctataatggtcataacttcccattcctgataggctatctttcactcagtgtgtcaaaggtttaagagaggagaatgcttccccatcctcaacgtattgttgtctaaaatctgatatgttccctgaaaatcaaatctttatatatttcctcggatggtgtgaattagtctctgctacttgaatcctgtagcttgaacaggaccctcagtgaacatagattttaaataaccaatggaaggacccaccaatgaatcacactttagtaaatgttgattgaagaaggcagaattctaggatgactgttcatgatctacaactatttgtgttaagctctagattatcactttctttactgagtgtcttgcttctgaccacttgactgtttcaggtctgataggctacctattctttggtttgctaccattacacaacagaattagtgggatgtcgcttgcataatggcactatgtcatataaaattccttttctccggattggcatgaaagatttggtgctggtcttaaaaaaggcaacaataatgtggtgtgctaccttgggtgacagctatgtaagggagaattacagataaaaacctctagattctgaaagtgacctctagcaaaaagccagggaccttgggcatacacctacatggaattaaatccttctctaaaccagaatgacttctcttccacatatttgacttattgcttttgttttattctgctcttgtttttcttacgtaagcacactatttatttccctgtcacaaaaaaaaaaaaaccctgaaaactagactgacaaagtaccaatagattcaaaggtgttaaatctcatgatcatctgcttataaaccatcaagtctgagctgagcagaacccacaaattccatgaaagtctagagagcagcaagcttacttatgaagaggaagagaagtcagagagctacagagtaggacagaatagcatctgataagaagacacagagagacctgtgaagttctattaaacagtgactctggcaacaacccattgtgctggttaccactttgaacgtcagtacagaacccagcgtgtcttcctctggtgaagggttaaaaatggcacctgtaggaatgtgcctgttctgaagggagcccagcatttcctcctagctttgcaatctttgttctattttaatctgtatccaataacaggtgagtcaaagttcaaccatggtgtctctcttaggaaaagcgctctctttgtgcccttcttaggtctagtgaagtggaaaattaagtttttgccctctaagtccctgaaataggtcagaacagatatcaaacattaactctgaagcacatttaacatgatggcatttaaatgtaaaataaaaaatactgggttaaactctccctcgctctcccgactctacttctaatctcaatttatgcccatctatatgctccagcatagcacacaagagagagctattcagagagcaccatattttataatcttttctattataatagcaggataccagttctactagatttaagcaaaggaaaggatttactatttaatgtaattgaaaatttcagatgtggtagcagcttcagacatatgctgcaaagtagggcagaggatgtggtcatgttctgtctttctgttccggtgaccattgtgttggcttaattcccagataggccctttccaccccatggaaaagaggcaaattatcctggtgttggcgcccctcaaccgtattaattctaacagagaccaggctcatggtacatatcctagtcgatgtgactctgttggtctagttggtgttattcaccgctggccttgggaattagaatcaacctttcccaactacgtgggcttagaggaggcaaagaatgactcaataaaaaagcaaaagtgtttgtcaatgaatgcacattcagcaggtgagaaataatagatgacagaaataataaaggctaccatctccacatattaggaggaaatatcttcccaaatgtgagcacaaaaaacaaacttcaataattagttttatagtgtgtgtgtgtgtgttgtgtttgcatgtatatgtgtgaatgcatgtatccatatactcctgtgggggcctgaggagcacagaataccctgctccaccaagcttctctttattcctttgggcacgggtttctcactgaatctataacaaccagctgtcaacatattactcacaccccccaccgctcccagaacttgggttacaggtgccttcatggacacaatggtctctttatttgtacactgaagatttgaactcagggcttcatgtctattcagcaagcacttttctctattaagccttcattgcagtgccaccctataatcatctttgtaaatttaagctctataaatgttaatgtccaatattcctcccatactagtgaaaactctagttcagctccacagattacattctgctccaaggcaaacctggacttctatcttgtattatgagtcctgaaaaatgcctcatctgctgaaatagataagatatttaacatttccaaagttagatgactccaatgcaacataagactcctatacaacaagacaaatatttgtatacttatgtattacattagtgcatatcagtaaagtcatcatatgtttaaatatcataagatgaaaatgcacttaaaacacctaacccaccaaatacaataatagcttagtgacacaagaacacattgcatatcaagtctttaaccttggtgttgttgtggcagctgctgctactctctggccctgcccagtattctaaggagaatattataccacatgccactcattcaagaaagacccaaatccaagatgaatttctaatgaatacatatcaccttccttgtattaaatgtcttacaaatatttaagttgtgggtcagtctgtatataacagattctgccctctagtaagattctaagaataccaatatctcctagtcaatggtcaaatttcattattttggatgcaggggtgtagatgttataaggtggatgcaatctctcccatggatcacctgatttattttttccatggtcattaggagaaaagtaaagcagactaggagtaactgccttgactagcagaaaaactgacccagatactggtcacttaaataaagactagctgagagggaatagaccaatagttaattatcacaaatttagtgagaaaaattaaattatgaatgatgaatacagtttataagtctgtgattaaatggagcttcctgacagtatgttttataagtcttgcagtcagaggccagagaaatagaacttgctgctttctttaagaacccaaactatattcccagcacccacatagagtagctcatgaaatcctcttctggtctctaaggccacccgtgaatggcgtgtacttacacagacacatcatacatatattttatttatatacatatatgtaaataaaaataaagaaaaaatttgcaatcatacctaaaagtcaaattgggctttaaaggcaagcaataggagtgatttagccaacagtttaccacaagggagtttctgtttttcttagctaaagagccaggaatgcaaatggctgaggatggtctacacagtccacaggcatggcatctgaacttggcctctccatacatctgtggccagtggatggagaacaattgcaaacttgctttaatccccttaacatttttatcatcaaccacaacacttatattttcattttaatcatgtagctgtgttgccatttgtcttccacaaacctagagaagtcccagagcaccttgatctcttgacttttcccatgggaatgacaaaacttgagctaaaagagatccaatttgcaacagcactgtttcccagatactctgcctcaatcatgcctttcttctaatgtccacatctgggatatatattgtttctttgtatttttttatttcatttctctagctgctagagtctagcaggacccagtgttttgatcaccgtagtcaaggattaaagaatggcataaaatgtaaatgccaatgataattttctcactatgattatgatgggttgactatctaggagctaatctcatgatgccacaataatggtcaaatttcattatcaacttgcctgggtttcgagtcaactgggggacacagaatacatctatgggtatttttatggggaaagttccagaaagtatacccaccctgaatataggcaacaccattgcataggttggggacccagactaattaaaaaaggaaggagacagaaaccctaaagctcatctctctccttgctttctgattatatattcaatgtgactgaccagcttcctcaagtgcctgttgttataccttccccaccatgatggactctgtcttcaggcctagaacaaataaacttttccttccataagttgctcacaagggttctaatcccccctccccatagtcatctatcaatacctattttgatttgtatggcatatagcaacaattaataaacaatcactcagttattttatgacagaacattttcctctagattttctatctctatagggaactcagagtcctgggagctaacaaaccttttggatatggtccataagtgtgatggccctgactcccaaagaaggaatccctgtccttagcccactattccctttgaagtgattccctcgactcccagcttcaggctttagattattttctgtaacactgggttattcttacctactggaaaacaaaattaaacttcattatactaaatacttatcatttcacaaatgaattatttgaaaaaaagctgtatatgtttttttttattttgctcttatttcttgtgtttttatggtcttacccaaaaagtcactgcctatattgctattagcactttgaaaagatactgattcatgcttgccttgtgtttggatgcagtgtttcatttggaagcccaagatggcctcaaacttttcccacctgaatactcctgactcaccataccacatctgaattaagggcattaactatcatgcttgcattctcatgatcatgctgataggaagaatcaatatggatgccaatcaatgaatgaatgtatacggaattgtggttaaaaaaatacagtggattattactcttcagcaaagaaagaatgatgtcctctcatttgtaaaaaattcaaaggtaacaggttaagttacatgagactcagaaactcaaatgtcaacatctgctctccatgcacatattttaaaattaatagagattacaaccagctattttttataaacatacatttgtataaatatgagtgtgatacataaacatagatatataataggtaatgatctaatcagataattacacttctgtttccttattggtttatattaggagccttcagggctgttctcttatagttattcatcaaatagagaaaacacatactccaatgtatttgtaagtacttacactgtgtgctatagaacaccaaactactgtttctctcttaggaatagtgtttgtggtcctcccccatcctgctatacttctgttaatttaatcttctaataattggctattgtgtgtgagagagagagagagagagagagagagagagagagagggagtttgattttttaaaaaaaatcaaacaatttcccagggtaatttttcttctacagaagtctccattcccattctcttcaaaatatagaatattcaataaatcaagttaaaaggtcattagcatttgaggagctagacaggcatcctctgccttgatagagatagatagatgaataaaattaacgatgtagaaaatcaaattggggggaaagatcaactttgtatgggacaatgggtcatataggtgagcttatttttgtcatattttccctgtcacagctaaagagaagtacttgaaatttgaacctctaggaaagtgactttataagcatcaatattgcctatggaactgaaatccactaaataagatatgactgtgtaataattttcttaccaggacacattgctagagtcagatctgtgaatttaaagagcaagctccgcaaagtctgccaaatgtgcaaacatggctgttctccctaagccatttaagtcaaatctgctggtgtcagttgggcaatgtaagtcacttaaaccaacgactaacagacctagtgggatttctcaagaaatagagtcagctgccttctgaggcaaatcactttcgtgggacctgaactagctacaatggaaggccaacaccacacagatatattttaaccgctaccagagagagtggatgagcatggtgataggggagactttgagggttcaattatctcctgttcatttcattttaattgacaggtgtttatgagtttgacttacaaatgctataaactccaaggaaagcttttgaaattattttggacatttgcgtatgttggtttataaatgtaagggctgtgcatgtgagctcattggcaatcagaggccaacttgcacaagttgattctcttcttctgtcttgtggatcccagggattaaactcagctcatcaggtttggtgacctgtatgcaatgacccaccacaccttccccacaaagaaagtcttaatgggtgctcttttaaaactgtctctctctgaagctctgcttagcatggtgctattcatagtattcccttggccagctatggttaacatgaactgtgcgcattctaatcagagagatgagtttcggagaattaaaagcatccatcatagcacagcccttggatcaagtagctcactttctctaatggatgttctaaattaaacttctattttgggccatttcattcaatgcttttctgcagatttactttgacaaagacattcctcagttggtgctggagtcatgtcggttcacatagcttactgctggggcccagttacattttcccacacttttctacatttctttgtataataacaaccattccccaggctcagtgactgttgttcatttcctgaggactgtgcagaatgctgcctaaatgagaaccatcagtgaggaggatgtaagcgatgcctttaattgataggataaacatggaccatttagttttgctttaactcagacttcaaagcaccaggccgtgcatttgcttcgttttggcagacgcaggaagccagaaactcttcagtaggtaagaaagctatgaaaattaggcatctgcccaaaatcaaggatgaaaaataaacactgaaaacccatgttagtgtctattctgaactgaaaagtgaaaagtctcatgagagcatttgaagataggaaacacacaattttcaagaccatggtcttgagtccattttacagtagaggatgtggtcttggggccagagaacgttgacccttcttcattaaagcctcatagccctactgagatgaaacacagatctttgagtcctcttcctccttgcccactgccacactttagcccacagtagggacacttggctgggcggatttatacatgccctttggaacatctaacagaggccttcctttgagtagccatttaaaaggagaataaactcaattaggccatatcatttcctgatgacaggctgccttcaaagaccactttagagcacttttctacctcagtggcctctgattgctggtgcacagacacaggacaccttcacacacaggaagacaggatggggctatttttatactcactaatccctgtattttcagaatagctgcatgtgacatgatgctgagcagcactacagtgcttctcggagcccaactgggcttgcaacaacttagaagtgaaaccagagccctaaacccagccttcccaccagcccttgcactggggcctagagtctccttgggctctcttacctcctcaaagcttagtgtgtggtgactttttctctgattttcttagtttatccacaataaattgagagctaatttgcataatctgaaacaagggaatggtttaattaatgatcatatgagttcaatggactctttggctaaattacattttcattgagaattctataaaatttgatcaaatctacccctcctccctctcctccaatccctgcctcatcccatccaccattctgccctcccagcttcacatgctttgttttcaatcacacttagttcacttggtgctgctcgtattcgcttgggtgtaaggaactcaactgtagcatgaagaacctctctgggattgaattcctgaagaaaactgactctggttctgccagacaccagcaattgccacaagctcttcagctgggagtaggtgggcttcacggacccagccccctcttccatgctgggatttttgctgactgactgtgccagtcttgagtgtggagtcactgtctctgtggctccatgtgtaaaaaagactgtttgctgtagatgccctctacccttagccttgggtgggcccaccaataggtatgaaagggtgatagagatgtagcatttagagctgagccctctagtcccttgttttctgcatgttgactcgttgctctgtgtcaatcaccaccaaatcaccttttttcacacacacacacacacacacacacacacacacacacacacaaagccttctcctatgtggattgataggtgtattaactatgtgcataaatgtaggaacttaggatcagttcactgccatgtccatttaacaaaataatagtagtagacagcccacacatgcataaataatattgtctgcaatattgactaacaatttcacttcttcaaagaaaaatcagtaatcactgtgtgtgaaaggaaaccagagccacccaaaatggtggggttactagattctgcaggaaataattagatgaaagatttgagatttgggccatttgtttttattcatggactgtgagaaaggaaagaaatatgacagagagaagcagacatttaagaagaagaaacaaataaaaggaaaatgtcagtatttgctgcccacagcctggaactaaagaccagttcctctcagagagacaaagaaacacacctgcttctcccgacattcgttctgtcagctgctgggatgctcagaccatcccggttttttatctctccataattgtgttagtgcttcagccaggacgctgtggcatttggccaaggtttccctgcatggttgctttttctacaaagttaaagaaggaataagataaggtttaaagtaaccccttcattgttggttggtagtgccgcatgcctttaatcccagcattcggatttctgtgagtttgagtgccgccttgtctacagaatgagttccaggacagtcagggatacatagataaaccctgtctagaaaacaaactaaaaaaacaaaacaaaacaaaacaaaacagcaaccccttcttcatgtttgtatattactgaatgtgtagggagtctgtgctcctagaaacagcaggctgctcacttcccttagcctcccaggcttcggcactaggtggacagagggaggcaagagaagatggttgttagttgattttttccatttttgtttcttcattgaagtgagagtgccctgtagtctagtttattcgtttcatttttcattggcttgactgtgcacagtcacctaacaaaagaaacaaccaagggctgaaggattcaaaaataaagaaagaaggggccgccagtctggcctttctctttagctggaaactgcttgaagttaattgctcacataagaggaatcactgctggtgctgtaattgaatttttatggaaataaacaggtggcagatttactatagctgtggggatggtgagggggggtgagatgctgtagccacattaacctgtttaatttaatagcttcggtattcatacagggggaaaagcaaggcagctcatggagtcagttggatgccaaatgtaaataactacaattacagagcatgcccatgtggttgagcaaaaaagggcaccgggccagctttgacttagtttctgagcttattaattaagccactagaagtttcacaactcttaacctatgaaggaggcccccaaaaaagaccaagagaaaagtacatgacaaaggggaaataggacagcagttgacaaaggatctgctcacaggaatggcacaacccaagttcttgctttgtgggaaccttcattactgagagggaagactgcacttagagggatgagtgaaaagctagctttgcactatgctgcccccaagtggtctagtttgggtaatgcatatttttattctgagaaaaaaaaaaaaaaaaaaaaaaaggtcagttaggatacaaatgccattgggttattttcctgcttggcattcacttttaagccaaccaataaaaagagtttgtgtttaaatttttggttttttcttttatcacaaagcatgttaaactctctgtactctctatttttacttaaagaatgaaagtgtattttaaagaaaaatgcaacttctcatgaagcacttaccccaggaaatagtagtaaatttaactaagaatcccttgtcctgtttcttaggctcctgggtgagcagattcccaggtgaggcacttaaacgaagccatttgtccatactgaagactatatacacaaatgtggacatgaggctaaagcagagattgtcaaaatgtcacttgaaaaaaaaattctacatgcttttggagtcacctcattgaatacccgagattataggatacagagagatccagtcaagcacaagtagatttgtgctctttggagatttgtgggatgttgtgttgtgttttgttttgttttggttactgtagaccaagctgtaaagaaatgaaaactccgaaagtgtgctctcttttctatcagtcttgtgatgtcttttttattaacttcttaagtaagtaatcttatccagcctgatgactgtttcccctccctcttctcctcccagccctccaaccccactcccccaaactcacatccagttcttcccctttctcttcagaaaagggcaggccacccatgtacatcagccagccatggcatatcaagttgcagtgagactaggcacctcctgtcctattaagactggatgaggcaacccagtaggaaggaagagttcctagagcaggtaacagagttagaaacaacccctgctcccactgttaggagttccacaagaagaccaagccacacaactgtaacataagcagagggcctaggtcagttccatgcaggctccgtggttgttggttcagtctctgtgaggccttgacagcccaggttagttgatgctgcgcattttcttgtggtatctttagcctctctggctcacataattcttcctccccctcttccacaggattcaccaaggtctgcctaatatttggtgatgggtcaatgcgtttgtttccatcagttgttggatgaagcctctctgatgaaaatagggctaggtaacaatatataagtatagcagaatatcattaggaatagtttcattgacttttttcttttttccaatcatagttggttctatcctaggtctcttggctatccagccctgggtcctggttctcatggctgggttagggctgggctacctctcatagtatgggtctcaaactgggccagtgataggggaagtccttctgtatatatgtttctctttttctttgatgaataaaacactgattggctgattggcaaggcaggaagtatagacagggcttggagatgagaattctgggacacacaggcaccaagtacttcagagaggaagatgggcattgaaaaaactagttatggagttgctttcaatgaggcgagactagccatttgggcaagaaactgctcttgcctgggctgtttgactgtatgctctataagctggacatacaggaccctcaggagagtgactgctgaaataagatgggacagtcatgaaagactcctgcttcatagaagagtctgccagacattctgcaagacacagaaaaaggactgacaaattgccaatacaggtggacaggttaaaatttcatgattcactgagatgtctgccagatacactaggcctatgggttgaacatggatgccccaacgttacacagaagaacttccggtgactgtccaggcggcaagatgtctctgtctgttctagagtttatatattatccttctgtggtctttgatgaagttgaagacagataatcacggctatggttttccttagttatgataaaggataagttacatataaaaccttagacccacaaagataggatagataacagaatattttctttaaatttttccaaatgttaatttacttaatattgttagctatggttcttacatgataactgttctgttatatataattttactatgttcaagttaaaaacgtttctttttatttagacagaaaagaggagatgatgagggaagtccttctgtatatttgtttctcttattggttgttgaataaaacactgattgactgattggacaggcaggaagtataggcagggctaggagatgaggagaatactggcaaaaataggcagatggagtcaccatgtagctgccaaaggagtaagaggtccagacccttctctggtaagataagaccatgtggaaatacttagattaatagaaatgggttaataattaagacagagctagcccataagaagccctagccactggccaacagttttataattaatataagtcttcgtgtgtttatttgggctggagaggtgggacctagcaggacaagaaaaattgccagcaacagaccagtctttgattggccactcccataacttctgtaccacctttgtctcaatatgtattgtaggcaggacaaattgcaggtcagagattatatggctgggttggtgtcccaatcactttagtgtaagtcttgcctggttacaccagaaggttggtcaaggctctgtatctccaatttctaggaatattacctagagttaccccatagatccctgaggatttccattgcaccaggtttttcaatcattccagagctgcccctggttccagttttctttcccagtactgtcttccttcatcttcctccacctgatccctcctgttcccatgcccaccttcccatctcaacctttcccttcatccactttgtgaagtctattctatttgcccgtcacaatgagattcctgtgttccccccaacaagccttccttaatacttagcttctcaatatattgaaatctttgatccacttgaattttggtattttgtgttggtggtggtgatagtgtgtgtgcatctgagtgtgtgtgtgtgtgtgtgtgtgtgtgtgtgtgtgtgtgtgtgtgtgtgtgtgtgtgtgtctttcttctttttgggttttttgcgggtgatgtgagggtatttattacctgttttttcaagggtataattaatctccttggcttggagttttttcttttattaccttctgtagggctagatttgtggatagacagtctttaaatttgacattgtcatgaaatatcttgttttctttatttatggtaattgaaagttttgtggagtatgttagtataggctggcatctgtggtctcttagagtctgcaagacatctctccaggaccttctgacttttagagtctccattgagaagtcaggtgtaattctaataggtctgcctttatatgttatttggcctttttcctctgcaaattttaatattctttctttgttctgtatgtgtagtgttttgattattaagttgtgtgggaactttttctggttcaatctttttggtgtttggtaagcttcttgtacatttataggcatgttcttctttagtttaggaaaagtttcttctatgatttagataaatatattttctgggcctttgagccaggattcttctccttcttctatttctagcattcttatatttgatcttttcatagtttcctggatgctttgtgttagattttattttatatttaacttttttttaaaccaatgaacctatttcttctattgtattttcaacacccgagactcttccatctctcatattatgttagtgatactttcatctatagttcctgtttgtttacccagttttcccattcccagaattctatttgtttttgttctatttgcttctgtttctatttctaggtcttgaatggtccttcacctatatgtttgctttttttcttgactttcattgcattctttaagggatttattgatttcttccaatttttttgtttgtcttttcctcaatttctctaaggaattgttttcatttcctctttaaggacctctattatattcataaatttggttttaagattgttttattgtgcttcagatgcattggattgttcaggtcttgcttttgtaggatagccaggttctggtggtactggattgacctttctgtggctaattgtgttcttacaatggcatttagacatctgtgtttgggttgattataggtgtaggtgttggttctcaaatttgtttttgttggatgtgcattttgttccttggtttttatttcctctctggtcttcaggcctaagtagccaggggttcttgtgactagtgagtctccaggtccagtaggctgcctccagtggggtttttgcatccagcaagacctttggcatttggggtaacagcgttgtctctgcagttccttgtatctgtgtggcctctggggttctggatacctgcttggtctctgggattcctagtacaacatgtcctccagtatagcaaagtcttctgctgatgttgtgtgcttgaatatggaactctgggtgggggtagatttgggagctgttgttctagtttagagagtgttcgctggctctgggcaatgttttcccatgggtccctagaattgacctggcatcagcagatgtcttctgctggcattgtaggctggaatatggagcccagaggagggtgttgagtctagggttattggttgggctttaaaaagtgttagcatgtggcaggtcatgtcttacctggggtccataggaccagcctggcttccagtaaaggatctgaggtatggagtatcttgtaatgtctttaaggtcatcatgtcccatgaatacttgctaagtgcatctttcctgaaaaacattagcttatctgttatagcaggctcatttcttacagtcttttctctgtaccacaggatttatttttttgtacagatgccagtaatttgttaatgtacctggtgaacccattgacagagcaagagctccacattcatttcattattaagcattatgatagatatataataggtagatagatagatagatagagatatatgattatagataggtagatagattagatgaaaagattacagataaatgataaaaggaccagttatagataaatagatgataaataggtaagcagatagatgatagatagatagatagatagatagatagatagatagatagatagatgatagggatcatagatatatcttgctgtgcaagccacaaatacacacacactacttcactttttctattacttcttgcctcctatcaatcagttactaccagatcatctgtagtccattcatacctactcctaggtatcccacagccctccatgttcctgcatccatacaataaactcttacctggattactgacatacttggtatcttatcttaccattcttagggcacactcctaatgccacactcctactgcagccagtgaaaactttaagtatgtaaccattgctccttgcttaaaactgtgaacttaactcctcatttttctgaagataggatagctgctgaagtttgacaactctttgctgttccattccttcctctcacatttttgttcccacccttatcatttcagtaaggctgttttattctacccagagactccctcctgatggtgatttggcttcctctatctgctttggtaacacctgcctccccctgagaggtttatctgcaaatgaaaggcttttcgaaaaagccctgttccttcctccaaaactccagtgtatatatacccaccaataacaacacagtacagggatcctttcctggttttgttttgtggttcttttgttttgtccatctgactcaagatagagttatctgtacaaagaatctcagttgacaaaatgccagcatcagattactagcagtcaattctgtagagtcttttctttattaataattggtgtggttggtggcactcccggccaggttgtcctgtatcatataaagaagaaggttgagcaagccacaaacagcaagccagtaagcagcacctgaccatggcctctgctgtagtccctgcctccaggttcctgttctgcttgagttcctgccctggcttcctttgttgatggactataatttaaaaatgttagccaaataaaccctgtcctctgaaagatgcttttggtcatgttctcatatcacagtaattgaaatcctaagataggttccctgtagcacaagctcatagaattatcttgaacagcatctattttgtaccatcaaaacatctgtactaccaatgaaaatggcatgccagaaattttcttccttattgacctcccatacacagcatgtgaatcttgactttgattgatattgagtaaaaatttgttcaattcgaagggtggtggttgcacatgcctttaatcccagcactcaggaggcagaggcaggcagttctctgtgagtgtgataccagcctggtatataagagctagttccaggacagcctccaaagccacagagaaaccctgtctcgaaaaacaaaacaaaacaaaacaaaaattaaaaaggaaaatttgttcaatggacacctgatatccactttataattgttcagtatctctacatctttaaaacttctacatattcttttaaaactgggtgattgtttgattgtgactgtggtgcagggagtggtgcaggtccaagatttggcatgtcctaggcaagtcctctacgctagagcttcacttacacactgaatgcctgaaatagagatatgagaagaactggcaactcagaatctttcaagctctaaaccatagttttcagttttgattcgcctataagaacgatttgctttagattcagtcttttagaacatggagacagcaactcactccatgtttcaggaacccagatggcaactctaccaattgcttaagcgacccatttgagttataaagtcagaacaataatcacacaagactcaactacctagaggccaactgagatcgaaattcaattaaatatccaagtacaattcattattctggtcagtatagacagtgaaattttcggggctgttgaaatcagggtagcttaaagtcatagtttaacaatgccccagattgctggactttggtggtgctcgctcacctttaatcccagaactcaggagggagaggcaggtggagctctgcgaatttgaaaccagcctggtctacagagagttccaggacaggctccaaaacaatacataggaaccctgtctcaaaaaacaacaaaacaaaaaaacaatagcctagatctccggtcacctctctctcgcagttcacatggggctgaatgtattttcaccttcttgagtcttacagttgtattgcagtttttttagcatactgttgcattctgttcacacagagaatagcccgcctatgtagccagatctaggatatattttaggtgcgtgacctgaaaagtaagcagtctattttggtcacaaagtcaaaacaataacatttggtacttgaacatgtttatgtgaatgttgacccctaaaagcacattacccttagaatgtaatatctctgtgcatgatgcttaactggtcatcgttataaaggagcactggctatttaaaatggtttctgcaaaaggatggcatgtcacatccattgtgcataaatccaggacaaagaatagactgactacattaagggctatttatctgcaatgctagtaaatacccagagaacccccttctaaggccccgggggaagattgactgcacacacagtgctattactgctgaatccaatatcaaagagttcttcttttggatgtaactcacatctgagaattggagtgagagtgtttaaccccctatcatagtggcctgaggaagacctatgcttcccaggggcgggtagggtggagtgttttctataatgagaatagaaaggactatggcaccatcacttctttcagtgaagggtctaatgactaccaaagatttcttcatatcagaccttaaagaacaagggcttgcctgtggatccttgtggtgaccataggtagtgccagttggtggttgctaccctggaatggtctcatcctccatgccatcagggaagccacttgaacaaaagcatctatctaccagtggggtaagaagaacaggaattcaaatcctatccaaaactgtgcccctttcttgaccaatgcacttcccaagaccttggcaaaagacatcttccagacctcttgagatcaaataaggggaaggtattttgaatgttattcaccttagaggacattcttgtcttctgaaggactcctgggaactcggtttcttatccaaagcctccattaaatctagcctctagtcaagaactaagccataatcagactccttcccaccactctggctatcacttccattgcagcatctcagaaagactagcccctttgtaaagtctgatactgagatatgcccaaagtcaattgtgcttagaaatcaccatcattcatatacataactcccaattttgtcataaaagcaaagaatctccagctagcttttacaatgctagtgactctttgacacgttgggatctgcccactagttaaaaccctgaaggtaatgaggtagatgtagagcagtttcaagatgagctgattttccctcccacagttggcccatacattaatttacttctctatcgctgtaataaagcactcaattaagaaataggggtgcaaagatttatttctgccagaataaaaggagacatagttcacataaggtcagctgtgccagcaggtggctctgtacaagccagcatgcgagtctgagaattaactcttcaactcttggtattacagcagagagagacagcaggcagggagcagggacagagtgtagtcgctatcatgcagtaactcacctcttccaggtagatgctacttcctaaagtttccacagaaactcaaagcagcaaaatcagctgcttttggaccaagtgcccaaaccatttcacatttaaaccagaactccctaaaagatggaaacccatccaaaaagcagaatgcacattttgatgctcccaagaaaagatataaacttacaaatgttttgcagtgagctctccagcaaaagaggacaagtgatttttgatttgtagttctgacatctttctttcatgagaagttgtctacatgatgacatcaccaaacaaaggtggaaagaaataaatgcagttgtcttctcagagccaggaagcctggaatagcaacggggagaagaggcatgcattcatagcattctcagtttctggaatcactcataggatctgattctgaagttcagcatccctcacatttgtagtcattgtcacttttatgtgagagaaccagcaggttattaacagcaatgttgtcaatgacaacattaactctaatctctgagaaagacttttaactatgtagaaatctaaagtagtggagagaatggaaactcctggtactgttagcattcctgaagtttggtttttgccacactgaagaactttgagataaatttatttaccatcttttcaactgttgattgttctcagaataaccctctgaaactatgtacatcttttatttgtttgatgacaacgactacttggttttctagaatgccttgccttaaataggtatttaactccatgggagccttgtatttcagagcccacagagtctttaattttccctttccccaccatatgcatggtttctagggacaagtccacagagaaagatgaagtgtcactgagtcccttcccttcctggaaatcaattcctcgaactcacatctcacaccatttttcctaaggcttcaatacttagatgcacaaccccactaccatcttttgcatcagaaatgtgtgtaaagcaaaagaagttaaaccaaacatgatataattaagagaaaagggcgaattgtagcagaggcgttcgctcccacaactatgtagaagttggaaagaggtagatgagaacaaagggaagtcagacagcaggaagctctgtgtttagagcagcataaattctacacctagtgccatcaacctgcttccagctcctgtggattctaatgtgtttctctggataatttcttttctatccccagatggaaccatctcactgccaagcctagactatgtgcctgtgacctcactgtctaagtggagaaaagcagtgcatcggatctgtttgtgcttatccatgacacccttcatcctgccaagaccagaatacccagggtggaaaaggagttccagtgccagatggtttaacaccatcacaactgcagtcaatggacaggagcgggatgctttcagaggaaaatgttagtgtccaaggagaaagtgagactcccataaagagaggattaaattaagggaagaaaaatgacaggaaacagaccaatctttgaaggaattttgtattgatagaagggctagtagctttaaagataatgcaggtttagaaatattgctcatttttccattataacaactaaatacatgtcaatgagagtattcatttaagaaaaaaaaaagctctgcagtcattaaggggataaactgatgaatgactgcatatgggtaaaattaaaaacaatgcatatagattaaagagttatttttccccttcacgtaggacaaatggaaagatgaataaggcaagaagaagaggcaggtagccattgctcattaaaggaagttgggacacttggatctttcaaccttaataggttatacattgcagatcaaagttcaaagaatgaagcagaatttaaaaaaaaaatgaaaggaaggaaggaaaccttgatgactggaaaacattaagaaccactactataaaaagtgataatgaattaggcatgaataaaagatctagtggaatggagagccacttcctatctgactgcctaaaagctgtgtaataatagtcactgacattgggctgatagatttttccattaggaaaaacagtattctctccactaaactatccagactctagtaatcaccttctttcttttgatgtgattatacacacaacagatgcaggagggactctagacacacactcaaacacccccccacacacacacacacatatacacacacatgatgaggcacttttgacaggttataaatgaggaacaaatacagctacctatggcagccttgtatgtggttttgtggtgtctttgatgcttattcaaggaaccagaatttaaccacctattaagagtgcagaacaggcctcagattcacctttgtcttctgaggtttgtcccctttgctgagatgattccagatgcattttggtaatgacactgtatcaggcttctaagatcaatggcctgagctcaatctgctataggaatcttcccagaagaaagggatgtttcatcacgcagagtcattcatcctaggcctcactctcctgcttctgatcttccactgttaaaagcataacacactggaggaagattgtgctatatttcatgagtgctctgtgccgccaccaagggacacttccatctgttatttgctctcagctttgcctactgataaaacaggaaggacagcttgctgatgggctctttgaagcaaatggctccactctttcctgcaattaatgtttgtaaattatttctacagtagtcagcaggtatggtaccacgatttcaagattagtttcaataaatcaagagcctgccttccttctgagagggcctccattacaatgagactcatggttagtggcatgctctagccttgatgaatattgctgtgtgtaatctgatactctcattaattctgtcaattaccattccctcgtgggaagatatgaaggctgtatgttgggttgttgaaatttcacttaatgtgtagtatatgctgttcacagaatctggtatttaggacacttcaaaattccccagtaagttaatagccctttggctgctggagagggagatggctcatcacaacaaagctgggttgtaatggaagtaattttgggttttttcccaggattactctgttgtttcagtcataaatcatttttagagtagagaaataattatatattttccagccgctgcactattttaagaggaatttctctagatctatagtatgaacctctctttctaaattgaaaaacattcttttacttaaatttcttatttttagtttaatggttcaaaaatatttgattaaatatgaccctggttttgttattgtttgttttgtttttttttaaaactgatcatttccttattttctctaatggtctattttcaagggggaagatggccacttaaattacattcagattgccactttaaaagtttagacaagggatttgaacttgacaagcaacatctgttctttcagagtagaagcacaagaaacagaatgatagtttctaaagacaacccaggtagagagagatcactgagcaaaagagggggcattgaacagctattaaaagcctatggtggcaattacctcttcacctgggtctgagttcagttgagaacttgaactcttaccaagagaaaagatgaaggggaagataccaagacatctggtggcaaaaagtatcacagtgcctcacctaaagacaccgagtgcgcattagtaatgggaaatacaaagaattacaggaatatgtggaaagaaaattcagcatgaagctcccacattatatgaacaggacctttctcagaaaaagaattttaggaagtacaagccattcagaactgtgtgtgcactctgtggccactagctgtgcttcacagtagcttatgaaagccatggcctttgcctctgtgttcacaatactgagagtaaactagaaagcatgccagacattaaagactaaactagttgtgtgagatatggcacatgaatattaaagagtaatagagtttattactttttaaaaatcaactgtcttttaatgagaggttagacaatcctcttctgagagaaaactatataactactaaggagtgaaaagaataaaacatccagagaagctttccttatcatcaaatcagtctctttaggttttttaacttttcaagtacctcactgtccagtgtatgtgggcattgggaatagcactgagttaagtggaaaagaaactgtaaactagcagaacaatcatgcagaggcaaggtgaaaggagaaactgttttggattcttaagtctaaaataaataattacaaacaaggcacacactgttgttaaaaacagcaagaccaacactgaactgcctgtgaagaataagagcaaagaaaacattttgctactgaatgtcagcacctttctgtggacaggtaaatgagaaagtattggaaatttggaaaagcactatggacattttattttcaagtcatggaagatccagagaatgggtagagatataatattgagatacaggggaaggggttgaatatcaagcatggagccaaagtcttcaacaggaaatgaccaatctgttttcagaattcctaagaacatacattggggagatagctcagtaggtaacatgcttgccaggaaagtaggaggactttcttttctactgtccacacacatgtaaaatgtctaggtgtgccagtgtaaagccataatcccattgctgtgaaagctgagacaggtggacccccagaatctttgaccagacagtaaggccaaatcagacagctctgggctgagtgagagacactgtctcaaaaattaaggtgacatattgaagatgaatacacgtgacatcagtcttgctttttcacatgtatgcatacacacatatgcacacgcaccccacatgtacacaagcatatacacatgcatgatatatatatatatatatatatatatatattggaatattggaatatttgtacacggtgtgaagatgtgttactgtgattggtgtaataaaaagctgagcagccaagctgggcaggagagataggcaggacttctgtgcagagagagaaagaggagataattgaggcacatgggaaataacaatggaacaaatcagacatatgagacagaagaaagttaattgagaaacatgatagaatgcagataaatagaaacaggttaattaagttataagagctaattcagaaaaaaaaaggcaaagctaagcccaagctttcataattaataactttccatgttattatttgtgagctgttggcccaaaggaaagttcgactacacacacatacacacacacacacacacacacacacacacacacacacacgcacacacacacacatgcacacacgcacacacacacacacatatatatataatatgaataagagaatgaatgaatgaatgaatgaatgaatgaatgaataagatggagaagcagttgagtaaggcacccaatgtagacatttggtttccacatacatgcattctaacgcatgaacacgtgcaaaatgataatattacactaaagttagatctaagaaaatacacagaattgaaaagacactctccattcttccagtctttataaaagatgcactaccatcagcttcatacactttcatgccactcttcttatgggcctattcatgatgacctgtcctagcatgcgccgtgtaatacagtatagaaatagatgcatacactcattaaatgggccaaatcacagcatggtctttttttcccagagttgggtactttgattactcctacatttaatgagtcaactttagagagaaaaacatgttcttttttctcttgaagaaattaaatgcctgtttgtagagaactaaaacaatcaaagcatgtactgtgttattttcctatgaaagttggtgtttatgagggactgggaagacataatcactagctactaattacagagattttttttttgtcttttgacagggaacttaaaagaatttctagcactttatcttagaattttcagttttctaatgaagacacaggaaagtgggcagcacaggctggtatgcaggaagaaaccaagttcttcagtgaaagaaacagcatgatttgtaaatgacaaagaaatagaaccggtatactttaaaactacctcaagcctagaggtggtagcctacaccttaaatcccagcattaggtggacagaggtaggtggatctctgtgagttccaggacagcctggtctatagatgagttctaggatagccagggctactcagagaatacttgtcttgagaaacaaacaaaaacatagaaaaaggaataaaacaaacaaaaacaaaacaaacaactacctctaatttatatgggtagttttcttcatttaaccttcccaagcaagtaattactccaatgataactttcttctaagtattttgaaaatacaactttcagagtcaacatcgtatgcatttccacattcacaaagcagacacatgtaatctgttatatgataagatagatcctgcttcttcttttgtcacattacaattagtattttttactcaaaattagtattccttactcaaaatatttgatgtctcctcatttcattaatagcagcattcaattaagttgatatatatatatgtatatatatatatatatgtatatatatatatatatatatttctgtatttagaaccaccaatctaaacacagacataagccagtaagattgctcagagggtaaaactctttggcactcgtgttcttatatgtacattcgaagagagggggagagaaagagagaaagagagagcactcacaatagcagtaaaattaaaattttaaattaagtacaaacattgaaaaatttgcatcatgatgttctacagagacaactggaataaaccaatgaacccaccagtccactcttgttttgctactgactcagacacaaggctgcctgttaccactagataaatacttaggaaggaaagtgcctacacagttcagatgaaatatcacatcttagttaacacatttgggctcataaatgccactctcaccagctcaatactagtccaaactctgcagttatcttggaactagttgttaatcacacttggcgtagttgtttgcaattcaaagaatggtaatgcttctctgcttaagaaggcaagaacttgatgatcagaactacacaacttgggtaacctccaaactcaaaattgagaatttcatttttttatcattatgaataaaattgttgtacttttaagaattcttttaaaatcgttaagaatttttaaagtcctggctactggaatggcaatatggccaacaaacagtgatgaaaagggacaaaattcctttcttgtaaacatttagataggtaatggtgatatgtagtaaaacaatccctgagtaggttatcacagtattcccataattattgttttcaatattccctcatgcctttagaaaggatgttggcaaacatgagtaaagctagcttgtaaaataactgtgtgcattacacatctactgtatgctttattgtgatggaaattattactatgtttggaaaaggtgtcatgatcttttagaggttacatgatcttcagttaatgcatgtgagggagacattgccaaacatgttttcaagattagtaaactgaagttcagagagattaataacttcttggttaaggataagagccaaaatttacaaatcttactcatgttgactcttttttgggggaaggtgttatttgacttccatgtactgatcacagaccatcactgaggaacatcagggaaggaattcaaggaggagcagaggcaggaactaggaggaaagctgcttactggcttgttcaaatcccctttttacacaacccatgctcacctgcctagcgatggtagcacccacagtgggctgagttctcttacatcaaacagggatggagaaaatgacccaccaacatgcccacatgccaatcttagagaagctgttctttaattgaagctccctcttcccaggtgactctagtttgtgtcaatgtgaaaaaaaacaaaacaaaactgatccacatagactgtaaatgctctatgatgttggttctcactgtgtggcacattctcctacattgctaggcccgacccttcagagtttcaaactcagtaggtctagaagtaggctaaagaattaggagttcttaatttcaagtgatgctgctgatgctgggacttatactttgggaaccattgttctacgattttttttgagtcttttttagagttgtgttttgtttttaattttatgtataagagaatgcctgtgtaggggaatgcacatgtcaatgtagttcacataaagtccggaacagggcatcaggtcctctggagatggagttaaaggcagttaggagccaccagacatgggggctggcatccaaacttaggtactctgcaggaggagtgtactcccttaacttctaagccatctctccagccactgtctcccattgactatttctgaaactagtgattttatttgttttagctattgaagttttattaacaaaacttaatttgtgagagttgacatgtataaactgttaagtatcagtttaagaaacatgaggaaacaatgtttaagtctgatattaaattcttgaatcctacttcttattttaaaacatgattgactatttttcccctgttcaattctcactggaatggcatatgatacgtggagaatctgcagtctagtcccaaatggctagaggacaaaagctgctttcatgtcgtttctaagcagaagctgaaaggccaaaaatcactggagaaatttgctagggtgagatttttttcagttcaattttattctccctcgaggttcaaacaaacttcagataatcatcttgaacttggtgacgaaccaaactcagattcagactgtggcttctcagagggtcagcccttccatttagaataaggcacagcttaaagtgacaagccaaatggggtcaaatgttcaatacttggtgaaaggctcagctgtcgtattgaaacaatgttgacaagatggcaggctttaaaataaatccctgtggaggctattgatatcattcttgccttcccttctgtctcctagccagctgcttctttctacagtactgccaatcatgcccagtgcttgctagaggcagcaaggtttgtacaacatctccccgtgctgggtccagcaacagaagctagctatgggcattcatagaaggtgacattcttgattcctcagtacaagacaaagtgagctgatatacatctacccaatcaagcaggtacagttaccatggtccttacttatcaacagttaacccttttgaatcaacgtcattgaataaagtgagatttggtcatggtgatttgttcaaactagtccatgttaacagtttgaaaataatgagtaatttcagttagggtacatttttctggaaagcaagaggttatgaatcatgaagagttgggcttagagagatggctcagttcaccaactgcttgcctggcaagcatgaggacctgagctcaactcctagtacctgtgtgaaaagctggcttgtgtggtgcacacttgtagtaccagagctggattggtagactggaagttttctgaaacaaacatagaaagtttagaacaaatcagagtgtccaacaatttttttattcaataacactgagtcagaagtgttaactgctggtgagtgatgcccatagtgacaatagctgcctctgaatttttggcagatgtgaagaaagtagactaattggcaagttaaaattaagataccagttacaggtcactgagatgcatcagatgggaaagatgcctgattccaagtctaaagatgtgaattcaattccttgaacccacatgatagaaagaaaactgtcctctgacttccacacatgcaccatggcatgcatgtccacatacatacacatatatgaacacacaaaatactaataaaatgtaaaaataatgttaaaagtggccaatgaagggaccctgtgttttcaaaaaaaggtgcatggcactcaagaatcctaaggctatcttctatgtgcgcgtccatatgcacacacacacacacacacacacacacggcaacacacagatgacaagggttcagaaacatatatcaactaatccttagaagtgacatcatcatctagtaagcatttagctcagcccactaaagctttgaacttcacatcactgacagttaatgtcacctgtcagcttagctgggtcaactgactcccagaacactgggtaaataaatgccataatatttaacgtatatgtgaacaggatttcaaaagagatttgcacttgatgagctaagtaagtagctaaactgattcaaagagggtagcaccatccagaagttccacagatgaacaaaaagatggaggaaggttgagtcacctctccacctgactgctgatctgagacatggatcaactgcacttggtgtgcctaccaatgtggcctagaattaaaactatcagctgttgatctctcatgcctttgaacccacagtagctttcctgggtcttcagtgtgcagacagcagatcatggagctattcagtgtgtataatcaagtgagtctattccttataaaaatttcattgtttgtaattgatatatgtgtatgttattgggtctgcttcctgggggactccaactaatacaatgatccctcaacgtatgcagcgcataatcagtgacacattgagatgtatccatgcctgctgtgaggaaaattaactttgggatacactgttcctgtttcaaattatgtcttttcctgtaaatgtaatgtaggagactaacaacatcataggtataaattgatattgggattgtttttgatgacttggctcacattgtgtttgcttttgaaatctgcatagcttctggtcctcaatgaatagtttctggcttgagtcccaaggagaatactgaggtggattgtactttggggtaagagattaatttaaaaagttgttaatgccatagatggcaacatgatgggaaggtatgatgagagttctggtccacgaggcagagagggatccccttcctacaggtgtcataggaaggaggattcatgccatgtaattgatgagtaacatatcgctcaggtctgccaggctgtccctggtatccaggtaagtgtgctactctggggacagaactgagggaaatctaactgaattgtagccattggaagcatgaggacacaacaatgcaggctctcttctgatgtccacaagtctggcaaactgaggtctatgatttccttgggatatgatttggcttttttgttttcagcaactgtaagaaagagtctattgtagctcatgttgtttgttcttgctctggggcatactccaattacaaagggtgtctctctaagagatccaagcaaatgaggatgcccaatcttgaccctgaccttcagaaccttgggcgagagtgaacatctccatttcatatgctatgtcagatattttatgatggctatttgaatcaatctaatataccaggccctgtcataatccagagttggggaactactgtgtacaaattttgttcttttatttttgtttttttcaaattttgttctttaagaattgttaaaatattggttgttggagtggcatgacaggcttttcagaaggaaacatatagtacttatttgtctcttgcaaacatttatgaatcccaatggtaatatttggtcatacagtttatcagaagcatgttattgcattactggaattattattcaagaattattattaaaaaccctgagaaaagctttctagaataatctcatctttaggctagtcatctctgtacgactcttggaatattaaagccaattaaaagattagcacatgaagggaccctaatgcgatttgatacagttgttcgctacactgtggcactttcttcagagattacctcaaaggatagcagaacagatgaccactcctgctcagcctccataactcgtgctccagctttatgtgtttgccctgtagccctggcttctttcagagaacagcattttgcttctagcaatgaagtaaaaacaatttgtggctcttgtttacttatgggcaagtcagcaacttgctgggaggggtgacctgattcggttgctactgcttatctagtttcaggtcagagttgcagtcttcctgctcagtgaggtcagaatgggtcacatgctttcagaagagtccaactctgctccttttgccagcatcacccatgtcctcttttcttgctaagtttcctgctcacatttcccagcttaaatctatggatcccttttggaatccatgcctcattcatccctatatacaccaaattgtaggatattcagagaagcatgcatgaagaaactgaattcagtaggagagacaagacataagcactggttaagcactgatcttaagttgggatcaccattattattattatgagaacagtgtcattgtctgcctgtagactatgctgtattatctctgacaacctgttgttagaatgtacatgaactctctgaattccatcctacaagtatcttaatatactgactttgtgaacatcaggaatgtgactgaactctgcactttaggtacaattgttcctcagtatacacgatttccctcacagagtagatttaaaaatgttgaaatcccatcctacgttatctgatacttttgtattccccttgtacctaacaaagagacatgtgtgtggcaaacaatctgaaaatcactggctagtgaagctagaaataaaactaacacccttaacctccgggcccagaggcaaagagtgaagagcagagagagggcatcaacaccagataaccacgggagagctgcagccttgcatgacctccctgctgtgcttaccgctaatgatcagatcttccttctggaactttctgttccctttgttttatgtatcatggctcttttcttacctctttgaacattcctgctaagtggcattttgtggttttgctgaccccccaaagattttcgtgtgtttcctacatttttttcatggcatttctttctttcttcctctctgcttgaaatactcatcttccaagactcagtttaaataaaatttcctgtttaaaggaatccaggttggaattatttgtttctttcttgcttctttttaaatagatatatttaatttttcatgtgaaaagtttcttttgccctatttttaatgtaacccagtttcctttctcatcaactaattttgtatgtgtactcccaaagatatttatacataaataagcagagataagcatattttccctctgctttaatgtaattgatagggtgtgacaaagtatgttctatacatttctgttttcacttaattatatgtttaagagggggttgtttccatatcattccctggcaactatgtagttccctactgtagcataatagcatgttgtatttaatcactttgttaccaatgcaactcagatggttcctaaattttactattataagcactcatgaaatgaacagcattatgcacatgccaccttgcaaacatataataatatgcctccattattaaatagaaatttttctttgcgaagtataacattttaataaattttcgatttttcttcatacatgttgtactaattttctagcaatgttgttactaaacctgagactttataaggttccaaagccaatactcagaaaaggagaacaaataggaaggaaatctgttttactcatggctaagcacccaaagaagacaagccttctccacaaaggcaaggttgggaactcaggcatctcaaaaaggcaggctttcatgggaaaagaaaggaagtccagaggactgcaaaggaaactgtatgcagagcctaacatgcaggccattgttgggtctgccttctttctacttttatgtgtttcagttttgatttatttctattcatgtgtatgggtatgcttgcttttctgtatctgtccacatgtatgcaggtgcccaaaaaggccagaggaaagagtaggatttcctggacctggagtaacaagtagttgtgagcagccttaaggatgtaggcactggaaactgatctctgatcctctgtatgaacaccaagcacactttcttaactgctgagccaactctccagtgtgtgtgtgtgtgtgtgcgtgtgcgtgtgcgtgtgtgtgtgtgtgtgtgtgtgtgtgtgtgtgtgtgtgtgtgtgcttgtgtgtgtgagcacatgtgtgtctgcgtgtgttattgttgttatcttgtttttctgccagttaaacctcataggaatgttgactccttgtgctgaatgatgcataggactagaataaggaggtcattgcacactctgatgctttccctgagttatcagatcttgagttttgtgacattagagagaaataaattaacagttagcagttgtctgtttggttttgtcttccttgtttgtttctgctatgggtttgggttttgtttttgtgacaagatcactgctaagtagctgaggctgaccttaaggtctgctgtctccactcgacaaatgatgggattagcaattaacatcttgcccattttagtgtagcttctccagagttaagagtgctagcaaaagtcaatggatacctcacaaaggggtgaacaatgctaagacttgggagagcttcctttccccacatttttggctccatggtatatgaaacagcaatccatttagtttaagtagggaagagtttcaacgttcatataattgtccttttatgattgaggttgagtctttttcatattttaggagttacacatatatccttttagtgaactatctgttttgccatcacttttgttctgtgagataattagttctgtgcatttaaaggagagctttgctgacggtgagttagattttgctgctgttgttggtataaaacagcaagcttcttagtgtgagcttttgggcttgggactcttctaattattcacattctgtagttgtgaaggggtaggggagttagcttcctgtgtcctttgtgtttctaatctgaaactctgtgtaacaaatgacaaatgagtaagagaaacaaatcagttcaggtcaattagctcatgtgttttcttaagtacataggagaatccagggagtatagactctagacttaatctcaaaggaaacatttaaactacagtcttaaatagcattgttctctgaaacaaagaaaggattgagggaaaggccaggaaggattagatgacaggggcattcatgccttagacaaaggcaggctcctttccacagatctaagacaacctcttctccagttcaccatcctctgcaggggtttcagagaacagtaacttcgtcaaaacaaaattccaaagttggagagatggcttattcagtaagtgctgtgctgaggtttgatcccctacatctaaagccaacacagaggagccagacacagaagcggggatccttgaggtttgctggtcagccactccaactgaattagggagctccaggttcggtgggagtctctgtttgaaaataattatgatgatgatgttgttgatgataatgtggaaaaagatcaaagaagacagctgacagcaacctctggtctccacattcacacatgtataagcacctgcactcaaaggagcacacacacaaacacatacagtggagatatcctctctagatagcaatttctcttaaaaatagttaactccaaatatgactctcatattcaacatgctctagaggtatgttttagactagcatattctgttgtgctttgtgttgtaatgtatcatgaattctagcatgacctacgaactattattttattacagaacgtatcatagtattgaaagacccccgaagaggtacttttgtagagggagacccacacccaggaatcagcgaggccacgaactggatgtaaaaacaagaggctttattggagatgcgggtacccggggcgacttagcttttctgaggccaagcgcgccaagccaagggaaaggggtccttatatagggaaaaaggcgcaagctaggagcagggattctatttgatggttcaaatgaggcacagagccattccagatcagcatattctcaaggtctggtgtctggtacaacagacttgattcctccctccgcgcccaggtggctgaccagacagagaggcagcgggcctttcagtatgtcaaaactgttagtgaatttgctactctaccttgaaaaaaacaagaaatggtatcatcttgttcagctgtttatgccttttgcacattaacattatgtcaggtgttaaaaatgacagcactcaattatctttgaatgaatcattgtttttctattttcctttggattgtaaactggtgctacattgcaattgttctgggagatttgaggtcggagtttggaccctggccacccattctcaataggccaattaaaaagatgagtaatagctaagagcaggaagatgattgattcaatgagatgattgactcagtgtagtcataatgaggagagaaacaaataactgaatccagcgactactgagtttgtcttgggcagtagaatcgagagtcaagcagctctgtccatcatcatcatctcagtgtagtctgacaagttgttggaaatgtgcaaaataactgtctggaagacaagtttctcctctaactggcaccacagtcccaactgttttattcctcagcataagactcctgggaaataccaacttcatggactccattatttaaatgtctgacagccagaggaagaagtatctcttttgaatatcttcgttcctgccagaatggttacaaagcaattccactggtgctagcatatctcacctaaatgacagccatcttgttaacatctcactcttccactggaacttagaattgttgtttaggtacttttttttttttttttatcttgagacaggaggtcaagctcctgaattcaggtcctgacttcttatctctggcacctctttcttccccaaactataatgtggaactttctttaaacttaatgtcctatctgactaaataccaggcgcattccctcatattctccaataacttgtcaccatttccagaaactctaaaatcttccacccgatacagatttggacactgttcatgttctaaacatctggtttttcttccagtcttatatttgccagtctcctgtgcataggcccatgataaattcatatgacttctcctgttagtctgtctaacatgtttttaccagagagtagaggggaaaatttaacttccttatagctccatttcatctatttttcagatattcaaataatgaatactgtagatcagaatatgattgggagagcataaaatgctactcccaaacatgtctttgcaataagttattttgagtgttaagcaaaagcttgaactctatctacctctgaagatttacttttatctctaagtatctcccataaatacatgaggagtagacagtaattaacttctgtttgtccttcacttattaatctatatttaattatgggacatcttggctgagaattctgaaaggatagagatcaaaataattttcatcccataactaacaaacttttttgacagactggtttttattacagtataacttcttaaatttcttcaagaaaaaggatatggatgtatatagtggtggggagtgtgtaagtgaggatatataggtgtgaggaagataaaagtgtgtgggatatgtatgtgtgggaatataggtgtatgggtgtaggggaagtgtacatgaatatatacatacttgtgtgtatctttgtgtatatgggctggagttagaacagctaagctaacataaagcatttaaatgttggtgtctttcttaatctataaaaaaaactaagtgcaaagcatacccttctaaaagataatcaagagttggtgccaacatctatgcctgaaagacacacacacacacacacacacacacacacacacacacacannnnnnnnnnnnnnnnnnnnnnnnnnnnnnnnnnnnnnnnnnnnnnnnnnnnnnnnnnnnnnnnnnnnnnnnnnnnnncacacccccacacacacacacacacacacacacacacacacacacacacgcactaactttgaagtaagaaattgcctctcagtaaatccaacagcagtcagtataacttttgtgtactctttagtttcttttgtatatattcactaaaacatttgtagaatatcttttaaaaggaaaatgtaaacatcaagtatcttagaacattagccaattatgctattacttctaaagtgtttctgctttaaaatgagaacaaagtggtttctctcatagatacagtcataggcaggaggattatggaaacccagtttacatgttcacctataattttcagttttctgtttgcctcaggtcttgcagagaagccaagacggtgtcttgctttgtttggtcttgcagtctctgcctacacacaattacgtaaaagcaatgtgccatgactcacctccttttttaagttactgatgattgcacaaaaagtaaacatttttcctacagtgctctatagcaaccaaatgtgccagggcaaggaccacttttcaagtaaatgaaataaaacatatgggaagaaactaagaactcttgtcaaaattattccactgtgaaattagttacattccacaagaaaatataatcatgccaggggttgctttcttcagtgactctcgcataaactgtagctgggaagaattcctagtgttcagcttcataagctgtcagtgccattggctacctagactcattcatatttgattattttcagtccactgccatttctatacagccctggtggatatttctttggttcattgaataaaacattcgcatcagtctgtgattgtgttgctgttgtccccgctataattaacacagcaacagattttttttaagtgctacttaaagtaactggtgtagagttcacttccaaatagaatacacattaaaaaaaaaaaagaaagattatccaccagagagcttccaaatgtactgcaaactggaagcgtttcagagtcccttaaacacttggctagaagctagctaaaccacctctctcctgtcagcaaagcatgaagctttgagatttgttttagcttccatctagtctctgccagttcaaagaaagacttccaagggacaagttcagagtcccagttttaatggtgttgtctactttctttgtcaaaagtagtacatctccctctgaaagatgtttgagtcccttttaaacatgacagtctaaaggacactctgagaagatttcccaactttcattctcagttttcttcttcatgcagcccttctcacattcctagagctgtgatggcaccatgagaagataaaacaataccccctatatttttcttataacaatatgctatgggaaacacccttatggacatgtgtatgtacacagtagtaaaagaggagaacaggtgtgtgtggggttgggggtgaatgcagacagtaaacctctgtactgaaaaaaaaaaaaactctgtcaaatattcatttctaatcaaatcaaatgtgattttcgcagcttgtcaaatacctatacaagatgaggctagactttcaaatctatgttttaccagtttcctatatgtgtctcatattcctagtaaacaaaattgctcagtgttcctgccacccccagactccccaaccctccccgtgccttcctgccctgtgctctcattcccgggatttgcagagaattgagccctgctagcccggataggcaacaagagaaaagaaacagataagtgtccctctaatcgaaccttatcaatgggtggcagggtagaactgagggaagaatctgcacacctctttcatcactgaagagaaaaattatgccaagattctatgtggacagagcacttcagcgagtgtcttaagaattccataatgcaacctgaggagacagtcgtgtattgattagcaggatctgagcacccctctgagagtgtgcagacaggagaagtgaaatgacttctggtaggcaagaatgaaaccaaagacaagaagggaccagaagacaaccatgtgcttacacccacaaaacattgtctgcatggagtgccttcatcttccaggtccaattctattagttcctcaagaaccccctagtaacaattcttcctagaaatctttacctatcacatcaaaagagtccagactttcctcttccacaagcaacccaacagttctagaacttcttgatggctttccttaatacattgtgggttacagtcatttgtcccaggccttcactgtggcacttttaatacattttgtggatgtgctatcttaatattattgcaactacatattatggcatataactgccactcgacaaatatggctactatgattttgacatctgggaagagcaaatatttccatactctgttgatcaggcaaaaaaggtgccaagatccaaatatatcccttggatgctctcccagttagccaatattgttagacattctccaatatgttccatagagataactcgatttgtttggcttatattgaatattcacttgcaattcaccaatgacctggtcaatgaatatgataatttatagtgacaaaattattcactaccatctcaaggcataaaaggaatgttggatacacaatatcataaaacaacaacaacaaaattcacttccattttctcttcaagtgttcttggcacaaccaggagaccatattattccaaaaaaaattattgactccaaggttaattgactttctagttagattaaaatatagcttatttccatagttgatttagcaatcttttcttgctatcttagccatgaattaaatgcaccattttggaagtatatattagaatatgtaagcaatctaatttcatggtggaatacacaggaaaaatcttcaatattagaagtaaaatatttcttcaatgttctctttgttaactactaagaaaactaaggttaagttttcagccaatctattagacactgtgaaatacattttatgatttaatattaagtttgactatttttttctggttaatttccatttctccaatttcttaaagattggtattctataagcttatataaatacctaaatggcatacatttaatgaatataaatataaaactataaaataacactaataaacacaaaactcaagcgatctgttcttatttatacctcaatatcctaaagtcaaatagtttgcattgaaatataatacaatccaaagaggaaataaatgactgcttttgcctcttgaaagtaaaatgatttcaaaactaaatgaggactcaagaaaactctgtattggtagatcccttgttttattctttaacgtcaaggcatgtcatttacttttacctctcattttgttttctaaaaggtgtagtaaataaaactttcatctcaccatccacctcatttggcaattctctaataaagtaaaaaggtgaggaaacctggttttcaaatacctgttaatatttacagagcgataagagtacaagaatccaaagagctcctgttcattaaggatgctactctccaaggccaaaggaatgcatcaaggaaataaaccacaaatatgattcacagtggaccactcaatgctcaacagactctccttgaaaccccactttaaaatgcataattctttcattaaaatatgttgaaaagtcagagtttgaagctccaaattattgtaaaatcttaacctattttctttttgtcagtatgagatatattcatataaattatttagggttttttttgcgggggtggggtgggcattgagacagagtttctctgtgtagccctgactatcctggaactcactttgtaggtcaggcaggtctcaaactcacagagactggacttcctctgcttcacaagtgctagcattaaaatagtgcactatcaccacctggctaattatttagtatttattggcatattttcatttctaattagaatgtaccaaaattagcattgtactgcaaatgagaagtaataatcttacactaaataagaagtgctggaacatgaagtccctcctctttttaatgtgcagatctttccatgaagctgtttatgaaatgaagttagccagtgctactcctgactcaaatgaagcatttgctgtaggggaagctgtagccacgcctacttaggggctggctacaggtgtgcctgaccatgcttgcgagggcgtggtcagggtgatgtagaatgactgcgttttctctttcaggttcactttggtacttgctggacagactgctgctaatcgttcccaatctgtgggtgtcaccctgttaaaggttgcccatgaatgtaatagctgttttacgtatgggctatggagaccatatgagacaactgattaatattcttaagatccttcagctgtataggttgccattcataagccatccatccatgagtgtgtttcttagaagctggcttttctaccatggtagctgggtacactaatggtgtacgagtaacaaccttagaagaatagtcacaatacctgggtggagtaggtgcctgggattggtgtgattctgcttctgaggcatcccaatgatctttaagcctagtaatgatatccttttgaaaagtttcaatctccttaatcataaaagattccaagcatgttagtgaatctgtaaattgctctaactgctcatttacatgtttttctaggtctttaatatgatcatccttaggcagcatctggatggcatggaaactgccttctatgtattcgagtctagattcgaggtcatgatttgctgattttgaatcctcagcagtcgaccgtatggacctatgtaatctgtcagccctgtactgtaaattatcttccaaacattcaaatctagactcaaatttgtgatctgctaccttggatgcttcaataattgattgaatggcattgtccaattcttcaaccctatcctgggtattttgcaccgttgcatctagttgctgggtaacattgcctatctgagtttctatctggctacatatattctctagctcctcgtggtcttctgacagcctagcctctaaggcctcagacatggaggatctctctgtgtttatcttatcatcaatatactgcatctcatcttgggtaacagacagctctgtctttagcatattagacacatagccaagcttatcatccaatttctgttccacttgctccacagttatggtctgacctaatctgttctccaaaacatcattgcgtaaagatgttatttcctgtaagtagattgtgaggttatccttatccctattcctgagtcctctggctagtaatattatttgtaccagcaagctaactgccattatggcatataggccagtaattggcaaattagcatcctcctcaaacattgaattcacgtaataagcaaaaatattaccaattttagtaaatgataaatattccaccataattttacctgatttctattccagatgcagtaactatctttgacgttcagttagtctgcggcgtttggcagcagtcggtcagtggtggagagaggtcacaaaagcggctgtgcttatcttagagagtatacggccttgcggcagcaaccactgaaatagatgtggctttactggagcagcagtggccaggggaagcctctgctgaaagccgaggcctaccccaactctaggcagctagaaactgtctccgagctgggtggatggttctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggcatggcagcagtctgtccagcaagtaccaaagggaaaccgaaagagaaaatgcaggcactccacatcaccctgaccacgccctcgcaagcatggtcaggcacacctatagccagcccctaagtaggcgtggctacagcttcccctacaatttgctgtagaaacagagggcattggagtgattccagaagtgaggaaagtgtctcatgtgagactcacctcataagttatcaccattctgctctgttgcctagctggatcaggaagaggtggacagtctactaacatagaacatacagggcacagttatccaccaagggcgtcatatcccttcatggctggatgcaatgactcttggcatagaaacttctttaataaaccagttactgatgctgagtccatcactaaacttgaacaaatatggcaagtagtgctttcagtcatctggtggtaactatcacgagccagtctcttacaacaataactgggcacctgcagagtctgatttccgtaaagtagcctttttacttcagcacaaaaagcccattgccttccttgcgtttttatggagtcttttggcattttcctgctcaattagaattgtgaacaatgtgaaagcagaaaatggagatatcagtgaagagacacagtgttgaaaacaaacttcagagtcaactttttactcaatttctctctctcttaatatttatttatttccatttatgtgtatgagtattttgcatttatgtatacatgcacatccatcatgtatgtgtcttttgcccccagaggtaaaaagagaacatcagatcccttggaaggagagtttcagatggttgtgagccaccatgtggatactaggaacctaatctgggtcctttgcaagaggtatcactccaaccttctggttcttttgttttgtcttttgttgtttggttttcaagagtttctcttagctttggagcctatcctgtcactcactatgtagacaagaacaactcatatgtagacaaggcctcaaagtcacagagcgctgcctgcctctgctctctgggtgctgggataaaaggcgtgtaccgccaatgcccagctcattgtgtatttttaattaaaggttataatgtcatctgttctcacagtaaggacagaaaagatatttccaaatagcaaggttagaacttgtcacatggcggaaataattatgatggttgtaaaaaaatacatattgaagaaaggaactcatccattcctgtgggtctatttccaactgcaaatgtattcttcaaactatttgcatcctaggagtttgaagagatgtgttttcgtttcagttctatgataaccctggttgtgcactggatttgaaaacacaatagatcacacagtgagggtggacagtgccgatgtcctcacattctggtttttgttttgttttattttgtttttttgttttttatttaagttctctttgattactaaacattaagcatagttatatacaccatgtcaatatttggtcaatgacagacctcaaatgttatggtattcccatagtattataatccccaacattcaatggcattgtggacatggcagcaggtgttgcaacacattctttgagtccttagtgatgcagaagtaaactacccacccactggaatatgtatagaaacacagtagtacaattacatataacaatgactcatgacaataacaaataattgcgcttatgggttttgcattttctatatattgtttatcatcatttcagagtgtactgtttcttcaaaaaagttaactataaaatagccttagcttttgtgtattcatgaatacaacaagaagtcatgtcagaaaatagcaaataaagctatctatgtctctaatgaccttctttcagtcttctaaaaaatgtttattcagccactagtagtacatgcagcactgtggtagattttatcataaaaatatcaaaagaatttgacacatgtgtttgaggatctcagggttttcctaaaaccaatagttaaatcaatatatcagataaaaggctgtaagtacatgagaagcgatgaatgtgtttgaggaagtgtgtagtagaagggccaccaagcaggagaaacagaagacaatttgtggaataggacatcctgggaaaggaatcttaaaatagttgttgcatccccatcttggtatatatccaaaggaatcacaattcatacatacaaaatatctacacccttgtgtgatttcattcacaatagctaagatatggaagttgtcaaagtgaccacaggtagataagcagacttagcaatgtgcttagtgcgctcagtggaacccggtatactctattcactcataaaggagaaatggaatcatatgtaacaccataaatacacctggagaattttgttcaaagggaaataagtaaagggagaaggcagataccaggagatcccacttaagcagaaatctataattttgattgcaaggatatagagtagaaggttaacagaggctgggcattagagtggggtagagaaagtggaaatttgaccaaacagcataaaatctaacccactctctaagaataagcattagtcgtctatagtacataattgacacaatgtggtatacatttcagagtgatagaagagtagagctttagcattcaccaataatttattaaataaaaagtgatgggctgttcaggtggttaagtgtgttatttggtctttatgcacttttttaaaataaaacatacacataaagcattttcttatagctcagaaacatatgcaaatgctatttattgacttaaaaacaaattttcaaaactgtgattatgtgaattaatgtataagtttatatatgaattaacctgtggaatacagtgaatactgtctttcctcaccaagagaaggcacaatagcatttagggtccctatatcttccttgtactctttcactggtttgcaggctttatttcacaacctgtgagttggttgatcagcatcctagtcatcatgggttgatgttatcctgtccttctatttctttataataaatgtcagaatctctgtaaatattctttcttgtgggttatatttccatatcgttttatcacacctgaatctgacccagggcatttgtaagttcagtgaaatggatgctttcaagaggacagaagaatcacatatggttcaaccaacttggcttcttttattctccatgacagctggtagaaaggaacatggaaaaaatctgtgtagcacagacccagaaggaagacctcacgaagtccctcaaatcaccaagatggtggcctgcttcttttgcatgagggaaggcatggcattcttcctgctttctcttcctgaacttgtcctttcaggaaagcagccaaaaccttagcaccagcctacactgaagttataaccctgaacttgtcaatcttctctccctagacagaacctaggaacctgagtcactgaatgaaataaggatgtgtacaagcccaggtgcagtgcatcctgaggtcacttctgctgtgggatttttagcaatcggattcaggagatacctgggtttcaatgtggccatttatgtgcagcccgcattcatcaccttctccttctcagctagctctctcttcaataactgcaacctacaaatcaatgctatatgtaaaccattgcttacattttcatttgcttaaacacaccttgtttccaatccttctcctgtctaagaaacagggtggtaaaatggccacctacctactagaccacaagctctgccttcttcagtagctcactaaaagtctggccgtaactcactcccactatcttctttcaggaacaggaacatcccaccactttgaaagaaggcaattttcctgtaatttcaaatgtatgaaaagaaaaatttttcttgcagcattggcagtaaactgtacaaacaataaattgttctgaagattgattatgctcccaagtgttcccatgaccattaatcaacggcatcagcagcttactacatacattacctgtcataagcaagtaagaacaaaaacagaaccaacaaacatggctaaatttgcttgtaattcaggcagtcttaggaattccctgaaaatggaaagcaaagcaggccctatctgatagaacagaaacctgagcatttcccatttttattaaggcaccagcagagtttgattttaaattgtgaattttatatagactttggctcataatgtgatccaattttaaaagttttgctatcattctccactattgctatgcatctttgagaaaaattactttatttctctatttttctacaccatatttctggttacaagaataaatataagccgaatgtttaatatcatctctttagcaagcatttcgatcattacaaagttgatgtgagggtagctgaatacctaagaaaacaaaatatttcagtgaagtcaaataaagctgctgtctctctatgatcagaggctgtcactgctctctgctgccagccctcatgggttctgggactttatagagagaagttcagtaacaatgagtattcctttattataaggatgaagtgaggtgtattttgccatgttcctctcatagcatagtctctggggaggctagaagctatccagtttctagggaggattctgtgaaaactggacttgttaaaataaatgtcaataaggctatttgtaagatcaaaatgctttaaagtgtgaaacctgttcaatggctgaagtaaaaaatgcctcttaagaaggaatgaagtacagcaaaagaaacattggctaattcctttttctaggaaacctagttggttcaggttttcttctgataaataaatgaacatgaaaagtagtttttaaaattatcctttagtcttaacttctacaatatagtagacaaatacagcaaggctgccaatctatacatccattcttcaccagaaaaaaatgccacagtctcaaaccctgccttctggggggctgggtgggtgagagatctttatcctgtcaacaagatagaattccaggagaaagaaagatatttctgggcagttctacctctaagaccactcctaaaactgttccagaagaaggtagagagaatggctagcaggtaactgcccagggtccaccagagattttcaaatccagtctttgtctcctaggaaaacttaccttaaaacacagaaagcaacagaaaactgcaaagtaagaatgagaggaagacttgactacaatacaagaatgcatatgaaatagttaaggataaaaataagctatattttgaccacccaaaagttaaataacagtgaaaatgtgcttactactgcagcgagggaagatgtgaccaggaatccccctgaaagtcatgctgtaaccactgtcctgcttcctggttcacttcaaaatggcattgcccctgcaaatgctcacatgcaaacacttatattcaaacaattgtcaacaatcatctgaactctttttcattcccccttacctttgtaaatcacatttatttcataacgttagactcaaaccagatgaaatcccctgacaaaagaatcgaacaagtccaaattgatctcttaagtggatcaatagaaacttaaccgaaatggattggggattttatcaaacttgatgtagtagaacactaataaaatcacttccaattcacacatatggagttaaattctcagcacaaattgatctgattaccaaggatgaatggtcacctttaataatggattaaggtagtaaagaattctttctctgcacacaaacgtgttccccttttaaactcatgaagacagctttcacttttctacttccacaaaactttattcatatcttaagtgttcagatctgaatttagaactgtctcaatttgtaaaatttgactctacttggaagtgttttcaagagagaactttggagacgctaaagaagccatgagacttgtattgtcttaggaaaccatggtatccctagaagttacttgtaagataatataaataataagaaacatgttaatatagcagaagccttcttgttggaaatgcttgctttgcctattttatattgactagtttgataatttatgtttatgcttttgaatatattatatattctaacttactaatattccctaaaggaatttatgcattaaaaattcgtgaccatcatgacactattttggagtaaagatttaatgtggtgatgaattaaggttcaagatagcatttctccaagaaagaaaacctctatctgtttcctccccatttgaaatattaaaagtctccatttcttcaacattcaacagcagtatcaagtgttggctctagaatatacaaggaagcttcacttctccaatggagggcaagggtattaccacagaatgctcagattctgaaatatcttgtcaaccctgggccagtgaatgcacttgaatgcaaaccattaaccaccccccccacacacacacacatcattctctgtgctatcattgctctttggtctttgacacactctctaaatcttacttcagttaggaaaataggccccaaagttgtaagcttctctgtccaagaaaacatatgaaataaacagtcaaggttgagcatatgtctgtgtttcccaagaaaacaaggtcctctaaatcaacagggaatgatgcacatatgaactcacagagactgaggcaggacatgcaggcaggcaagtatcttcaacaggtggggttctagaactgaaaggagatgtgcacccatgcctccatcctgaacacaaaagcaatctctaatggataactacttgcaaatataagtttaggtttttccaagggagtctcatggggaaagaatctactcttaagggtaggcttcatgcccagcaatagataactacagaaaatgaactcaagaacacctttggcagttccttgtttcataatactgtgtcagggcttttaaaaaatcttattttttattttatttatatatattttcctcttttttatactacaggtcctttttcatatgtattatggcttccagattagtgattttcagtccaaaaatatatgtagtgtttccaaatagtccccattcttcagctgaaagtaatttaggaattcttcactatagtgtggtctttagaaacatctacagtacttctgttagtatttaggcatttttactggcttgcctttggagtgatctatgtttcttctctctgcagtgacaaagttccagaggtaatggccacatcactctgaggaaatactgtagggactagccatggagaatagccagaactaattactgagaacattcacaagagagaaacttttgttatcataagtcaatatgattttagggccattcacctttaatgtggcaaaacctattcaggcaaatctacccttgccacagctttcaccaactgatggaccatgtaacatatgatgacaacaagaagtgcctgctagagctgtaagatccacactatgaaagagagttaagagaagtagttttctatgtgaggttgaaaagagaatatcaggaagctataagcaaacattgggtctttttttttttcttatctggttcatgttttaaacattttgtaaattgttattttaataactttattttttatttattattgcttattattacaccattggcaattaatttatctctatcaatgaaactgtaaaacttttcttcactttgataaccaggtttttaatgtatcatcttagaagtttagttggttataaattttatagtttttaaagcaactttttgtaccaccctttgaattagcttgaagcttgattattttctgttgctatccttccatatttactatggtacactgcacagagctaacagtaattgtactagtcaactgcaagtgtctcacacatatattttctctgactcttaaggaagtaattgacagatagaagatagaataatttctgaatgtcaattgcattaatgtttacattctatctgtaagaaacctaagtctagattcctccaccgccgactgacctggaactaggtgagtgagttcctgcctgctccccacccaggccagaacaccccgaccaccccatccccccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccccatccccccacccccgcctgtgcctgcgggcttgggccagacacgcccaggcagggaggagctccctgcgccccaaatctgctaacaccccactcttccattccacagaacgaccgaggaactaggaactagtgaggagaccaccaggagcgtctagatcatctagagttgtggacattgaattcctagcccccacacaccactgggccacaagaggagatagagagaacccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccgtaaaaaggccaaacctaagaataataggtgtagaagaaggtgaagatcccctttgacctacaaggatgactcgatctgacagtccgggcagtggaggagaggatggcctagaagcccctcccctagaatgagagtgatgactactctctatgctatactagagtcctcatccagtggctgatggaagcagagacagacatacacagaaatacactgagctgaattctggaacctagttgaagagagggagggatgaagaatgtatagatatgtacccccattttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacagtttttcacagacattgaaagaacaatactcaactttatatggaaaaacaaaaagcccaggatagccaaaacaactctttacaataaaggatcttctggaggcatcaccatccctgaatcgaattgaaaaccctgacattgacccacgcacctatggataccttatctttgacaaaggtgctaaatctatacaatggaaaaaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggaaacagagacagacatccacagatatacaatgagccgaaatcgggaatttagttgaagagagggaggaatgaagaatgaaggggtctgtcaaggtggagaaacccgcaggaatagttgacctgaacaagggagagcacatcgataaaaaaaaaaaagaaaaaagaaacctaagtctaatgtgtcaaatttcatttgacatagaaggccaggctttcttcagtgttcattaagagacaatgaaagaaaatgtcaagaaccaatgttttaatatatccaaattaattttttccttccatatccaagaaataaaactcctaagtgcaatgcaattttacaagtcaaaattatgacttattgtcttagtcattatcttattggtgggaagagaaaacttgatgatggcaactattaaaagagaatgtttttttttttttttttgatttggggcttgcttacagtttcagaggcttagtcaattaccattaaggcaggaagcacggtggcaggcatggcaggcagggtattagagtagttgagaactacacactgatgggcaggcttgaagagctggagcctggcatggacttttgaaatctcaaatcccaccacaaaatgatatatttcctccaaggctatatctcttccaacaaggccacacctcctaatctttctagtcttatcaaagatatccactctctggtgactaacataggagtctatggggactgttctcaaagcaccacactgacctaattgtgaaaaatactagggatcaaagaaaaacaaaacacccataattcatgtatagatgataaattttcatgcatatatctagatgattgtgaaaatgggtaaagggagaaatattaacatcactcaagtgatgcagtataactaaattccaaatttacaaacggtcatataaggataaagtcatataaggataaaggagagtagtggagcaaatagccaaatttctggcttgtgcaatgagacaaatactagtatgagagaaagaacaagtagagagacttgaatttaaaggccagagtctcatataaaggtggaagtcagaagaaaaatcagatgtgggaattgatatgtatatatttgtttgtgtgtctgtaagtgcagggataatgtcatacacttaccaagccagttggtgcggtgctaataccatttattaacttgttccattctgtgatttaaatttccaagggaagagaaaaccagaggagaaatggaaatgttttaccgagacactgaagtagtgaaaatgaatgcttacacaataacatgctttaactcatttggaggaagtgctggccattaaatatagtcaaaacagacactgtgctgtgaattacaaggtcgtaaacatccctttaactggtatttgacttgttagagtgtaatggtgggtggagagaagtatcacaataaatactagaagacaaattctaggcctgtcagtgaggatttcttatgtgttattttcacttaaacatggaaggaaatgacaaatccttaagtagagtgaaagccaacttaatgaagtccttatacaggccagaaatactgaatctgacccattgtccagacagaacaaatttaagtcaaatctcagcccttgtgcttctgggctaaaagtcttagtcaaatatccttccagcattgtatttgttgggcatattagaatggtcagaatcttcctgtcataagtgttttatatttttctcaatgccatggttgtctgcaaagtcctgtaaaatttattgggtttgctccatgaagatgtgctgaggattaatgctggagttttgagtacagcaataaatctaaagcaaataaatactatgaacttctgaaggttaagaggccttcagacaggctgacccacctttcagcttctaaagatgaagcaatgagaattggggttgatccaaacttaccctgtcatcataaaatcaaaacatgtcaaagatggtcttctcatattcatttctaaaaagcaaatgtctgtgaatgaacatgctttaagaaattctgtaggtaatacattttaccatttaattacatttctgttttatttcagataccttatcataaactagtagcccaaaaattcaagttcatcttccctgtatatcttagggaagtagctatatgacttgagttgcaaatcctaaaaaactagaaaaaatgccaatgctattccaccattgatgtaattccaaagacttactgtctctcagtgtcatcaatacttacagatccatccaaaaagaaaattgtttctttaataggaaatgaacacatctctgccctatctctatttcagtaatgctgttgaatatgtatataaacataaatgtaatattttggcaggatgtccagctttctcccattttttacattctctatctctgtctattccacccttctcctttccctcattattccttctctttcaagaccaatcaaattgctttcttaatttcaaatctgacatgtctgctgtatttcactagaatgctcaaactggaaataaagtcttctttctagttgatagcaccaagttcaagctctaatctctagggcaggagttttcaatgggaccttctgagatgaacagtgatttatattcctctcaaacacacaacagacacaaggcatttgaaatgtgggctagtgcaagtgaagcactgaatttgtaacaaattaaatttaaatcattccatgtggttaatggcccttatttaaggcatcccaagtgttcagatgcaaatatatgtgcatatgagcaacactaaaggaagacagctaatttgtgtgtgtgtgtgtgtgtgtgtgtgtgtgtgtgtgtgtgacaataataattaaagaataagaggctatgactatgagagggggcaacataggtggagttggaggaagaaagaaaggagaaatgatttaaatgtagtgctaatatctaaaattctcaaaacaaatagtcatgaatgtagaagggaggctactagttggaagacaaagaggattactggcagtgggtaagaaaggataatggggtgaatacggtcaaaatagaccatgaacataaaaaacaaagtcatgggccctgaagataaagtgccttccctctgctaggtactacatacttacttaatagccagagcttatttgcaatcaaacagttaaacatactttcataggattcatttacttcatatgaattatcaaagcacacatgagcacaccattttagcagcacatgttcaaagtagttcataggcaaacttctgccattgctacatagagttaccataaataaataagtcaataatttgaaagcttattttgatgagaagactcaaaaaaactcacatttttttctcccctcggaggcatttcatagacaaagaaagagaagtgaattgaggacctgatgcttaccttttttcttctgacttgagaaaccatgtccactggtgttaggttaaagcaaccactgttagactttaatggggagaatgtgtttctgattgtcattcaagataaagctcactgtttgatctaagtccaccatcaatcacaaaggagcccttaaataaaatcttaatattcaatgcaaattatctatgttataaagttttaatgttgcagagaccagatccccaaaacagtccaaggcagaatgtaaaacaattatttctgtacagactatatactgacaatgcttaggataagggtctaaggaggaaatatctggaataagcataatagcagaattttgcaaaagcacatgggacctctttcataagaatgggttctatttactgagaagcaatgctcagaagtttttaaaatgtaaatataattttgctataaaactcagcaattaaaagtgttataaaatacatgctgataactaaaataaaaacagagcatctttccctttgttaagagattattcttattctctgctgttaccaaatgtaggcatcccaaagaaggctttgggaaacatggtttcaaatcactgctctggccttacctgcctagaccttcactctttactgcccccctatctcacagtcctcaactgtaaatcatttttctccacacattgtgattatccgatggactgccatttttttctttttttaagtagtagtctttttgcttttttaaagatttatttatttgctgtggatacagtgttctgtctgcatgaatgcctgcagtccagaagagggcatcagatcccactagaggtggttatgagctactatgtggttgctgggaattgaacttggggacctctgggagagcagccagtgctcttaacctctgagccatctctccagccccacaaccattcttgaagtcaatgaaatcaaataccagcaagcgatttttgttagttcatttgcatttactttccatcttaatcagccaatacctcatatgtaaattactaaaccctccaagatattttttcagctcatgatttttgatagatatcatattggtccaccaaaggtatttgcactctcatcacttaatgctattagtgtgttaccttgaacagcaaaaggctctacagatgcaattcattaagttcaagctgttgagatcaggaatatttgaagtccaggtgggtgagcacaactcagtattgagagaagaagaatcagtcagagaaagaaatgtgatcacataaacaggccagagtgatgtaaggatgaggtcataagccaaggaatggagaaactgggaaaacagccagcaaacagaagaagcactaatccactgaatcattgattctagtccatggacttacttcagacttctgagcccagaattgcaagataataagtcagacctgcctcaagccatttaacatatggtaatttattatcaagacaacaagaaaggaatatatcccctcatcttagtttctgtgtccacagccctggttatagtctgtctttcccaaaacacctgccagtctttttactgcattccttccttttaaaaatgatttgtttatttattttatgtgtatgagtattttctctgaatgtatgtctatattccacatgcatgcctggtaactgcagaggccagaagagaacatggaagttacatatggctgtaaactgtcatgtggatactaggaattgaacctagaaccttggagaaagcaaatgattttgacagctgagacagctatctcttcagccctactagaccacttcttagcctacttaacagtagtttctctataatcagtagtctcctcagcaaaggactcctgaacactttctcttgtatcccaccccaagcaatcataaaatttcctcatgatgaccttcctttacctctctcaacaatctgtatcttccagtcttgcttgcaaacacatacatgtccctctttgactttccaagtggtgcaacccatagctaggattttcccaaaatgcaaccctccacacaccttttcacagagagtctccaaggccttgatgaataattatccctccagagtgccacctcttggtttcttagatgtcatgagctgtaactactggatgtgtccatctatccatctttagacccttcaccatgtactttggacacatcgattcatgggtctgtctgtcatcattttttaagatatgatgaaatgattactaaggggaggaagtgacaattatctgtggttgcatggcatacatcttgacacataatagttacatgttatatgttgaaatgagctaaattattgaattaaactatgtaggattgtgtatcccttcaaagattagtttctaataaaggaagggagattgtttaacacttaaatgaaataatactgagaagctgtgatagacatatctgtccctagggaaataagttttcatgtgtgctataaaatgtcacaattcattctgtcatttatatcctggtaaacctctgcacaacaaggaatagtagaaaaggaatcaggattcagtgatggattttaagttcaaaaatacaaataaataggctggggagatggctcagtgggtaaaagactcaacaggtataaggacctgagttcagatctcaccaaacatccttgtaaaagctgagtgtggtagtgagaacctgtttctcattccctgggtgatggcagaaaaagaggatccatggagcacacaggccagttagtctagtcaaaatggcaaggtccatgttccatacaaaacggccatccctctggtctttgcacatgtatgcacatgcatatactacatatcatacagacacagacacacacacagacacacacacagacacacacacacacacactcacacacacacacacacagagagagcgagagagagagagnnnnnnnnnnnnnnnnnnnnnnnnnnnnnnnnnaaagaggaggagagaggaagagggagagagagagagagagagagagagagagagagagagagagattgtgtctatttgatgctggcaagatttagcaaatgaaggggaaagatgtagcaggataatgcatagtttaaaatctgcattcattattggaattcactgaaactctccataatgatctcccattgccaaattcatcgtatcatatggctaaaaggttaataggaccttcttgagacttatttttgttgcttcatttactggagagctagaaataaattgtgagagatatcttacttgaaaattactctacctgggtgctgcagattattaggccatagatcctaccagaaaagctgggatatgagcaggactaagctatacacttggcttttctctacaacccagaaaacactagtaaattccctgaacagggaggcagggacttgcagtattctacttgtgagatagaatttttgctaaaacagcagactaagcatcttagctctttttctttatttcccccgctttctttttcagacctgaggttcccagacaactgaagaggtacggttatttgcaaggttttgaagctgtttccattagcacacacacatttctagctgctcagtgatatcctctttccctgttaaatgctctcccttcctgtctaaaacctggcattgatgcggtgcagttaatgcatacagctcagttccttccagtcaattgtctttaaagtattaaaaatactacccagccgtccctcagcccatagcccttcctcttgatgaacttattcagtctctctactgtgttgtcgccattgttcttttccccataaccacacctccgtctctatgccttccaaaatttcctgtgcaaacagttctaactatagcttaaacatggaaggttgccatttccttcattgttatctatttctaaatacttaggtgttcgcttccccctataactttcctaacaattatttaaaaatgtgtagacctgcaagaatttaagccatccttttatactgcatttataattctgctatatttctgccacattctccataatatcagatcattggcattctatatcaaaccctcagcacaattcttgtataagcttccggtttagacagtaatatacctgctagattcctgccttgatagttaaccagaattatcaacttaacttgatttagaatcacacaagagatatgccttttgagtgtgtttatgaagatgtttccagagaggtttaggggacaaggaaggacccattatgactgtgggtggttccattctatgggctaggatcctgggctgaaataaaggaaaacaataataatttaagtgttaatctcagtctgttttctgactatggctacaaagtgatcagtagccttacacagcagtcacagtgcttgttctgcatgatggacacatgatctcaaaccaggagccaaaataatcccttcctttcataagctatttggtcaggtgttttgtgatagcaagaagaaaagcagtcaacacacctaggtagcccttaaaaaatattttttataactggcctatggatactaaaattatgtttaattgaatattaactatatatgccatgtattggtacacttaattaaatatgtgtggacgcacagttaaacattttgcatttctgcgttttgtcagtttgatctgaatcatttctgagaagtgttagaatctcgagttaaaatgggtaatacattccaacctccccattattctcaccacttcttcctcctacttacacttactatcaaagaaaatgagaaactgaagacattagaattgctcattagaaattaagtcaattttgtaagctatggtttcattgttggggaatgaaaatgaaacctataatttgatctcgacttcctgatgtgaaaaaaacctcctggattacaattccatctcccatatcccccagatctgcatgaggtaacaccctggtaaacactgacatgtcctgggaccaattcatgtctacccagtcaggaggtcactataaatcttatcatttattaacgcttcttctgctattgcacactagcaaaaacttccaagatttatgaataaaatgaatattaagtgtatgtatgtaagagaacaagatttaaactcttcaaaaccatccacacagctatttgtatagcaactttagttgttttactttgggggttcaaactaagtacttggaattatgacagcagaatttgagtttttggatctttttcttgattggcattgtgtagagaaagtaaaacatgtgaaaatgaaaatataatagaatcacacagagacataaagataagtagagaaagagactgttgcctggttcctatttctagatttggagcccttccccaggccagcctgcattgcttatgggtcttgaagacataactacatcctgaagacttccctcttttcctttaattccttgagttgatttgcatttacactgtacatgtaaatgcatgtatatttccatgttcacatgttttactttctctacacaatgccaatcaagaaaaagacccaagaactcaaattctgccatcataatcccaagtacttagtttgaacccccaaagtaaaacatctaaagtatacagctatcatggcaaacttgttacaactgagaaatgtgtcttgaccacttctgagatcagaagatgatcagtcatcagttctcaccatgtcttttacgtttaacacatacctgaactacaaagcctggataactaccatccatccaacttgaacaaaattcgagaaaagacatcaatggcagtttttcaagttgcagtaaattctgtcattattgggaagagccatttatcctagagccaaaggaactctctaccctttccccttttagttcgtttgggccattctatttcctccctggtgcattcgaacttggtgatgaacgtgtgttctttttacactctcagcaatggaaagccatcagttcacagtcaactaccaatttcatttactacagtaaacagaatcgcttctcaagtcattagtatctccaggaacaatgcttgaattaagttggaattacaataggtagaatatacagttctgaagctaaatccacttctatacaggggttctcatacacatgatgaggtgagaggaaaagatggttttgaatgtggtatctacttccatgtagaacaggtgcatcccttgacttctttctagaataacagcatcttaattgtgttagtgactttggaagacagtcaaacaaagtatccaagtggttcttgtccccagaagcagtcctggtcctttgtttcactgagataggacatggcataaggttcagtgggttgggaatctatgggaagaggcctgattgcaagcagcttcctgtgacagaaaaagtctgaaatcttaatcctagaattcactcttaggacactttcttgcccgaaacatcatcacattctcccgtcttgtgtatcagcaataagggtgctgtggtttttctcctgtctaccaagcaatgttgacatatgtcttaactgatttataatttgaataaggaagagaacattaatgaaagttgacttaagtgtataagcaatgcatttctcaagccccacccccccgccctcccacccaagaccttgccctgtcatctaataacaagtacttgtatcacatgaactaatcaccacctcaagttcagcacttcagaaatagaagtatccaatctctgcatgaaagagaaatggaagttgacaccaggcatttctggtttagccaaaacaccttacttatcaaagctttcaggattggaacccaagtcactgatgatactattacatctatctgtacttgtaaagtaatgtaacattagttcctatttagacgtctgcatgtcacacacacacccatctcacaagctagatattttcagattccagatgccactttgactacatcattcccttccaaatatctgttagtggctgccatctccaaatcaaatccttttttcctgatataaaaacacttctggatatggaaataaaccatgtttcctctgaactgaagcattcccttcagggtgtggccttctaaagattcaagatggaagcttcttaaaattagaagtgaatgagacctagaaggcctggaaagtaaacaaaaatcaccggtctcaaaatgtcactgaaggttgaaaaatgtagaggtccttcccaaaatgtagacaagcaatgacctttgatggggagacaagatactccaaactgtagagcagcctgcaaaccagacatggagctccagagatacagctttcatcagtcagctctcatgctggggtgggctttttggtcatgcagttgcctttgagcctcctgaattactcctggcctgtttgcctgacaggaaccctagtaagctcaccagtccagtcagataagctaaggtggaatcatttccttggtcagttatcagtaccctgactggtgtgagaagatgtttcataggaaaagtcacacagtatttatccattctgctgtatgtgttatcttctgcactcaatcttagtcaaagacagggaagcaactaatcctgttctacagaatgaactatttatgaagcaatgtttctactatatggctttgctcaagttgtaatctacccacacatcatcactccaagcagcctctccactctgcctaactcctccaactatttaagggcagatgggaagctcagcatcccatccttgaatgctagttttatagctgcaatgcaggttttcagttaatcatacactatatgaaattgagtgttcctgtggtttattagagcctcatcgtcgccctgtatgtagtattgtgagtttccatagccgaagaaccagggcctgcatcccacatcataaaactcactgatgatcacacagtggctgtaaaaaaatttaatgattaattgacttataaataaaaacaaagtaactgtcttcatctaaatgatagcttggttcaggactatgaaatttcagagaaatttaatcatcagaaattctattctgacctctttgactttctctattgctccaggcgggcccttttagtgatttttgtattcattttcttaatccaaaaatggaagtaaggcttgtcatctgtcttactcacagagagtggtgaggagtattctagtcgatgcaaggcacacagctaatacaaagtttaataaaaatgataaataatgtccattataaaattgaaccattgttcaatttctactgccctttcggtgctttgattcagttctccctcactgaaatttgagaactttaatctgatgaaatgttttactaataaccatcggcttcctgcattaaccttttcttatcattaggtacacctggatggcatgaaattattcttttaaagaaatcaatacatcactgtaagtgcatagaaaacagctgctaatgagcttcagatgagagaaatctgttttaacacgtgatatcagaaattctaagaactttaatctgctgagctgattttgatggaataacattttaaccaatctcaaattgtattttccttaattatttccataatttctttaggcaaaattcctgttttcttgtcagagaagttaattttctttttctgtgaatttccaaaccaaatatttttttatatttctaagggaaaaaaaaacaaaaagtaaattctattaaatgacttcattacctcaaaactgtttatttaaaagcacttgtcaagtaatgatctcttgtgataaatcaaaagtcctaagactgagtagattttggaagttaggatgaggcttaacaaggcatcagatgattatttctagagagatagttggtgagtgctcaataaagtcaattaaaatcacctgacctggaaggaagaaggcaaatgtgccaacagagacagctgtaaacatctggaaagcagattacccacagttgtgggttttgtaattcttctgcttaaacccactgtcaaatgcatatcttaaagcctattacagtttataaacatttttgacagtgtgaactaatcaaccaaaacgtaggagtgataaaaaatgaagtaagcctcaaatctttttttttttaaataattctatctagaggcattgggaaagacaaagatatgaagtttcttcccttttattgaaaatagattcttttctcatataatatatcctgattgtagtttctgctctcgccactcctcgaggccctccccacctaccttcccctctggatccactccctttctgtctctcattataaaataacagacttccaagagacagcaaccaaacatgagaaaaagaaatataataaatttcatattgaagtcggacacagcagcccaacaggagggaaagaatcccaaaagcaggcaaaagagtcagagattctctcatcctcacagtcaaaatctcatagaaatactgagctattagctacaatatacactcaggggacatgatacagacccatggagtccctgtgcttgctgcttcagtctctgtgagttcacctgagccttgcttagttgatccagagggcagtgttctcctggtgtccttcactctctctggctcttataatctttccacctgctcttctgcaggattccttgagctctgaagagaggaatttaatggagacccccattttgaatcccttttcatgtaatgtctggctgtggatctttgcgtctgttctcatctgatgatgactgaataaggcaccaatctatgactcctaactctcttctcttctctctctctctttctctctctctctctctctctctctctctgtgtgtgtgtgtgtgtgtgtgtgtgtgtgtgtgtgtgtgtgtgtgaaatttttggttttaccctaggtctctgggctatctagtctctggttcttggttacccaaacagtgtcaggtatgggttccttcttgtggagtgagccttaagtcaaatcagacattggttggctattcccacaagttctatgccaccattaccttagcacatcttgcaagcaggacagattgtaggtcacagatttttgtggctgtgttcatgtccatgtttctctcttggtagtattttgagtatcttcccctcaccaaagagactagatgagtgttgtactcagcaatggggccttgctgtcagtttgttgagagtgaccttttgtcttagcaatggcctgggttgtttgggaatttccatgagacccccttggccaacccagttccaccactggaagccttgactggcaataagagatggccatttgagactctatccaccattactaggagtcctcattaggacaaccttcaaagattccaagaaagtttccactccactagttttccacccctcccaaggcctcccaattctagctgtctctctcaacactctctccctctaccccaccccaccactcacctgatccccatctctcatctccacatgccccaatctgcctgtgaagttctgaagaagttcagcatctgtattgcatgtgaatttcatcctccctggcttctcgccttatgccagatacaggctcgggtctggagcattttctcataagtcctttatgatagctcctcttataggcacatcctatcccttgtcccagagctctagctgcactggaattgcagttatttcttggtacaaaagataacacagtctgacccatattggcctttaaagtttttatgactttctaaatattgtctgttgttgttcctttgttttctatagtactggggttcacacccagtcttgagcatgctaggcaaaggtggaacacaccgcccaccctctagctcgtgaatctctttaagcaatttctctatttctctggcatagggtctctgccacacactttgctggaagcatcccttccttaaccttctacttgctatctgatgacaggcacccatccttcagtgtcaactcagctctggagattccaagaccaagttattttcacctagttatactgacttaaagcacctgagatttactctgattaacagaaatgctaattagtgtcattaagaaacactgtttccccaaatatttatgttcatgaagcagaaacaatacctaaactgttaagcactgagctctggtaccaatcatgtggactgcatgtcagggacttggtgatttttgctaaatcaaaatgcaaacagctaatctttcactataactcattgaatagaaaactataaagataatctagcagtgtgggaataagaaatagccataagcgagtttaaagcagaattcagaacatgatgaaaatagaatggctttagatttcaggaaattaaaaacacacaaaaatgatgttgtataagttctgtgctaattagtatgataaaaataaggttaatattcttatttttaagaaaaattaagtagggggaaataactagtatgcaacatgattcttatacaggattataatcacttattaagtttttactgttgctggaatttatttcaccttttgtagtgcttagcctatatcagaaaatcctcattcaagtctttctgaattaataaaatttaaaggaacttgaatcctaattatttttttatttcagaattctttaaacatcaaacatttcttagaccatagttttagccactgtcagctggtgaccaggtgttttaaaattaagaccataagaaccaataagagtgctgtgaaggttcaaccttcaaagtcagagttccagcaagcctgaaaatgaaatgttaagatgtggaaacaaaagtaagggttcatttacttacccaacacctgcccgtacacaatcggctcaagcccttattcattagatgaaacctacaattcaagtccaaatcatgaaatgaagtccacttgcagaagactctggaagcctgaaacagcatatccaaaagactgccaagattttttctgctaagtagtactccagtgtaaatgtaccacaatttctctatccattcttcggttgaggggcatctaggctgcttccagtttctggctattgcaaataatcctgctatgaacatggttgaacatatgtccttgttatatgtttgtgcttcttttgggtatatgcctaggagtggaattgctgtatcttgtggtagactcattcccaatttcttgaggagtccgccatactgatttccacagtggctgtacaagttggcactcccaccagcagtggaggagtgttcctctttctctgcatcctctccagcataaactgtcattagtatttttgattttagccattctgacaggagtaagatggtatctcagagttgttttgatttgcatttccctgatgactaaggatgttgagcactttctcatgtgtctttcagccattttagattcctctattgagaattgtctatttagttctgtagcccacattttaattggattgtttggtgtttgggggactagcttcttgagttcattgtatattttggagatcagccctctgtcagatgtggggttggtgaatatcttttcccaatatgtgggctgccattttgtcttgctgactgtgtcctttgccttacagaagcttctcagtttcaggaggtcccatttatcaattgttgatctcagtgtctgtgctactggtgtaatgttcaggaagcagtttcctgtaccgattaattcaagggtatttcccactttgtgttctaataggtttagtgtagctggatttatgttgagatctttgatccattttgacttaagttttgtgcaaggcgataggcttgggtctaactgcagtcttctacatgtctgcaaccaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatgctaattgaaactcaaatatgtgatgaatccaaggtgtttcagagagtgctcacctgtgcatgcaaatttgatttcatctttagtaagtaataaagttatatgcttgccaaaaaaaattgacacactggaagacaaatgtcacacaatttcaattttatgtgtaacctagaaatgatgaacttatgaaacagagagcagaactgtgactattaggcttcaatgtgggtcttttaacaatggggaaacgattgctttaaggatataaaactgcagttggacaagaggcatggactctgtgaaggcttgaggtctactaagagcatgataaatatggttgataacaatacgctatattttaaaagttgtgagataatatactttaagtgttctcaaaacaaaaatgatgaatatgtgtgatataacatgttaattggtttaatttagccatgccattgtgaacatactgtactgtgtatcataattgtgcatgactttatttatgagctaaataaataaatggaaaaaaagatatctgactttacaggccacatgaataggaaaaaaaagactgccaagagtccccaaacagaatgctggctgttatggatcttcaataatcccacattcaataagaatccctgttttaaagtaagaacacactgatgctatagcatcaaggaattacttaacattaaatatgtataaaaacattgtacaacttcattcatggtttcatcatcttattaattaaatttgggtttttttgatgatttcaaacatgaacacactaaacactctcatattaccccacccacatgactaatatcacatagtttgcatttatttttaaaatgtaaaattttgtaaatttggaaggtaacaaaattattagattcctttagtaatgttttcccttaacaaagcttcttatcttcagaatgaagtctgatcacccacaatttaggctttcttctgttctacacttcagaccataatgtttttcaagttattatgattaaaatatatagtgttttattatatacatggacaggatacccaaaaataacccctacatttatatacacagaaaaaattcatagtatattcttgactgacagtatcttcttatctacagaaagaaaaaaatagaaaagagaaaaagaaaagtgaaatggaactagaagaaagcaaggggatagagaggggaaaggaggaggtggaagggaaagccagaaaagagagtggggggaggaggagggatggaaaggaaaagtggcaaagggaagaaagaaaggggagggaggggggattgggggaaggggagaagaaagctcaaacttcttagtagtccattgtttttgttcttaatataagagatttcatacatattgtcaccatagaaacataactttagagttgtaagagtacatttcaaaaatccattcatgctttgtttattaattaggttgctctttgacaattttatacatgtacaaaatacatagtgaccactctcaacccccatcctcttctccctaccatgcctgtgtacctgccttcttccctacaaatacctttcttctactcatgtctctgattatggctcagagtaacctttgtctacgttgataaaaagcatttatcaactcttaagagtctttgtcaggaaacttaagtggacagaatcataatatcatttcatatggataccattacttcttttcctatttattctttttatttctgtctcttgtctacgtgctataggcaatacttcaggcactttactgcacagaagaagaaggtggacattcttgtcttcttcctaaacttagtggaaatgctttaagatttttctccacttaacccagtgctggctataggattattgcaaacaactttggctaagctgaaatatagtctctatacctagtatctccatatctccatgattttttttatcatgaagtgatgttgggttttacaaaaggtcttttctgcatctactcacatgaacaaatgatttgaaattaagtatctcaatttttaaatatcacattatcagtttgtttatgttgaagcattcttaaatggagcagctgacaatgtttttatttttatatattaaataaacacaattcagtattgcctatgctttccacctcaatttcttaaactgtggttgcaattccatataaggagacataactagatgtgatggttatagggaaatttggtaaaagttttctgattacactataaaagaaaagattcaaaatcaaatgcacaatgaatccattgcattgtggtttgggcagtatccccatgctgtataacacaacttccctgcagccttggttatgaacacttatgcactttgcactgggcattccatcatgatatgtaccagcagccactgctttctgaaaacattcagctcagaatagccattgctctatgctatgaagtgcagtgcttttactatatacacaacacataatggcttcattatggaaggttaaacttttgtatttaaatgtttgatttttaaaattgtaggcttgaatttttatttttcaaaaattagtactatctgcttgggattaagctagaatttccaaagtgactaccttgtagtcatatgtatttgtgtaaaatggcattctcagcattgatatttgtaaaaaccaaactgtcagccaactctgaaaaacatgaaagatattctacatcctgaaatatcaaatacataggcaatattaaattctttatgtaaatataaataagcatgtctactttattagcatgcaagtttacattcatctttaataagttgtaaaatcatacattttttgaaaaaaattattaccagtaaaaatttcattaacatacctattttattgagctttatacttaaaattgtgtaagataatgtagtataaatggaatgtagtttccaatggaaaaatatgaagccttcctttattccatgaaagacaaagtggggaaatccagccagagaaaaggtgtccaatcaatcaattacagtagcttagtgagctctaaagagagacacacaaaatgatgaagatcaggaaccaggtcctaaaccaacttcctgaggacttctggatgagaccatttttttaactaagtgtgcaatgttgaatagaggattgctttgtatgaaaaagaatatgggtgtttggaattaacatataattccttgtaagagattgcattaagtaacagtaatactgaagttcattcttcattgaaaactctgaaaagatatttcatatggtaacagagactgtgggaggtggagtaaaaacataatatggaaagccctatacactatggaaagtcctacacattacagaaaaccctacacactatgggaaaccccatacactatgaaagaaaaaaaccgatgtattatgaaaggtcctaaacacaatggaaagccctacacactacagaaaatcatatacactatagaaaaccctgtattttgtggaaaggtatgtacattatgggaaaccctatacactatagaaatctctacacactatggaaaactctatactctatatgaaggagtttaaggttttttccagaaacaaacaagtgagaaattgttttgaaaatgtgacctgatttcagttttaccaagactattctagtgaaacacgtgattttgaattagatggaaacaagagacaattctcttatgaagctaacaaatgaaaagactttgtcccacatgagaaaacaagacatcaggtcagagcataagccagaccaacatggtccatgaagatgttgcagggataggatctgacaccactgagaattgtcggggccaataaagatggctccacttcatcttggctctaggtcatagagttcaaaactattcttactaagtcataagacctaaaggtcgaagggatggctacagtaggatgtttaatcttggccatgtgtgtcttatctaaataacaacagatttggtatgaggtgtaaattaatgtcaagagaagcttcaacatatgcacataatcagtgagacaaattcaatcataaaaaacagaaacttcagtttaaatcagtatttattaccgaaaagtaagtaaagcatcatgtttaatatgtaaactatcaaatatttatttaaatgtccacttattttcaagtgaaaatatgtataagacaaacatataaagatataagcagctagaagcataacacgtgggcagctccacaaatacaactgaaatataattcaatattgtgaattggagtgacgtcataatgcaccaaaatgcattccatatgaaaagacagacaagaagcatttccatcagacagcatacctttccccatgctttcccacttatacaaatagcctatgaacacaccattcagcaatgagtttgctatagcacagctctccctagggggaagtcatttagctgtagaggaacccactttatttcacatatcgcatgttacaacaccagcaccaaggaattcaaagacaccacatgatccacaaatagttcctctgcactgctcacaatttattattcagcattttgtagcaaaactatcgtaccctttatttgctactcaatataaggcattttgtgaagtttgtgcaaactatagtcatcaccttcaccaagattcatcatcacaatgccagagtaaagaactctgccagagatgaggagtgcaaagaacacaggacaccattctgtcttctcagcatgcttcttatttggtattaatatcaccagaacaaagctaccatgttcctgccatgtggacagtgctccaaggccatgagaaacacagtctagatccaacataggtcttagcgtgcttgtaaattacaactggagcacagatcaaattatagttgttaccctgactactgctagactaaagcgattccaccagaaccacttgatgatgtttgcagaagaatggaaggggtgttaaacacatttgtcgacagtgtctaatatcttaatatgaacaaaccaacacacataagaatttctctactccctgatgaaagaagaaaaagatagtatgaaaaaatatttagataaaatttataaccccatattttagcaaagtaagtccagatatactaaaataaagaggcatgcagaacgacagtatactgaattaataactaaaactttcccttcccagtgcatggctaccatgtaagtcccactacgataaaaactatgcactatgaaattcaggggttgagttttatcagagagagaagacaaattaagttctccaagcatccagcacaagaggccagtcatagtgcattctctggaatatgtttagtataaaaccacaggcaaccagcacagcactagagagacataacttcattttttcatcctgtttgacacaggtagaaaatatatctgaaaattcccacatgttgaaaaacacatgttgactctcattactattgtactaaaacccatggacagaaacaggaattccgggccaatgtctgcattcaaagtacacaagcttctgaaacaagctattgctactgattgtaggaacttttttaaggtgaaaccctctgaacatggataatatcaagaagaacctagttaataacttagttgcagattttacagcagcagtaatgaaattctcagagacaagggttggctagcaagtctctccaagaagatgggtgagtaactcagaatcataagagaattctgatggtttgtcaaataatcactaccatatatctacatatatataggaaaatataggtttaataatacaggatttttttttgctttcagagtaataaaaagtgctgttgactagtatctgaaataataagaatgcaaaggaagcgatttctcgttgctataaacattcatccatggcaaacaatgtggttggttcttgttttatttctataaagtacttttctacttgaagataatatttgattatattatttagtaagtagaataaagattaatttgtaaattccttaaaacaagacccttcattccttggagctggaacccataatgccttgtctcctggaatatatgactgttgttctgagtctgtggttactaagggtcattagtaaggacatgtgaggtctaccttcaaattgtgccttttagtcagaacacacaaaatccacttagagctgtaacacagaaagatctaactcattttcccacaagatgctgtgcaaaataccactacagattaaaatacagttgttgctgcaaagaggtaactgagccttagtcttctcctacccctggccttcaacactgcctttattggcttcatcaagaggtaacaaggatgtagcaaggcaggtctttcaaacaacaattaattcagtttaaaaatcagtagcgtgtatgctaaagtgagctagtgtgtttaatgctgagtggcagcagccatccacgtggctctcagacgcctaatgagtcaccatttctttagaagtattacctataaaatgtgtgggcagttattgatactataaacgtacctttgatccaaacagacttaaatacacacacagcaggcagctgtttggaggctgaaaccaccctctacatttccagtcaagtggaaataaggaaaagcagggggtaatcccaagaaattaaataaaagtggcagatttttcactaagaaaatcttgggaagtgaatatttctatagttatcatcttgaaggcatagtttcaaaaactgaaacacatggaactgttactttatgtaaatgaaacagaaatagtttttagaaaaggaaagaaaaagtaacactaacagtattgacatgagttggtaaagaagggcagtgtctcataaaacaaagaaatggtgaactttctatatggtttgcactaatacgtgacataaatcagcatttatttttagatagaaataattttaaaatttgataaaaataaaggattgcttataaaaaattggctgttaactcacctattataaagtacagtattaacaatcggtggcctacctagaggtcacactttcaactattaaatattttgagatagacttttgaaatactatttatgggaaaatttagctaaactacatatgctggcagtaattcttttacccatatataatgtaaacagaagctatgcagatgactcattatcttctctaatttatatcttctatgagcttcttgccattacacaatggcatgacttaattcctggcttgattgattagggacataaaacaccatcctgcactcaatcagcaccaacacaaggcttgttataaagcaaatgatattcaaataaaacaagtttttttgagtcattttcattggaatctcaaatctatttctttccaaaataagaaaaagagctacaaataaaacttcattcatggtttttctactattcacaacaaaacacaatggaaaccattgtcttccataccacatagaccttatgagaaagccactaatattctttatgtgtacatttcaactaatgtagcatttaaatattttaaaataggtttaccaatattctatgactattttaatgaaaaataataggaatgatttttatataaaatatttaatttttaaaacacaggctattcatgtcacataaatagttctaattttaggttatctgcttatggccagcagaagcatcatgtgtgacaaataagaataatttagatactgtcacttaaagtctgaaggtctaagactcaccatattaaaatttcagagacttgaatactctattttgctaaacttcaaaacctttcacttcctctaatgttttaataatttgttagtattcaatattcaaataaaaggaaaatatttttcttacattaattttgttataccaacaaaaataataccatcaaaaataaagtcgtcaactgaaaactcattttataggcatagagtgaaaattactttctttaaaatattcttactgtttcctgaatcatgtttttaaatgcaggttcacaaatcagataaagggcatgaggttaaactggcctttcagaacttttattcctatttaagattccaattaaaaatgtacagaacagctaaaactttccattttgcacattcaatttcccagagtttctaagtttataagtgatgagggagatgctggttatttacctttggttcagaataatttctatcttattcataaaaaaatgtggataccacagtgtatattatatatgcaattttcctggtctttaaaatttttacatacatttattttattttaaatatatgggtgttttgtctgcatgtttatctgtacaccaagtacgcaaggaatagcagaagagggtattggatgtcagaagagggtattgaatcctctggaactgcagtcacccatggttgtgagtcaccatagatgggaattgaactcaggtcctctgcaggagcagtaaatgttcccagaagccaagcccaaattctccagcccaaattctgggtcttcctttttaaaaatcacaatcttcctaaagtagcactgggaccttggaagaagcttgggtgtactggagacaccaaagctcctgcttaattagcttctcagggtactcatttacattcaacagataagctttgatgtttctctgactttgttgtaggacagtgaaccatggttactgctaatcacaggcaccctgaaatctcctcttatcctgtccctgagttgtcttttcacacctcagttacaagacatccacaaaagtgagagatgcttgctttctttgcatcccattcacctgtaaattgagagaaaacagtaagtttgccaaaggctaataccagcttgtgaggacttctgctacacaattgtcttcatgaaaaccatctgttgttgttccaatggcagttgaggaaacaatttaagcagacacataaggcaaactgaaaaattaaaaaatgtttctaaatgcatactttagtgttattgagactgcagagcactgggatcaaaactctgtcaactggccggaccctgcacccacagagctaggcggggcagggaagccaaacacacatgcagattgtgggtatacacctgtgatcttacaagtggaagtgggcgcagccatgtttgctaggacacatggccaatcgcctgaagaaagacaaatggtggtcttcctgaagctaagcaaacccaccatttataagagccacttgaagtcaaaggggagaattgaatgcttcaaaagagacaaaatagcactgttagaatgtcaatcagtggaaatataattatgtgaggagaataaaattgcacctaaaatttagaaatcaacatgctttaaaaattccatgttcaaggctttatatactaaacagagaatatttcaaaatagagtactgtatatcttaagctgttcaggctgcatccagctttgggttatagtaatcaaatcataattttatataaacattcaaatatgtacaccagcacaaacactaacacactaacactaatgtgtatatacacacattatcctaaaatatgagaaaattttactttgtataaaaactatatattacaagtgtgcaggagaatttctaaataaaaagtctgttttacaagttctcaataaaacaattatgaacatgaattccatgattaaagaaatgtgttcttttagaatataacttcaaaataagacaaaatgcaactccatggacggtattttaaagaaatactgattttttttatgcttgtttaaaatgtattacaatggcattataaatttaatactacaaaaagaatctttgtaaagagaggagggatgataaagtgtaccctgactagctcacacaaggaaagacaaatagatattgctatgagaccaaccagcccaagagcacattagtctcaggaagaaccaagactcgcaggaccctctccatggctttactccatctcatagctaagaagactcctccatgttaaatcttatgggtctggtgtaaaaataacaatataaaaatatgtacctccagcaacatctgctagatatagatggcaacaaagcaatactattttggttctagaaaccatacaaaaggtttggaaagcccatgttaggaaaaacagaaggaattgttacaagttcacttaggaaaataaacacttgtttagccttttgaaaaaaaaagtcaactttgggtatatattaaatgtcattggggctttaaaaacctggattggtgaactgttctggattaaaatcatcatttgtactttgggcaattgactatgaactcaatggttttgttaatttggataatttttaaatgtctcatttttaagtggtcagaatgtaagggatgaaacttactgtggccatgctgagcatttaatctttggatgttagaaataagagtttaaaaatcccatcattacattaatccccattaaaaattgtccagtgttctctaactctgaccctgcatcatccagctgaacacacatactgaagactccccttctaataggtttgttcgcaattacctcttttgcaagttgaattgtaactaaagtgaagaaatgattggaaaagcctagatttataagtagaaatgttttaagagatcagttgaacatcttactaagcagtgacatttcttccatagtttttatgtaaatctgtgcttttcctaattgatccagatagttttattcagagacatattttagcagaactgtaaagggaatgtacacattgtcagaaatcatcaccatgtaaaaatagccacaaagtaaaaggaaaagtgattagaattactaacactgtatatgaatgtggttatagagataaaactccatatttagagtttcctgggcaatttctcccaggttcatattgtattgtagagattaaaatttccgaagaggcagctcatcaatggatgtcataccaaaaagtacacattttccagaactaaggaaccaggatgaaaacaaagtgacattccaaacaccaaacctcccaacaataagtgaaatcatatttaacctaacaaattctccatgatttttattcaaactcagttcctaggattgcctcataaataatagcctcaagaccctaccctgcctggggagtggagggtagatggggtggggggtaggtcaggagtgggggaggagatgtggggatgatgggagggagagggagaagggattggcatgtgaaacaagcttgtgcctaatttgaactaatgaaaacaacaacaaagaaaaaaaaaaagaaatgcttctttaaagcaatcaagaacattaaggtttgaggatgtagctcaatggtagagtgcttgcctggcttttgcaaagccctgagttcaatctcaacctacacacacacacacacacacacacacacacacacacacacacacacacaactaccccatcttttgttctgatgctctgagtataactcattgaaagataagtgacagccatgttggtcactaaaggaaaacaatccaaggtctatgtgagataaagttatttctggcccctttgccacaataatgacttctttttttcagaaaagtagaaaactcttttcacagtatagatgccccagtaggtaaagctatgtttacagatgccctatatacagaaaaccctttggtcttccatttgaaggttctcagtcactataagaaatgttgcagagaatcatatcccagttgccaatgccctttgtctttttctcttacctcaatgggtaagcaccagactcaagaactgagcttgcctcactgtgtgatttgcatattagctttctataaatacactgagttaccagtaaactgctcagaaattagtttgaatacactagaagatatgaatagaaataactggttcctctagtccatcaccaaagctgtgttttcttgaaataaagatccattttgtatctcagtcctgggcagatggccaagatttcgattcatgaagttcataattctttagagtcttctggtacaacttctagtataatctgtaatgttctggttattctctctacaaagagataaggaaagattaaaatgcatgaaaatcaaaacggcataaaaatagcaaaatgtgaattatttggggatgaatactgagagtgcacagccaccttctttgtagtgcactttcaagaattatttacttcattacaatcttatcaggctcaattaatttacttgtcacttctacaacttcccatgatgcttcctcagtaagaatatattaatattttgtattcaaataagaacacttatttatgaaccaggaggctgaaaatattttgagacaatgggaccaagatacaaatagatgtttacaaatatgcttcatgttcagctcaaaatgggtttgttcttttttcacataggagatgataaccaatttctcaggacagtcaggagaagagtattatttccagtgtctaatttgtagtattgttgagcaaattaccatgtttatcaaggccttgtttatctcataaatagattgagaaccttggattaatctgggtcattaaggtctgatccttagacaagttacattaagcatcgtccacaattccaaatttgctccaattttaatcattagtctccaatttagaagctgaaggcttaacccagcaagaggtcactgtaacagacactaaaatataaaaatacctgagttgtattacatctaaggacactttttacccactgccctagagtgccaagctctgtggtgatgatttcaggtacattctttcttagttattgtcaccaacccccatagaacatcttcagaagccccccaatcttggaaaccccaggctctgtcctcttaaaggattcagaagcaaatcatctcttgcccaggtattctttctcctttccaatgactcattattctaacaggcctttcaaacaatattgtaaaaagctgttttcaccttttgttctctgatttttgtggtttcaatgctaaatgtcccccagaggctcatgtatttgaacactagttcccatccattggtactgtttaggaaaactgtgaaaagtttaaggggtgcagcttcactgaagaatgtgagggctgacatggagactctataacccagccttacttctataggttgttacatggtttctgccccctcactgcagacagtgtgatcagccactcacaaaccattgcagtcttgccttttctgctatgatgggctgtagtcactcaaactgtgagccagagcaacccctcctcccttaagttgcctcttctcaagtatgttgtcacagcacaaagaaaagtaacaaatatagtcatagtccctaaggaagttttctgggcacattattattttttaatcctgtgtttattgtaaagggtttatgtatagtattttcaaattaattaaaccttatataattcttaaataaattgtattttttaacagtccactctgccatgagagcaacaatcaaacgccatatttacagaattatcctattaaactaggcttatggaaaaattatctgtcaacagtatggggaaagtgtcttttccaggcagacaaggagccaagccatatgatagtaggctacaaggtaaaagaaaaacaagagttgtaaagaaaatcaatggagttaaagaaacatggcctcaagtacgtgtttcaacacatccctgcttagctccccaagttaatctctacatccttgtcttctcactcatccctggtcctccaaacctgacagcaaagcttttcctagtaccttccaataatgtgagtttccaactgttgccttcttagatctcttgctggtgtgggaacttacaaccattccagagccatggaagcagctgggatgcccatgtttgcatgtgtccttctgaaagcgcagcttgtattcttctttcagcagggctaggcagaggcccaaatcataaggttctgcctcctcagccctgctgactatcccccctggcatttctaaattctcccttttggattctgggagtggcataatttgtataatggttgagtgttcagtaaacagattggcattggcctcaggtactcattggttccccaacttttccttctaggctgtctgtcctacaacactgggtctggcacagggtgttcagtggaggcaagggagcttctaaaaacactgcagaacatttggctttggagtgccatatattctattcacactcacgataagattagtggccctacaataataatattactgcctctctaaacaaaggtgagccaatgacctacagctggagttttccataattacaacctacaggacttaaagcaatgccatggtgtggtttcagttttattttttcatgttcccttgctattcctgaaataaactggaataacaactgacttggcaaaatctcactcaccccatcacacctggtatccataggggagtagcagccaagattgagtgagcttgggaagcagtgccaagccactctgccccagcacttatattaaaaatcatagtatgttttcttaagaagggtttttaaaagctttcatatgcataatatttattatgtggagaatcttctgagcccctaagaaatacaggcaaacttaatgaatgaaaaaggtgcactctaatcttttgggaaaatctgcaaaggcattaaccagctttcaatggtctgtcccagataaagctatcttgatacactttgggcaacacatgcttttaagctctggagttgcaagcctgctgtccacaaagacagattgtaggctttcggctcatgtcagccacattgggttttgttgtttgcttgtttttacaatcaaagattttgtttaaatatacctgcctccctatctctacctgagcaagaggggccaggtgttaggcagcccactggctctcagctgtgatcaggttgaatggatagctagaggctaccaagttcaatggctgtcattagccctggcctgggttaccagggctgtactagtacctctgtgtatctgtacacatcggggtagaacctgcctcccttttccttcactgggaagtttgcctttctgtagataaataaatcatataaacatccaagcagtagaattaactgctgtcttccagacagggagaaagctttctgcatatctgaccacccccttaagagaatgcttcattctagctctggaaatgctataacctaaaaagtggttcaatactggcatcctgtggccagaggtattcatcaaatctctagaaatctcacatccttgggctaagaagctagaaacattccctggctatctgtgccaactagccttgtaccagtttctgaatgatgtctggttgcaatttctggagatagtcctgaccaggtgcattttgttagactgtcacattttcccagggttaatccattcacatgtaatcagataaaaaagcataacataaaatctagacaatttaccaagcaaagcaacatgatatcaaacgactgcacaaattgcttcaagcaaggctctcctgcctccaagctcacatgcagttttctctctaacagaaagtatgtctttagaggaagggtctagtactgctgcaagaggctcttgcttcgagtctgtgtattttgttttggccaacggctacaaaaatacttgccactacagcaataaatattataaattttctttattttactacaagaacgctgcctaagaggaaaatcaaacagaattacagaggactgttgttttttcctacttcctttcaaggtgtctataaagataaagatttgcagtgatgattacagtttaaagtagaacggctgtgttcctggcaaaaagtcagagcatccccgagaaccgaaccaccattgtgggtctcctccaccgccgttcatttcacaaatgactgacactaacttcagtggccttggagatgttcaaaacaatattagaggcagaaaaaaaaatagcaagaactccaaaatgacaggagcagaatggcaacaaagaaaaatcatgtatgaaaatgatgcatctaaactgaccgagtggctgctagcacacctgcggtagagagaccagctagaactggctgactgagcagggaaggacagaaaaccttctaggtgggacaaaatggcgaacttgccctttcttcactccatgttctcttcctctcaaaggctgctggctctttcttctaggggttggactttctttcgtgctcaaggtctctttgtgtacttcagtctcccagctcaatcctcaactgtagcaagaagccaagtgacactaatcctaaatattttaacagaacttgtctcccttcagatctatagtccagtgtctccaatagagaaaacctaactaaatatgtcctacagaaaaataaatacagctttgcaggatacagaactatacaagtactctgggaatcagcgtatttcccttagccttgaaatcctaatttacatagcagcatttctttccagaatagtgttgccagctagaaagttaaatcggaatagaaagagtggtagaaaatctgaagtagccaaatgccaattcagttggtaaggagtcatgacaatactttaaaatggctggtttctgaatgtattcttggaatatattagagagtagagaaataaatgtttttcttgttattttgtaccaacactcccttgttgaaaaatttcccatcaatcactagacttctagtttgggtttttatatttttgggaacttcatatatgagtattgtatttacattatttctccctctctaaccaccaactcctaccatgtcacaattctcttttaaatttatgatttatttaattgttctttttatatacacatgtatgttaacatgctgagtccattgtgtattgatggtttgtagatgtgtatagggctgggatggccacctgggattggggcttggcctgggagaagagcaatcctccctctctggtcagtcactgtttgcctgttgctcttcatctgtggatggggccttgtgagatttcctctatcactttggcatgtcaccctgtgttgtcattctgcagttcttattcaggtgaccatattgttgggatttcatagatgtagagcttcaaattcctgtcctccctttgacttttaagattagccatggtaaactaagtaaattaagaccaaatagaaaacaaacaaaaaaggaatttgtattctaaactcaccgaacatataaacaacagcatttctggttttgaaaatatatttaatgtgacttaaccaatgtcagtatcacaaaacttaaaacaacttaaatgaggaaaattttatttaccctaatgtgcctttcctgtgtcaagggtcacggggattaatccattgatgggtatttagctgaatttgtcacttgaaactgggtttgtttggaacaattatatgactgaggactgcatttaaaaaggtattttttaaccttagtctcttgttctatggagtcctctgcatcccgcctgtagcttcacctcatcaggtgctccctggcctctagaagcaatagaaccatcaccatcagagcagaatgaagccagtcccaggactgaagtgtcccagaacggaaaagggcaacaaaccatgaaggcacgtggactgaaacttttgaagccatgaacccaactaagtttttcttcctctaaattgttcctgatcttatattttgtcatagtgatgaaattctaacacagtgggtattgatgtccagcaaatgagagttcaaattctggctgtaaggcttaagattctgtattcttgtttctaaattctccctcttgctgagccctggcttccttacctggtggaaacagaatcttggacatgggtccttggtgattgatctgagagcctgaagcagggaaagggatcacaagctcccctaaacccaaggctcttccaaagcacccttctggccagttgatcttgtgcattttctcctccacgtcttaactgactaccagttgagccagcttttcctccttagtgcttttaacttcctcttggtcctgctaatgtcctcatcactatcactgaagaaaccacccatgtcctgttctctgtcttcagcctcaaccttctctcctccatactcagtagcaggcattgcttcatcaaaggcaaccgtctgagtttgagcccttgctcttttacttacatccacatgacttgtaagagtgacatgaattctctggtgacataactcaatatctacataataggggcaatgacttcagatggttgttaggactgacagtggtcacacacatgcaagcatgtagaaactaaacaagaaatgaaagctgttattctcttcatggtttttgctgttaccagtaccctctgcagctcccttttcctaacaaggtagtattatagccatgatgtttaagacatttgaaggtacccatctcactcaccaagaaatctcacatcattgagcactagacttcactcaacccaggaaagcaatcattgtatcactaggggatttaaaagaggagttgaggctgtttacagttctgaaaaaaaaaaaaccctctgcctaaagaagttattctctaaaatgtccatgattacaaccacccaaattaaatacccaacaggattcaataggggctgcactctgaatgacctgcctgtctttctccttggagcggcaattaaaacgctgtaattcactttaataacaattgtacctcatgtagctttaaactttaagagtttgcatattggatgtgtgcacttttatgggtttcctataacatagtctcttgatgggtccaagatgcttaaacatcttacctgacaattgtctgaaccacttgggtttcttgtcccatacaatgaagagataatatgcagggactccagtcaatgtaataaggaagccgaccccggtgctaaatgggtctgaataaagggagaggacaaccatgaagaggcaggtgaaggaaaacaatgctgggatgaacagaggcacctggaacacagccaaaagaaacagcttcacataaagctcaagagaccagggatggagggcattagttacattaccagccagtaggccccaactcatttaagcagcaaaacctctccaagcagcacagagcatatattaggtgtggtttcttaactttaacttggtttagaatgtttgaactaagtctcaggctaggaaaaggtgtttgctagtggatcatctattcaaattctttaactagcagtgtatccttataatttacagttgtcatcttaaaagattggtggtttgataattatgattagaacccattttcacaaggagtcaagagcaccagtggccatgctccatgttaacacctccctgtgaatattgatttcctgttgagactcacactctgacctgatgggaataaaacaggccaactcctagtcaacagctaataaagatgctgcaagcatgtggcgatgaatgcaattagaaacagatcctgataacatggctggcagcattatcagtgctatgtcttaaaagcaagcactgacccatggacagctggggctaagaagatgacaagactgctctcttgccctcccacaggaaaatggtggttacggtaaatgggtgtcctgcttggcaacaagcaagctcttcctttgttatttcatattttttagttcagtggttctcaaccttcccaatgctgagacccttttatacagttcctcacgttatggtgacccaaaccataaggtttcttcgttgctacttcataactgtaattttgctactgttatgactcgtaatgtaattatcagagttttccgactgtcttaggagacccatgtgaaaggtcagtcggcctccaggttccccaggttgagaaccattgctttagagtatatgggggaagctgctctactacaaggttaacaagttaaaacacttactaatctgtaaagcagcaccccttcccagttacaactaatgaagtactttctttcacagcccagctgtgtcaacaactggttctgaagacagacaggagtatcccaccctctgaacacacaatgccatgcatgaaaacccaatgaaaaacctcttaacactaactgttctaaacacataaaaatctgtgatgagttcactatatcatacttcaaaatacatatactttccgtaagcaaagcatattagcaagtgcttcctgcaagagttaaatatgttacactgaaggaccacaccccaccccaacctccccatcaccaggttctgacaaaaagaggtctaggtattaagagagagatttatgtaaacccatcaagatggttgaggttaccttgaaaggacgatgcatatctggacgtttgtatcgaagataaatcaacccagcaactgccagccccataaaaagccacctggcaaaactgaggaaattcagaagactgtagagatctccggagaagagcattatcatcgtcaaaggatgctggcagtggaggagaggagacaaagtaagtgcccagaactgagaaggaggcggcaattccaagcaacaacattataagtgtccttccaatggttatttataacagaagtcaccatcctgatggaaacctagattccacaaacttcttttccatattgtgttctgcaactaagcctcagctggagggtgctgtcatcaccccagtttcagttggaactttatgtgaatctgctgttttgttactttgtcagttcctttcttttcactgacaaggagcaaaagtattttctgttgctgtttaggttttgtgtacatgtgtgttcatctatatgcatgtacataaatgcaggtatgtttataaatgcatgtggaggccagaggacaaacttggctattgttctcagcctgtcattcctcaagtaactaccctgtgagatgggggtctctcattggcctagaactggccagataggctagggtggctggcaggccagtgatctccagggatctccctgtctctgcctccccagcactgggattatgaacacaagccactatgccagcaattttaaaaatgtggttctggggggactaaactcaggttctcaagctgtcaaggctagcacagtatacaagcttcaccttactctagacaatgtgtttccaaagaataaaaagagaaaaaaagacattcagtcattcaagatcaatgtagaatcaattattagtaagttcccatcataaatattaaatgcggactccactagaaaacttaaaggatgctctgaggtgatttctgagatgctctagggatccatacacgggaaacaactacgtggaggtgaatgttttggttactgaatgcaaaacattgaccttttcctgctccaggtcaactctccccttgtgctaactgcatgtgaccctcaagaccaggaaagaaggaagcctagagagtaggccagtaatcctctgcagtgaaacagccaaggatggctcgactgatagcagaggcttcaatgaaagccctcttcatggaataatacatcctgttgccacaagtgacgttagcctctagattcctccctgagtgtgtgcacactttaaaaagaaatttcagggagacattctgaaacaaattaaatgcacagagaagaaaaaagtgttcagtgcttcctagggcactctcgacagcacattccagttgagaaaaaaaatgttactaaaataaaaatgactatagcattgccaatgggtatttgagggctcttacaccttttacagtcttttgtatcccacatttcacaaatattgttcccggcatagagaattccacagcttcaatttacatgtgggctttccctttcttctctgtaaggttgactctcacaggtctcagttacaatcagagaaccatttcactgcttagtgtttcatctacgcttttattctgttgtgtgtgtttcattatgacgggtccaggaggagacaacgggtaatgcctgcacagtctgcttttagctgagctctggtcagtaggtgagactgtgtccttactgttttccccttctttcctttcctctgccaaggaaagaagccacatccctcacttcccattataaagcttgcaaattttttccaaggtgaaagagaagtgagatgaagcatacccagggcatcccatacacatcagaaacacagagtcacaggaagccagggcaaaatctctggccttacaaacatgataccacctgagttacactgagcaccaactgagtgctgaattaagatgcctgttcccattccctcttttgctaaaggctttgtgaggctcagtctaaatatacgtgttaatgtgcattaccaaaacaataacagctggcagaggagtgtgcttgtggacatgaatcatggagaggatttctggaaggtgcccttctcgggaggcaacatagaataacctggtgggagaaaaacatgggaggtgttgactatatagaatcaatcattcaaagaggtaatatgctgaaacccccaatgcaatatgtatgcatctttctcacactcaacatgttggcattcttagctggtcatttgcagacaaagggcagatttcatcctaagtctcattttaagacgtacaatacctggggcatacccttttatgctttgaggaaaagcatggcagcatctcactgagtagagcttttcctacaaacgaagagctgttggcaaagtcagttctagattgctagtgtcaatccaatctagcacacgtgttttgcacacacatgtacatgcatgtggcattcatatctatctgatttagattgtaacataaggaaacaaaagagattttcgtaccatcaaacaaagcaaaagggttacagattgcggagtggttatttctgctttctactttactctttttcgtggcaccttcaggaaaacaaaagactttatcgccagaaataaaagctgttattagactctgtagacagactctaaaaaatgctcagagtgagctatgtgtagacacgcagcgccctctactggacagaatcaaacatgcttcacttgtatctgccacaaacttgcatatccctttaaaaacaacaggttcggaagcactattgcttttctctttaaaagttatccttatcacatccaatctctaaaacagaaatgtgtttctgaaaatacatgaactcgctcacctggagacagcgaacacgccaccgttcatggagccgaagcaggagagggcaacaaagatcgggactgctaatgagaaatttcccagcagccgctcggagaaggtctggggaaagaaagaacgaagcaaattaatgctttcccagaaagtggaataaaatgaaacaatttaggccaaacttgctctttgactttctattagcctggtgctacgtgaatgttttataatcctgctttttggttagggtcaaactgactccacagacaatcatcagaagcgggtaccatggcattgcttgtctcggacctgtggacaaaggtctaaacagtcgcctcctctctctcctcaaagcaacgatccatttactgaatctttatcagctatgatgtataacgtctctggctctgatcagaggaagaggctcaattcgggaattctacttttagagacagagatggttctgcacaatacctgccctttagcccagaaagcctcctatttatgatcggggtatagattcgccctcacaagagttacaggtatttgtttcacataccaaccctggtgctagacggtaaaacaagacaatcgacaagctgatcatttatggcgtgcgaatgagcccgtctgcaccgttctttcccccagtacagtcataccagctgaacctgtttaaggagttggccctcccccaccctaggaagctgtcatttccttccagggtttcctgtaaaaagctagaacacaattccaatcctgacaagtgacaggaaatataaaaggtagaaaaagttctgagatttcctgtgggctgtcacacatgccaccctgtacatttctatgaaggatacactttatatttttttatgtatgatttttttcattatttcttgatgcagctggggctatgcaattaacagaccccattatgctctccaaaaattagtgctgccctttgcctagaaaggtgaggcaactgaccagacacccagaagctttatacacgtcactgcccgatagtacgcctggcagtggacaaagcccttttcatacagtgaacccatacattggttcacacaaaatgagataattatcccctgtgggtggtgttgataggaagcgatcctattttaaaaggaactgactgacattcatgaatgggaatgtcattggatgcttttattttttttcacccttcctgcttttgagttaatgagtgaattctttcttacaagctaaaccgttcgagcaaaataaaagtctgtgtgacataacagcagtctcataacatgattttcggaaacaagtatgatcctgtggtcaaataaattggggggaattctttagaattatatgtatatatttcttatggagctacaatgcacactggcatcttcaagtattacagcaacatgtctttaacatctaattgactagttgttcccaaatttatgagtaccccaacgccactattccaaggttatgctagaaatagatagccatggtccacctgaaatttcaagaatgataatttgaagagagaattcaagtcaacatctgaaaagtttatacccagaaatgagaagagtgggtctcactttggaaatcaaaacctgcatttatttacattcagtaacagtccacctgtccttagagacatgctggggaaataattccttattctaaggaagccttggtggagttttaggcagctatatgtggaaatgttttctaggagattaaaatcaaaacaaagaggatctatggcagaggttagctgtatcataggatataccctaagtaaggtgtgctcaaaattttcagaatattatcattcaggtcaagaaaaaatcactgacttccaaaacccgttctcctcaagggaatcactacaaagctccatcaactcattaacctaaatttgaactggcatgattttaatgtggacttaccactgccacagcattggatagcaacaactcctcagcactgatagtcgtaaaataggccacatttgttaacacatagccaactgtgatgatggccatggaaatgcagatcgcaagggggatgtttctgtaatacacagacatcactcatgagacattatgaattctctgctaccaaagaatataaaagactggttccagtgaaggatgtcatggccttggccatgattgaaggctctgttggcatatggagggacattttatcagaacaaaatatctttgcaatttaatgagattcaatggaggcgggtattttgtataacttgtctattgcctcatccccaaatatataggtctgtccctttctttgttccatgaatgtgatcaccatgcttctactaacctcacagtcacctggaaggcttgttaaagcacaggccactgagcctatccccgagtttctgattcaatgggatcagtatcactcctatgttgctaggagaccctgatgctgctcactggggaccacatacctttctgatattaatccactgtactgacagctcctttttttttgaattttcttatttgaattagaaacaagattgtttcacatgtcaattccaattccaattccttctccctcccctcctccacggcctccccctgccaactaacaccctacctatcctgtaccctttctgctccccaggaagggtgaggccttccataagggggtcttctgagtctgtcatatcctttgggatagggcctaggcccacccccttgtgcctaggctcagggagtatccctctatgtgggatgggctcccaaagtccattcctatgctagggttaagtaataatctacactacaaggggccccatagatttctgaggtctcctgacagctttttaaacagagtcctccaatgcatctttcatattcagtgttttccccttaggcagcttgtggtgccaacaagtgaagactttcggaagcaagagagtgaggtgcatctatcttcatgacatgatggcaataggagttttgtatgtaagagaagtgttcacaataatgactactctgcatggccctgctgtgagttcagaggactctcaagatcataagcatctaataaagcagccgtgcagataatcccatgaaattagaggtgacatgctgtgaagtatggacgactggacagtgttgacactgtgtggcctcgagaagtacccagcacaaatgcaatattatgtcttcatttaatgcagtgggaaagccagaaagctactgaccctcataatttgattccatgttaccgatacacattacttgcttaacataatcgcctcttcagaccctttccagttcagacaacttaaaccttcaactccctgcacaaaagctggtcattttttttttctagccatcctgctatcagccctcatagatgcttccccctgctgggtgccactaatgaagacctcaatataattttttccaagatgaaaatgctgttctgaactaggaggggaaaggcatagccggccttactggccaagctagatgtgtttaacacactgagtcccagctcattatactgaatggcaatattccctgtcgagaacaggcaaaaggagctagtcagcaactgccattcattatgctgcttgcagcctgacacttgccctgatccccaaagccttcagccttgacctctaaatcctggcatctgaacatgaaagtagcagatgttctctatccccagtgtgaagaaggtcccgtggaatttcctgtgagcaccatgacaggccttgctagctgtaattgatatgtgctaaatttaagtcgaaataaaaaaaaaatccacctggccaatgaaatacaagggggtggtgcaattaaagatgaattctgtttctctgaaagtctggatgacattgcaaaggggtaagcaggaagagatgagttatatattccccttctcagtcattcattgacttatgtggaacttgggttatttcagctggtataatagccccacctggagactacatgctttgggtaaaggaagatggagatacaaagaaggggagatacagaccctccattccttccaagcacatgactgattaagatatgttaagattctattaaaaaaactgaggtgatattgctcagtgcagtggggtgactaactttcacaagataaggaatatggtcatcgatgtggaataatccttttgtgcagtgaagatttgccactcagattggtttaataaaaagccaattggcaggtagccaggcaggaatgataggagggacaaccaaactaggagaatgaagcgtgaagtcagaggagacacaagccagctgccaaggaagcaggacatgtagaagatgaggtaaaaagcatagataagaaatatgggttaatttaatgtaagatctgattagtaacaagcctgagctatcgaccaagcatttataatatatatgaagtctcccagtcagttatttagcaagtggctgctgtttatttgggagcagccggtcaggacaggaaaactgcctacaagtcataccatataatgcagaaaaataacagaaaaacacatctgaaacttttgactatggtcctcccagcaaaaactgagtttcctagccctgtatctcaaagctagacccctgcagggtccatttctcggtatgtatctcagtggggctttcattaccatctttgcagagggcaggcttagttaacccagccttctaggttattgtccttctttctcaggttgccactaacaaacgtaacagcagcagttatagctattgggctgttactggccccaacattctatgaaatattctacatatctgcctcattttgtccttggaaattcctgtaagctggaaacatcagcactattttattgatgaagaatagcatcttttgagtttaaataactgttcaaggatacctagctggtgagtgaaatccagtgtgcatgacctaacctgaaatcagggcatttttaaccctaaagtatgtactccctcacacaagtgtggctcccttagctctattaagttcatggaaattaagccatagaatattaagtgagttggggaagtctcatcaaaactacatttcttggagaatacgtgtaaaggaaggggaaacattcaatgatttttatcatgtttctgtacagcacaaattgtagtgtcagaagggtgtcctcagatatgttatcattttatggaactgattatttattgctattattattgtggttgttactattatttaaaagaaaaaatgttcacttgatgaatttccccaaacatgtttgtatacaaaaggggaaagagtctacatgcttgtcaaataaattgtaatgagttattaacaaatgtgctgtggagccaaatatggtaggtagcccttgggaggggcaaccacaggcaactgaaatatgaaatccgaagagtgagatggtatattgtggagtacaataagccatgatcctctctaattagataaaatgaagccataggaattaagagacactgtggctacagagccactagcattgctgaccatctccatgttcctttccaatttgaaggaaggggaaagtatggggcagattctgtggttgccttgctgtaaacagcatcaattttctaaagcaagtagctggcctgatcggggctcggcgctatgtggttaagttctgtttacaagtatcaaagcctatgaaacactgtgtgagctgataaaagctatttgaccatgccagagtgatctttctggatgctttatatacagagggcagataagcactgttaggaacccaagaggaaggccagtggcacaggaaatgaaaggaattagaggaaggagcacagaggccaggggtgtttcaaagctctcaaattactgagaggcagacacccatcctaaatggtaacaaaagcattagctttttgatgaacacaaatgagacacctgtaaaccctcctctttctcaagtgtttgaatatgtttgctatgatgaacaaaacacaaatttagtgagaagaggtccctcatcctcaagagccttccgtcattacgtatgccttttccgattaacaggtaatgagtgtgtgtatgatacttttattagctgaaaattgtcttcaaaaatgtctcagatagtcttcctacttcttaatttaaattggcatctccagccattctggcacacaaggaagaatgttttattcttggaaactactaaactgaaagtctgaaatgtctgctcaggagctccttttccatttctttttgttatgggtgatggcttgttttccaaaagtgatggaagggtatttgtcttttaagaatctgcctagcccccacaaagacacttgatactgaagtagatgtgctgcatttccgaccattgtgaaatgatacataaaatgattaaataaaatgcacaatcatatgtttaagtaggaggtaactcccatatttttttaaacagagaagcccaggctgacaggggttagtgaactggatcaaagtcccagaagcagtgagtagagagctggaactcaaagccaacctcccaggtgctttgaactcctcatcttgactgtttagtgctgacttttttctcaagttcaagatccatgaggtcctggtatgtcaacagatgcacatggtgtttatgttaaaaaaaaaatccattatcaggccaattgttctattccatatctgatgccatgcatgtgtgactatgaatccaacagccactcaaagtggagaatctgctaagtatgctagtattaactaccagaaagattttttccagaatttcagtttgggcagaaggagctactgttgtaaaatcagaatgagtaaacccagcttgatgctgtagtccttcaaggaaacatcaaaattaatgggagttttgcaactcagatgaccagagtaaagccctaatcatttgaatttaggatagtccaagattgtttataacatgaaaaaaatgcctgaagactgttgtgacccaagccttttaatctcctgagtcaccatgatgacttagaaatcattgcccccattttatcccctcagtcaccatgatgacctagaactcactgccccccatattatctcctcagtcaccatgatgatctagaactcatcatcccccgttatctcctcagtcacgatgaggacctagaactcactaaaccctagggatgtgctttatgtttgaaatgagatatgagcccagacatagtagtagacaattaagctattaaaaaacaaaacaaacaaataaacacacatacaacctgctcttatatactctggaaccttctaagtggttcatgtttcaactttctatttagaatgcattattatttcaatgtattaatgggaaagaaaggacaaaaaagttgtgatcaagaagaacaaaacccagcaaacttcttaatgtaaaaagcaaaaagtaagtaagtaaaggaaaactagcatttttcaaagatttttaaaagtctgctgggaaacagggggcttagggattatgttcctgaaatgcagccttgcttcattgcagcataaagtatctataattatattaagtaccttccaattctaactatttattttagagacatacatgtttcagattttctctataatgactttgaaaggtttatcatttttttttcacaaatttgaccaggaaataatcaaacatcattaactctctcttttggattcaacaacttcctttctttcattatcactgctattaattttttaaattttcagactatggttgtgtatgacagaccaaatattaataagcttatttcaaaaaaaggcttcacacattttatgcacatgactttatgtccacacatgttattcatgcttcctgagccttgctcatagcactatcttcagcaatcccagaggttggactgtcccatgtggtcatgtactcactcacttttagcaatgggagggaggttataactattagtgacaattttctgtggttctgttcatatgcaactcctatttgttttcagggatttttgcctcagtgtcatttatggtagtgttgccacatctctagttttccattaagagtgggaataagatattaaaacatacaaaagaaacacatttgaggacatgcagaaagcaactgaggagaaggtgtagtttgacaataaaagaaaaaaaaacatattaagaggaaggaaaaaccagatgaacctgtttaacgttcttaaagttcttaaaggatctgtgttggtgcctaatgaccattctggagcacagttgaacatactgacacaagaagcatattgtgactgtgacgtaagtgcaaacaaagatagcactgagttcaggctccatcccccacttctcacggagcacagcaagactatgggtagctgtgctgacacattccaaatacagtaccattgtctcatctaaatctcaccattctctgtctccacagataaagaggtccagaaacagaaagagaagacagacagacctgggaggagatgtgagaaatgaatagacacagcttaagattggaggcccacaagaggctcaggagaaaacacacatatataggaatgcctaaaggggagcacagaaaaaaagacaaagaaaaaggtcaaataaaaaaaaaaggatcaagtttcccccaaaacctcacaggacaagtgaagagaaacataaatttacaactcagaaacatagggtaataagcaagcgcaaacataaatataagcattttatcctgcaaacactttatttttcgtcccactccctgaaataaactcatgactaaataaaattatgcagcaaaatgtagcatgagcataaattttcatttgtttccactttatacagtctcaaaaactccgcattgtgtgcatctcattttttctcattttctgaagatttagtgtgtgtcctctggatacattattgttatctatatttatcatgaacaaacacaagcatattttaggcaagttaagacaaaactgctttaaattaaatgctagcaattaaatcataggatgaaatatcttaatagtaataaattaaattccacagtagtggttagttcttaattttgttatgacatgcatataatatttctcttaccatttcattattttcctcattatctgacccaaagtatactgtggtctcagtgaaccactttttacaacagtgttccaaaaactcagatttatgaataaggcatgtaactacacaccagtttgtgttcctctttcaaaactacattattcctgagaggttgccacctagggaaaagcccagttaccagacttcctcatatgtaggagggaatgtgactcatttttaacaatgggaactgagtagatgagtgagttaaaagctaagatggctactaccctgtcctacctgggagctggtttttgttagtcaatgctccatcactgtagtgaaacctccacccgcccccaagagagtaaatatctgaataaatgagtgtcctctcattgttttgatgtcacctgaccctgttgcttgaggctgtgacaaggctgcactacacggctggagtgtgtaataggacaaaacctttcctctcatgttatgtccaaagagcaaaactgaggtaaaagaagggaacacggtcacataatctccttcaaaggtaaacttccattgactcaaagacctcccaggaggtctgtggagcagttttctcctagataaagagctctgtcctgaagggaagctccagtaagactccggatgttctaaggagaggtggaaattccatccttcagggaaatcccttaaaactcagaaagaaaacaactcaaggcttcaggaagtccctccagtcttcatctatatccagtaaggactattgagagacatgctcaagcatgtccagctacctctaagagacagagaccagctgagatgcctctacaaatgctgagctgcctgcaaattctgcagtgtacttgtgccaggttcccaggttttctgaaaaccctgagctagaatgaggcttttggtgacaggctagtctttgagtcattttgctcctgtaattaacctcttacctatactcctaaaagtaaccccaatgagtttattggttcatcaagttacactctgctagaatccacgttttagtctattgtcagttccctacattttgtcttcccaggaatagtgtctcacaataaagccacacctcttaatgattacatcacctcctaatagtaccacacttggaccacatctttatttctgtccattgtgggggagaggaatttatcctgaaaactgaagcaagactatttcctgaaaaaaccaaaccatgggaggaaatctgaattgcagaattaacacagacaaaagcctaccagggagccagacacacccaaaataggaagctctaaaatttaagaagtaacctttcggtggttgaaagccacaggcattatgtggattgactgttagttcaagaagcattaaccaaaataatcaaagaataaaggacttcctttgtatgtatccatttctttatatttatagattttaattagtgtagataaggctgaaaacataacctcattaagtaatattgtataatatattatcgagtttaccaaagatgagcaattggcataaaattctttatgaactaaatgacaatgtcaaatcaaagtggatatttatctaaacaaattagagaaaatcaatcattattcaattttcccagaaatagcagacacctcttatggtttgctatttttaagtaatacgagtctcttgaactcctgaaaatttccaccaatctaacaaagagaaaaacacaattatccacttttctccccaaggatgcaaaattaaacaaactccaatgatgaaagcaaggtggcatgtactgtgtctgcctactgctgggtgatatagacaaattggtgtcaaaaatcttcaagctgagttggggggtggtaggggaggaagggagggagaagggaactgggattttcctgtaattcaatcttgtttgtaattcaaataaaaaaatgataaaaaaaatcttcaacctgtaatgtacagtttgtaggcactgacaacatgttgcacacataaactaggccaatcacatttctgacagacaatgagaaatggtgcagatagacacatggccattcaatttgacaaacaaactattgcttctgccaccaaagttgcctccaatatctctgaccaatgatgtcaggtcaaattaatagcaatctttttaactttcacacctggtagtcaaattggatctctaggcatcaggatataaggaagacagtgaacaaaatgatggagtactcttaagttagttcaaccagttaaatctacttttgtcacttaattagcagaaccctctttaaaagaatgccgtgatcctgaattttaaggtaattttacaattatggccctaaaaagttcttttatgccttacttaatattttggtttcaactatgactttctaaggaatatcttaaatataaaaattaggcttaaaaactgtctgtatatagataattacataatttgtgtatatctgagcctgtaaagttcaaaataattttaatactatagtaattgaggaaaattttagtagaaaaagctaatctgagcaagaaaaaaagcattaagtagatgaaggagccagtagctatggtctggctttagtcaaggtggcaaaccccctgttgcagggcacatgacatagcagtttaggggaatgtgggaaagcgaaaaactagagttgatgggctaagcaccctgccagtttggagagataatatgtcattgtcaagaaagtgaggatggagactcctaggctagaagagttgacagctgcctgaaaaggtcacagaggcccacagaatggccgagcctggtcaagccctccctttcctcttctcaagctgtccagctatcaagattaatgttcccacaggaagtggaatgctgtgatcttttctctttcagcaaaaagtaaaccttttgaaaactacactttcatgcattcatcttatatttactaatatcttttcttaggtcacagttgcacaagcaaacctctctctgaagggaaaatattatcaaggcaaacatactgcctgatgactcggtgacacactacccaaaggaaacagaggggggtgcacaaaatcattgatccctcatgccctttctcttccataatttccctcatcttttctctcatatccccagaactaaaaatttccaaatatacaatcttaatgtaaatagtttggaggatctttaaatgtcaccccaactcttactttgatatttagtcaacttgatttcatgggatgattaggaagtctctacattccagtctgaaagttgggcctcagtcacaagtccatcactagcagaaacacaagaatattggattgatggagtctagaacccacttcctagaatgatcattcctccacaatttttgaaaaaagcatcctagaggattcactgaggcagggaagtaattgctcttaaaccagagtaccagaatgtagttttgcctcttctttttttgtctctcagaggacagaagaggcaccaactttccaatctcctctgtcctctaaagatgtgttgctgtcctcagcaggcacacagcacatcagagcactttccatcatcaccatctaaaagtgccagcctgactgaaagaaaaacgaccatcacagaagataatttagtggataagtgagttgtccaccctcctgattctacacagactctatgtgatcaaatcacggaccatggatcacaccaccataaacactcacagtgaggcttcataagtcactggattttataatgttggcatttatcaaaacttaattgtatccattattaacacctgaatttcaggagagtatacacaacaatactataaaggtaactgccaactgtatctagcaagctaactgacaccaagctcatggacttgaccaacttttccacatatcttctatttgctaattattataagtagagtgattcaaatatcaaatttacagaaattctctcagtggtggaatctaaaattcaaataggactgaggtaggagcctatcccccttaaaagacagtttatcctggattttcagattctggttcatcaaagtatacccccacacacacacaccctcagagaccctttccccctttttctaggtaggtctcagaacagtgttttgaagtctttctttatgtgttagttagcactagacaaattccactaaggaaataagtgtttcctgagtattttaaagcaccccaaggatttcctctaagtctccaatgaaaacatctttgaagggcattttcaggacagtttgtccctctcaagtataactgatttgtgcttctctctctctctctatctctctctctctctctctctctcatctctcatctctcatctcacacacacacggagagagagagagagagagagagagagagagagagagagagagagagagagagagagagagaaattgcacatgtgcgtgctcgtacctgcaaagaccagaggacagccttgggtagtttgggtagtttcacaggtgccttccatcttttatttgatatggtgcctctcttaggctggaacttctccaagtagccaaccaactgccaggggtctgtctgtctcttacatctacaagagtatgtttctttcctgttctgttttcctttgggggtttgggtttgttttttatttgtttgtttgtttgtttgggcaatttgaccaacacaagctagagttatatgtgattgagaaaccatttctattagattacctgtaggtagacaagcctgtgtgctgtggagcaatatttgtatactataaagatgcattgctctcattgttaataaaaagctgactggccaatggctgtgcagaattttctgggcagagagaatgctgggaaaaagagtgaagccaggagtcaccagccagcagccagaccaaaaggaagcagcatatgcaggacaggtaaaagccatgagcttggggcagcacatagatggatagaaatgggctaatttaagctataggaagtagttagtaataagcctgggctatgaaccaaacatttataattaataataaatctctgagtggttgtttggaaagggttggtggaacacagctgattgagattccccccctaaaaaaaaccctccaccaacacctgaaaaattgattgaattattgattgctgaataatatggaagggcctggatagttgtgggtgattctacccctaggcacatggtactggactgtattagaaagcaaactaagcaacacacaaaaagcaagccaataagcagcattcctttatagcctcagtttccattattgccttgaattcctgccctgacttctctcagtgatggagtgtggcctgagagctaaaaaataaactaaaccctttcttctcaaaaagttgcttttggtcatatgttcatcatagcaatagaaacctaagaatgacaaatcgttatgaccaggtcacacaccatggagtctaggaatgaagtttagtttctcacatttgcaaaccaagatgagctatttctctagcccaaatataacttacttttatgaaaaagacttttgtattctatggtttctcttaatttttaaaaaatattctatgtatataggtgttcttaactgctaagtaatctctacaaccctggtatgtgttaaattgtaaacttttttgtattttctttctaggacatctcctataagaaaaaaaatcttattaaaacaggaagagacagttactccatcagaagctaaaacttagactttttttaatcaattgaaataaaactaagttttatagtagccagaagacacaaaagagagcaaatttaagtcacttcaagaaaatgatgccattcttttaattcatactctttcttacatgactttcacaaccatgtgataagtcagcaaagatcccaaaagaagattccagaaaagtaaatgaaagcaacgggggaattttcatcccaccaaagtgttgtgtggatcccaagttataaaatctctcagaacacctgatttataaacagaataacaccactcaattttaataaaaagcaggaacctcctggattcatgcagcagtcacacacaaacatttttccttaaaacacagactgcctggaaaccaatgctggaccaaggatatgttacacctctgcaaggctccctgtcaaaacagtgtgcgattgcatagacatcacaactgcatttgtttgtgtttaatttttttctaatgtataatttacatataccaagtaccctggaaccaccacggggaaatacgctggtgataaaataagccaatatcaccactgtaaggattcaggcattatgctggcctgcccctgtcatctggcagtatgcactcaggcagtaccctggtcagcccagacttcaatggttgagtagtatgcacgtaggtgcaaaggacccctttaaaagaaagacacccccccccttctctctttttccctctctatttctagctgttccctggggcagacaggccattttcctttaactgtctccctcttctcttccgtcctatctctgtttctgtctttgtctctgtctcagtgtctctttccctcttttctcttttcttcctcccatttccctttctaataaaacttctcactaagctctgtctgtctggcatgcttgtcccctgtctcagacacccaggcttgccatggaatcctccaaggtcccccactcacattatcataacaaccactttgtaagaaaagtagcaaacacagaaaaatatggtttccatgtttctttggtgggtgcattccttcaaaagaaaagaaatatgccaagaagaaaagtatgtagtattctttttaatgtagaatagaatctatgtaattacttagaaaatacatttattatttttccaacatgggacaaaatattacttctcatgactatgaacccaaagagttttgaagtatttatatataataaacgtaactaatatttaatcctcagtgagcaatgttagtaattgtaaatatcataagcaatatttctttgtgttaccattggtacttctgttaatattttagcatgttagcttgttaaaagtattctgaaaatagaaaatcatgttttaaaagtgctgttttagtgatttcagagacttaagaaggccaaaaagaaaaaaagattaatgccagtcacaactactttcattcattaattttcttttaatcagaaaggacaaaaagaaggaagcttaataattaagcatggcacatggagaaagaaacatatggagaaatatatctgccacaaaattatagtgtgggggcattattataagaaataatgccttcaagataacttgaaaagtcataggctttaaattccaaagcattattcatattatttccatatataggaaaagctgaacagaaaatttcatgcaaacataagttatactcaatatggatttgtttagagtaattgagtaatattttaagcagcttttctctccaaaatagaaagagattttgaaattttttaataataaaattgtatagtaattggctgttatatcaacagaatgataaatgaagtggaataaattacctgaaaatatcttagtataggacataaaatttaatgtatattatcatatcatgagaagtgccataatttgtcagcttcataaaattaggggtattattactttacatatatatatgtgtgtgtttgtgtgtgcctgtgtctgtatgtgtgtgtttgtgtataaatatgtgtatacatgtatgtatgtgtgctatagatttactcccaaaataatgtgtgtatgaaagagagatttaaatgctctatacaaaaggctatgaccacaaaagcaatatacataaatgaaaatgcttattgtatttacatacaactgcaaaagttctgcaagctgacaactcaaacaaacaaaacaagagtgacatgggggaaaaatgacaaaataactataccactaggctgtgagtccaggccctagaactgcagaggaagaacagtggaaccaataacagaaagtagtgacccctggtgctggtaacagggaagcagtgactctcctttaaaaggcatttggcaacacagtgacctttaagtgctcattgcatactaaaagtagacatgacccagtagtcaatcctaatttcatgtacagacacataggaaatctatatctagcattattgcatcacagaaaaattgaaatgttttcaccatccaaaaagaaaaagagaaaacagaggtataccatccaccattaaaatggtgcccactaagaagtgaaggatacagaaatcaaatggaatagtgtgagattaaaaaaaaaaaaaaaaactggggcagatcggtagccacatgagtagaaaaagcagagtgtgggacataggaggtctctgaggtgagactgggaatgggacattaatggaggtaaacaacaccctggggaaagagacaataaatacacaaaaataacagaatgcccaagtttcaaagacaaatttatatgtatctttatccaagtgaaacaatccagtacatgtgatacacacacacacagggatgggaaaacggaggaccaaaattatccaagtgagtactattttgattcagtgtgattcacagactactcgtggctctacatttctctttcataatttgttggaattttcaaatttggccatctgttattattaaagagaaagagtgcatattaccatcttggaaatccaatgaaaatcattttcactgctattgaaaatgttactttcactcttctagcagagtataaaatatatgaaaaattgatcatcatctcactaagtggattattggattccaactgctttttttgagtcccagctactttaaaatgagataaataacatgttctcattaggagaattcagaaacaagataatcagggtgatctgggtatttaagtgtctctattcagaagggtagagtggacaggcagggtttagagttctggaatttccacacatttgtctctgtagaaatggcttcatttgacaccacctttagagaacagggagtccgctactctgcttagtcatggatttgtatcatcaacttgaaggtttaaaaaccacctagatacccagagtggagctttctaccatgctgacttacagcacagcttgtgattaatatatatagaaaacccccatgactcaaagcattgcatctctgagtttagtgcatacttgctttctcacagcccaatcacttggtcatctctccgtgacaagaggatactgtatcagagggttcaagtaaataaaaacttgcatatgatcaagaaaggaaatgtttaacctttcttacctaaaggcctacacagctactgaatagcacctcagatcttagacctctactcactgttcagctcacttactgcttttgtcattttcagacagacaacaaaagttaaccgtgtcttctgtatcaatttatctgtttcttctcccagtacaaaatacagaaagtggaagtttgactgtttgacagtatcaataacagagaaattaaatatagccactcagagataccaagaatctaagagctagggtacatgtgaagatactagagacaataaaagcagctattcctttacaatatcctgaaacttcgccatcttctcttcataatatttcttttttaatcttctaatctcataatctttcctaaatgacttggaatagattagttacttctactagtctagaaaccacatgcattatccacttgcagactaattttagaaagctgcatgacaaagctgctgattttactgttttaagagcagttctattaaatgctgcacaggacatgtctaatggtgatatttcctcaccaactaatatcaagacaaaagtcttgccatagccatattatagacctgtgtgacttattttctcaagtcaaatttattgtggttgaactacagcaaggggatatttaataaactaaggcatgcaggacatgccaatggaaaataatgtaaagacatgtaaagaaagataagtaagaatagaactattagtacatggtgataatatgaaaaaattgagacattgctattttttttccagagagaatagggaaagtttcacaccaaaatcagaaggagaaatggcatcatgaaaaaatcaatagaactgatactttggaaaggcagaacctggctgcttatagaagcccagtgatgtatagacaactcaagcctacttcacttacagcatcatgcattctaacctgctatcttcattttgtgcatgaagagtacatcagttcagtttcagctgttcacatattaatgcatctttgaatgttgtgctttaaaattaaactcaaaaccaatttcccacctctacaaaatacgaaggtgtttaattatagcattcacaactaatgtataccaaggctgagagctggtgggcctttcttgtaggtagaactatctactttacctctataaagaaaaaagaaagaacataaatgaaagaaagaaaatacagcacagaagcaatggccagcaaattcaaagaaccataaacctatttccttagaaaaccaagcacaaaaataagctacgattttgtaaaatagcctccatgtcaaagattacaaatgcttaactcaaaatgagataaattctgcttcagagagagtggtgtttcaaacaagggtagcatttacctgaagataatgagcaaattgaacactaagttaaggcaaaggagaagaaagaaagaaagaaagaaagaaagaaagaaagaaagaaagaaagaaagaaaggaaggaaggaaggaaggaaggaaggaaggaaggaaggaaggaagaaagaaagaaagggctcatcatgtgtacaaccacagacctggtaatccctgagagttgtaaatagctaacagaatcatgttgtgaagaaaagtaaaaatcaagtctggtgtgatgatgcacatctttaatcctggcatttggaaggcagaggcaggtgaatctctgtgagtataggacagcctggtttacagattgaattctagggcaggcagggctgcatacaagggagaccttgtctcaaaagcacccccaccaaaaaagaagtaaaaaggaagagagaaagaaagaaagaaagaaagaaagaaagaaagaaaaaaaatcagatagtgtatcaagaagtaagtgtctacattaagaatgacactgtcagacagaactagaaaaaaatcatcctgagtgaggtaacccaaaaccagaaagacaaatatagtatgtactcactcataagtggataccagacataaagcaaaagatacacagcctacaatccataaccccagagaatctagaaccctcttccagaaacagatggaagcagatacagaaatccacaactaaccattgaaccaagctcctggagtacaatcaaagtaaagaaggagcaaaaatatgaacaaaggagtcaagaacatgatagggaaacccacagaatcagtgggcctaagctagtgagagatcactgtctcaggtctgacaaatgaggaggctgcataagaccaaactagactccctttatataggggacaatggtatatacagggacaatatatgaggccactggcagtgggtccaaaatccaacactaatgcacaaattgacttagtagagcccattctatttagagagatagggtgtgtggggtagagaggtttcttggacctacctcaaggagatgatgggatgggacagacttaatagacttcctaatggaggccttaccctctctgaggaacagatgggagatggggaggagtggggggagtgagagaagaggagggagggggaactgggattggaatgcaaaaaaaaatttaaaaagaatggcactgtcaaacatactgatatattatccttagttccgataacaactgtatttggtgagagtcagagcatacaattagcaggttagtacttttaaaagtcaagattgtaaatacttatgaaaattaagacgaagggctctcttcttctattatgccacctgatgcaaataaataataagattccaactgggttattgaaaacatcttcagtaactcaggagacttcttcaaagatctttacctgcttataattatgctttgaagaaatccaaaaaagcacatagaaaaatactaacgaaaagccttctggaccaccaaggtttaccaggaactgtttgactcctatgagaatatatgataaagtaaatataaccagggattcctcatcacacagcattatcaatttcctcacaagtggttcctactggcacactcatagatcatgagccctgctttgaggtatcctcactgagttagattccaggatgtggtcctctgttttaagttctaatagattagttcattttctccattcaactgtcttctgaaactaaactgtgatcactgtggtaaggtttcttctatctcacctcttggtgtagctcccatgatgacctacccttctactcacacttggcatcatgtgccatctacacagggtatgctaggatttaaaggacaggcacagtcagctaccaagcatccttccctaataagcaagatggtgagaaaggataaggaacatagatagtgctaagccacaaagctaaatatccccagaatcggaatagtgttttggatggtatggcagcccagagtctataatcacagtgctgggaggctgaagcagctacactgtaagttcaagaccatcctgggttacatgctgagaccctatcccagaaaaaaggaaaaaaaaaaggcagaaaaatctagaaccttggccatctgatccatgtggatctatgaacacagcatgactgtgaaggtcactgtcatgcagtcccagagccttctaaaggaagcttatgcttattgcagcccaacacccacactatgtcctacgcagagtgtattacacattattctctgaaatccatcattcttccacaaccttgtgcctgcctagtcactgtctcacacaccttcatttctctcttctgcttttcacttcctctttttcagcaaaatttcatccttatttaggacaaggatcacttctgtcttttgtcccccaaagattagcagtgtgttagaaagactctgagctctggtgctagaaaaatgtggattaccatcctaatcttctcactggtcaactgcaagaccttagaatgaattccatcacacctttgagcttcatctttcttctctgcaccagacacatattaagctatgaaaaagtcatctgagctactaagtcctgagacccacctatgagccagattaaaatgctgtttacacatttaataaagaactatttttcaagcaggtatggtagcacacacctattattcctaaacttggaagactaaggcagaagtattgccctgaatacaaggccaacctgggctaccaagggaatgcaaggccagcctagatgatataatgagacctgtctcaaaataaacctatatatgagggctggagagatagctcaatgtttaagagcactggctgttcttccagaggtcctgagttcaattcccagcaatcacatggtggctcacaaccatctataatgaaatctggtgcccacttctggcctgtagtcatacatgcaggtagaatactatatacatgataaataaataaataaataaaactatatatacaaaacaagattttagatctttaaattatataaaaactcataagactttagcttacattctcatgcattgtactatcttctttactggaaaaagtcataataaaatgtttaaaatacatggtgaaagccactctgacaaagaccttatttcacagatttcttaaaactatttcttgataagatagtcaatctcaaaataggtaactctagttaaaatataagcagtctacccattctatctgcattatcaatcaaatgtgtgacaatggccgtccagatgaaatcatactaacatttatcacaaaaggaaaaaaaatgtcttccaagaaattccttctgactcatctgggtgagcctggtgttgccttcccctcagccttctaactgctaataagtaggtgatttgctggtggtgcaggcaacattccaagctgattattgggtcacatgagcagaaaaggcaccccctgttcatgaaacaattatgttaatcctttaattttttcagagcttatgcttataaaatattctaatcctccaagaatataggtttgggttgcagctggtgtttgcatattacttgttgagctcactaacattttcaaatcttacatattcattcccacaaccccaagaagagcaaaatagaggattattacttccatattaaagaggcaaacaaaagctaatcaagcaatgtgaggtatatatgaggtcaaacagccggttaaggccagatagggcttgaattttgattttctgaaccagcactatttgcaatgactctaagcaaatacagttcctaacattaaaggaattcctcttcttccctggatagtcttaacttcctttggtttctttcaaatttaacctaagattagatctcagttgtgcctgtacaaacacaagggttgttaattttcctaagtagaatgataaacggagtcagtgtttgaatgactggaaaaaatgatcaaaacattttgaggcatgatgtgtgtggacataaagactttcttatgtcatgacctagagacatgataacatatcttgcatctacccataaagaatcacatgaaagtttgttctactcaagtgagaatcttaagcagaagtgggtcagtgtgattgcctaagcagcaacagaccatagactggagcttacagttccaatgagtttttcattgactacaaaccagactgtaaaacttacttctacgtcatattttggcacagttatttgaatttcaagtgcagacagagcaaagagtaagggttgattatctgcataaatgaaaatatggatgaggggtgttgtgaacatgtgacctcaaaattgggagacaaactaatagctgactctgtacttctaaatatgcaaggaatatccatgtagatgagtcgatgggaaccagagcagatgcttgaatgttattatagtatgagtgtctgtggaagtgtgagatattttgctcctcacttgggtaatatctactgtgatcagacatcaacaaccaccctgcttatcccattcacacaataatttatccaaactagaaatggttgtaaatgacaaagttgctactcagcatgcacatgtaaaacaaaaaggcatagatgtgatggcccaggccttcttcccagaactctggaaacagggatagatggatctctgtgagttcatggccatcctggtgtgcataatgagttccacactaccagagctacattgtgagacccccaactctgataataataaatattattaaggtagactgttttaaagacacaatagtcagttgctcattctgtcgcttacagcttgctgctgtctcagatagaatagattcatgcttaggtttctaagctaagtcagaaactctccaccttcccccatgatcccaagaccttccatcctgtcactctatccactctaccagtcgtggtctcttatttctttctctaaaagaaacagaaactgggtgaagataaattaaccactgttattgatctcaaaacatgacttcttttattctagatgtcaaatataaacttcaatgagattaaaaatagaactcagaaatgactgaactgaaaggaagtaagaacattcaaaagcattccccttcaaaactctgccttttgatgtggttagaataaaaaaaaaaaagtactgtaccttccacaaagcacttgaataccccatgacaaaaatattataatataatcctataattttaatttcttcatcacttattagatacttcagccttatatgaacaatgggtcttggagccaaatgtaatttttatgcatatgtgaagctgagaaatgcaagaattctgatcccaagttattgggagaaagtttcagactgagcaacagcaaggaagagcaaccttttgaccaaaggtacaaccttctcttcttgccctgtggtcacatgctggcctctgactgcctcagcggccccaactatgtcattatatttctattgtgaaacacagtggaaccagctacaaaactttgtgcttattcccaggaaagcgcaacacgggaacattttaatttagatgttagttatttcaaaactgaagagcagcagtgtcctgatttaagataaatctaatgatatatgttgatattgaaacagaataaagtttcattttgccaaagggaagacctttgtagacttggatgtaaattcagttttgcaatttgtattacttttcaagctcattacaatttaaatttttaaagtatttcttacttatgagaactgtaatattgggataattgccatccatttaaaagtagtaaacaaagattcaaaatgtctcatcatggggtggagtccttaaactcctctattaagaaacttcatattttaagagaattacttggcaaatatgtttgtaagttaaattggtttaataatataggatttttctataaatttatttagagtaagttaattttctatgaaaaaaacagtttatataaccaaaaaccatcaaacatgagtatatataataaaaatttgaatatattctaggattataaaattagagtaatttttagtaaatagtttcacaaacattaccataacacacacacacacacacacacacacacacacaaaatgctgttattttctaatgagttgaaatcttctaattgaacacataaagaggaagatttagctcatggaaggctgaatctaaaagtgccaaaatgaaagataaaactaattccaagcccagcttcagtctttgctcatgcaatttcattattaaacattaaggcaagatttttttttttgcttgcttgttttgttttgctatctttaatcagattgatggttttatataaccttgtacttacaggccatatataaaagtgtaataagaaataaaacagttggtgagaaattaaatgcctatcttaaaaatttaagagtgtaacatctgaaccaaatttaaacatcaagattgtttggagggccactgtgagccagttagagggattgtactgcctcagtgatctcagagtactttccccaaagcaagttcctcttctaagttatcagtgatacaaggagtgatgactttgagatgccaattaatataaattgggagcagaagagatattaattaaacgtgacactctgattatttaaaccttctatttaagttgatcattcagagcacggtgatggcttgttcttcaaaaatgatggatggcatcaagctttagtgactccctctatatctgtggtttccaacacttcagaacagaaggaacaaatgatgtgagaagaacatgagaacaagtctaatagacagactgactaatctcagacccccaaggtcaaaccaaagcaatctgtttcttagctttcatcaacacaagacatgatttatcaatcgatgaacagtgtttcaaacattatacatctaaatgatatgttctttgtactgtgtaactttttgaacaaagatagattgtgtgatatattccctacaaaagtaatgtcatgagcaaaactcattatatttcccaaaacacattaaaaaaaaaccctgaatatgtcatctgtcattattactccacatgccatttggggagattatatttccaaactagattccttggaattctgtgcccttcatagtacaaatattacacactaacatccctgaaaatagtcctcttattctaatacatttatttgtgaagttggttgatgatttaaatttatatttaaatctatagataattattaaagacaatgttaaaaaaaagtatttcttgtgttgttataaaatttagtggagtttgatagatggctcagttggtaaagtgcctgccacacaagcctgaggagctgagttcagatccccagcatctgtataaaattcttgtgtggtggtgtttgtaattgcaatgctgacaaggtagagagctcactagccaggaagtctagccaattggtgagctcccaggttcagtgagagacctgtctcaaggatgagatggactagggaaggttgagagggattagggaagacattcaacagggatctctggtctccgtatgcatgcatacacacaggtgcatacacaccagcactaatatttatagaggaggaagtatggttaaagaaaaaaggtcatgagaaaatttcttaactataacataatgtaaatgcaagcatagatattattgtcaggctgttctctcccttgttacagcacctaagaactattttatgaggcatgcctatgatagttcagaaatgagttcatagtgtcatgttaggtaatctaggagatgcctcaaaatgagattacatgagaagagtagttggttgatgtcatgaaatttcactcttcattccacctccgtaaaatcgcatggctattttcactggcttaaattaattaccaccttctttccattagtttgggaaagatctgattgctcatatgaaggaggcagtaaaagggttatacccttggctgatgattcatcgcaccagctgccagcgagttgcatgtctcggcacacctggatacatgcaccagtgactgattaggaaacacatttatcttggtgcatcacaaaggagacacaactgtaattactctcccctgtaatgaaacgcattctggaacctgtgtccacctacaaaataatagaaagtacgcttttggacccgatccatgtaattgtgccatctgttcttgatacttagctctaaatatttcccaaatcactcttgtgttctaaaaataaaatgcagtttgaaaagacctacgttaactgttaaaatggtcagaagatatcaatttaaaacctaacactaatgaaaatgatcaaaactcagagtttctttggttgataaatacagaacatgacattaaccttcactgtgtacttaggaaattctgtggatttatcatgttttaatttggagaaaatgaatatattggctaagtttttcagagccctctaaatgagaactgacttaagtgtcccatgtgaaagaagaaaaaggaatcaaagcttttgttcttcaacttgtctcattataatgacctcaaaattctggagactcttaacctatactgagaaatcccatatattaagaccttaaagtaggatgttgtattaggggactagagagatttcatagcagttaatagcatgttgggttacatctaattgagttgttgaccaaaggggtcctatgggaatccccaagcaaaccaggttgttgccaagatataggttgctctccacactgacagcaagcccattgctgaagataacacctacacaattaatcgaacatgaagaggttaagccagtgcctacacagagccttcacccctacattacagcatccttaagacaggaaggtactctacacactgtcaaaagagaaacaaaaacatcaacctactcacaaaccctttatctacagtggtgtattgactgcaggatacatgagggcaatggtcacacaaagcttgtgggaggaaacatctaatttaacctaaggcccactccacaagatggaacccacacccaactactttggtgaccaagaacctgagggtagatagtccaggaatctagagtaaaaccaaataaaaatcaaaatgtactgataaaatgacttctattgatattctgctatcctcataaatcagtgtgccttgctcagtcatcatcagtgaagcttccgcctgcaacagaaacagagacccagagccagacatttcatataaagtgagagaccttggaacactcagccctagatgggatgtcttcatcaaattcctccattcagagctcagggaacacaatggaagaggagttagaatgagtgtatcagccagagggaatggaagacactaagaaaacaaggccctctaaatcaacgtgatcaaagctgatatggactcacagagactcaggcagcatgcacagggcctgcacaggtctgcacaaagtcctttacgtatatattatggcttccagtttagcattttgatgagattcctgactgtgtgaacaaagtgggtctgactctggtgacttctattttctgtctattggtttctcttgtccaattttgatgtgatagttttttattttatcttatttactttattctgttatatgtaaaagtgaatgaatgaatgaatgaatgaatgaatgaatgaatgaaaaacaagccactagggtaaaggttaacaactgaactggtgatgatacctgctgggagagcgcaaatcagttttctcaaatagagtgatagtaagtatatcaagcactccaggataggtctgatgttcaggagtagctgatcgaatgccattgttttgtgtgtgtgtgtgcttttattttgttacagttggggggggggggtcgtcagggggaactggctttattttgttttcttggttttgaggggttttgttgttatattggggttttgtttcttttcttttttgtttctttttgtcttatttatttatttatttattgcttttattttgagacagggtttctctgtattgcttttgagcctgccctggaactcgctctgtagaccaggctggcctcaaacttgaagagatccgcctgcctctacctcccaagtgctgggattaaaggtgtatgccaccaacgcccagcggttttgtttctttttaaggaagaacttaaatttcggtgggtagggaggaagaaaggatatgaagggactttgaggagaggaaaaatatgatcaaaatatgtttaaattttaaaatgcttctaaataacaaaaaatttaatttaaagaaagcatgtttttccaaaggatccaatttccaatactagcacccaagtcaggaggctctcaactacctataactcaaggggatctaacacattggcctctgcagacacctgcactcatgtacacacatacacacacacacacacacacacacacacacacacacacacacacacacacacacgcacacacacacggacacacacacacacaaagttttaaacaataaaataaaaatctcaaaaattagatattgaattaggtgttctatataagtttagtgaagaatgtatcaaaatcaacacttccagaaattgaaagtattcgatccaatattttaaaattctagtattacttaggatcctgtgagcttcatgattgaaactatagacattcatgtccctcaaaactctaatttttattgtaatacatatgcaataatgtaataatattctaagactgtttcataattgcttttaaagatttattttttctatgtgtatgtgtctatgtgtgttcgtgcataccactggtgtgtaggtgctgaaagaaactaagggtgcttggagttacaggtggttgtgagctgtctggtgtgggtgttgggaaactcactcacatcctctggaagagcaacaagtaaccttaactgttgagccatctctccagaaccaagtgagtttttatttattataaaagttgtattttgtttttttccattataagtagccttactccctatcaatataaaacctcaatgaattctctgcacacaaataagactaatcatgaaacaaatattcaactccagccctgaaaattgcaggagctggattcaatatgatgtggtgatttttcatactcatttcaaaaatgactgagaaaacaaacttgcttgggatgctgaaacctagaaaaacactcttaaatgagtaacggtttaccttgctctaaagtaaggatacaacaataatggtagcaacaatcaattatgtggagattaaaaaataatcatcactaatctaaatatatgtgctaactccttagcacaccaataaggcatatactattattattttcacttttcagatttatctttgaagactatgtgtgtgtttgcatctctgtgtggtggtatgtgtacatgggtacaggtgcctatgaaagccaaaagcacaggatcccttggatttggagtcagagacagttgtaagcaagtgatgtgggtgctgggaattgaactccagtcctctgcaactccattttcatttctttttctttttagttaagaaaaaaaatctctttctgggtggtggtggcacacgcctttcatcacagcactgcagaggcagaggtaaaggcaggaggatatctgtgaattggaggccagcctggtctacagagttccaggacaggctccaaagctacacagagaaaccctgtctgaaaaaaagaaaattcttttcagtgaaaaaattcactgaatcaacatatcacagtcactgttccttagtgtttataaacactgaagcatgggcttagtctgtgtctgaaactaagagatgaaataccattaaggaacagacttcttcaaccaagagccattccagggccatgtgtcagaaacatgtaacagcggtatgaaacacttaaagacagacacacatacatatgcacacaatagcagcatgtatctagcaaacacatctgtctaaactgttaaacaactccacctagaacagtgcttctacagcactgatattgtgatctagaacatgtccataaaccattacttactatttttcataataaatattcttttacattgcatttagcaatcagtgtctttaaaatatttcagctttaaatgcgatacttagccttagtcactcatttcccaaaatcagaattcaatcaatgtttaacataacatatagtataaaatgccctttctctgggtcaccgcaccacactaaggagtctacaaaactaaaatcacagttccacctatttatttctattatcagtgtggttacagccactaggtagtttgcttatcatttccaagaaatgtaagaattgcttccttgtaaacattccctttctctttaatttcaatgacaaatatgaaaacattcttataaattgaccatatttcttaataaattggtcttcttcatgttgaaattacacattgatttacagaacagtttaatcagatactatgaggcaccacgttaactcccattgttgactcttatgttctaaactctgatatctctgatatttggccaaatgcaatcagctaaccatctccaaagacacccggggccataatttgatagttcatcttactttcaacagtcagcccttaggcacactctctgattccaacctgtttcacaatgatgtactttctcacttcaatacttctgctttttcccacaggtaaagttctctctctctctctctctctctctctctctctctctctctctctctctttctctttttctccgcttcctgcactcttgatgagcaacatgtcctaggataaagttaagaacatcccattttctctttggtagataacactctgctgtggtgtcagtcacactattaagcttttgtttccatacttccattcagggaaaacacaataaaatggttgcagataagactcattcatcctgaaagaggtgcttacacaatagttagaagatagcctatgctgaataaaggcaaaatgagttaaatatcattatattttatatttcttaaattttccttctttaattgatatttattttttctatgtaaagtcaaaattttattcaaaaatcatgaaaataattaattttgcagcctattttgacccattgtttaactaacatcaaatctcctatcaatattttaatgaagaaaatgttaaaaaaattaactgagctcccaaatttacaagtttctataacatctttcatttacttcaccaagtttccattcattatactattctctctaattgcatagtttttttaaggtacatgtggaaataattaacttttttagttcaaactacacttataaagagtctgtgttaggttatatgtatatatgtaaaataggttatataaaacatatcattattctttcctatgttgagactgtaaggcaatttaggattaaatatagcacatgattatatataatatatctaatatatattagtatataatatatatttgtggggggtcatttatagtgaaaatttaggtgggtttatctaacagaacaatgatagcaacaacagtgaaattaactggcacacactgggtttcctcttcaagcctattattcaattagaaagttcaaattttattttaacgaaaatctcacaggaaatgaggttacttacttttcaggattttctacttcttcagtaataaagttgaggtaaaacctgtaatttaaattaaaaaaaaataactattagtatgttttaccaccacatgttaaacattttaaaatcaaactaagaatcgtgaaaattacataaaagtgcatgcagggagatgtaaataggaaaccagtaagaacttcaatagcacattttctactaaatcgtagtgggggcattaaaatgtgtcagacacaatggcgaggagagtggaaaccgcataatctgtatgccaagctcacagtttacaggacagctcagaacaacaggatgcaatgccagcaaagggcacagaagctagaagagtagaggcagccccaaactaaggtgggggaagcatttccagaggaagttccccccaacctggaccttcaagaacgcacagcatttcccatattgagctgccattccaggctgaggttggtccagagcacagaggtgtgaaacaatggttatatacagggaaagaaggaatgctatagtattctgccagtgggaaagaaagtatggaaggagaaattaagttgaaggtggcctgagtttcctgtaactctaaatttagagttagaaacaggaaaatccaaattatatgagatcaaccttgtagggaactgctatcgatttcctacacagaacacactgcataaacagggaccaaaacttgtaggaatgataatttattatatatctcaaattttcaagaagataaagtttcaaatgttttgccacaaaaataaaaactatactttgttatggaatgttaattactttggtttaattatttcatgttgcattcataaatcataacctcatatttttacctcagaaatgtatacgatttgccaatttataatttcaaactaaaataaaagtattaaaccttccattcacacttcttcttcaaattcactgccagtgtttaccctttataacctgattcacaagcctacagggaaggaggtctcgggtatgttcaggtagttaactgtaagcacattgttacttactacactgtccatcaagaacaaaaaagcagggaattttgaacacttctcaagtccataatacttttctggaaatcatacgtgaaaagaagcattttaggcagaaagtatttcactttcaatgccaacgggatctcatattcttaccctaatgtcagggcctgagaaattcttattgctttcttcacagtgagctactaccaagcccatacagacatggctaatgcctttcatcctggacttcattttccaactaaaaggggctgctggaggccctttaagccccatgaagttcttcttaagtatcctcaaagaaaggttgaagaaaattaagatttctcatgagaacaactgaacatagtaacaagaactacctatatcttcattccataaactcagggaactctcccagagtgaaaccctaaccctaaccctaaccctaaccctaaccctaaccctaaccctaaccctaaccctaaaccctaaaccctaaaccctaaccctaaaccctaaccttaaccctaacccttctacagttatcttattgttccttagacgctaaaataacctaaaatggcacatggaatcataggtctgaaagtcaaattgtcttctctctaaatacaaatatccagaatattagcccatcgcctgccacatgcttcaatcatctcacaccctagaagaaaggagaggaagctggtcctaactgaattcactagtcagttgatgttcaagaagaagatggctacagctttaataactaagttataaatcaatattagaaattcattgactgaaaatatggtagcaataagggtgatataaaaagtgtacacacatacatataaaactggtgatacattttaacaaccaaaaagttaaatttctaaaaacagcagttgttgttgccctagaaaggtgcacatatagcagactgcatataatgttgttattataggaaaagcaacagtcattgtgacccttgctatgtgcacaccccatctttcaccatataatgcaagctggaagaattgaaagtgtggactataaatgagctactattcttgcattaaatgtaccagagacagtgctgtggaatgtgctatttgagacagatttgacatgttcgttataagcctgaggcaacaggaagtatggggaacaaataaaaataagtaagcaaatacattaataacacccaaaactgaataaatcacgtgaattaaggaatagtgcttggttttgcatgtcagagatagccagttgctttttaatagttgatgaactggtctttctcaacaaccttaaggcaaggagaggactatttctgaaaaagaatgcaacttcaaatatttttttcttagagaatagagaaaaagaaagtgcttggggacaattttgggggggagaggacagcagatcatttcaaagccaaagtccatgcactgtgggaaataaactgggacagttgtctggtctcagtatggaatgaaggccacagtggtccctttcccctggtttacttctgaaggcccctggagaacactcacaaggtgtattgtcccagattttctatgactgtgcagaaaatgctatggttggccctgcattgtagcacccaaccttgtacatgacttttgaaggaagcagattctttaggtgagatttgacacaaaggcatacaataatctttgctggtgcttcagggagactaaatccattgaggatccgattaaagagggcgacaaaagacactgaaaaccaattttctatcacacagtgaaaaaagagaaaaaaaaaaaaagtctcaccacactgtgcttagctctggacctagatacaggattgaaattggttgacttccccaaggccaccagaggactggcagatgtatttctctgaatacggacattggcaataatatgaaagttgttctgacctgactccgtgacctgactgagttaatgatttctttccccctaatcatgtttcagtgaaggagttttcatcattctggataggttctgtgctcctcggagccaaaactttactccattcaggatccccaggggttgctggtatcttcttcctattcagcctaacagctggaggtgactgctcttagagtaaggtatccaggacaacagagggctagcatgcttcccatccaaacaggtagcagcctggcttgcaattcctgaccataactgctttgtttctgtctcattacaatgtctccacattgggtttatttcttccttttctttccccacttaaataaacattattctacagcaatgcagggaatggtagccatttacagtcccaatttacaagtgtgcaagccagttttgcactcacaaggtaaaagatggaggattcagatagcaaaggtttttcttacaatgctcccatctttgagacccatttcagactccaccttgatacatttacatggaaatatctacatctatggagtactgagcccaaagattctttcttgtacttgtgcttttttttctaagaccgagggccatagattcataaccagatcattcctcctctttccaaagcagcattaagccagcataataacccatgaagcaaaatagttccctatcattccccagctaagccacttggatcagataacatctcatttacaatcctagacttactttccaatagtgtgactgaaccctcaaacacacatacacacacacacacacacacaaaaaaaaaaaaaaatgaaattatggttcctggctcttcaagctagggttaagacacaaggattactgggggggggcagagggcggggagtatatatcaagttttcggtaaacctcctttagaggtgaaaacagtggcacttcggactcagcatcagtaaaatacaatattaataagataagtcaagatgaagagagtctttttccacaaaaaattccagcactcctcaaaaccctcagaagtggagaaaattggctgtacatgaagcaggtgacctgaatattcagtgccgggtggtggtggagagagggtagaaatgctttaatattccgtgggaacagatgcatggtgctcccaggcaaaagaaactccattcaacagaattaatcaaatctgccttgtgaagatcaccacattccacattcttgacagagtacaacaggctcccagcacccagctggagctgaaagctcttgttccctcccctgatttgctctggggctcccagggaccctcactgtggcttggctgctgccccagggcatggcgccctgattcaggctcaaaagacatagaggagttgattctgctcctaacactgtgatcacactcagttcttttctctgcttagcaccacattgtgctttgaacaaaagtgaaaagacttcaaaaccattgagattcaaaactaaagcgtgcacacaatggctgcaagaaaatcttcttcgggtatacaaatattttacactgatcttcttatgctataacccaacagccttcaaacacattttgcttcaaagctatgctaaacccatgtagctacactctgctgattctcttctaatgccatattttcacaatttgtgagattaatagggtacatattctattgattttggaatgcatttgtatattccctaaaagataagatccaaaaacataaacaaaaaagaaggaataaagaagagaaaaattgtattcatgttatatacatattcacattcacataattgttgagatactgaagtttctagatagtatttttaggagtattgtcacagctttaactattggttttataaatatggaaaaagaactattaccattatttactccaaaacaatgaaaattaatcgtcctgcaatgattttagtgtttcaacaatatcgtttcacctagtgggctctcttgaaatagtcatttcaacttagaaggtcaatacaatttagttacaggaagttcctctctaatatttgattactgtgactcatgctcctcaacaaaacagtgctgcgccagggcagggaggaatcacaggcagacaagcatgaaggaaataaacgcatccatggcatcgtggtgccaatcacatttgctgcctgtttgtgttttcagctactggaagcatttagatgaaatatgtaaaggcccgtgaatatgctgtatactatttgatttttattactttgatttctcctatcctgtctttatcatacgaaccattttgatctcctgagaccatctcatttctacatctaaattgtttcttcctcataacagggtagacaaaaagtcattaaccactatttataaatatccatggtactctagcacaaaggccttttgacagggagggtactaatccaagtatcccatggcactatttcatcctaactgatgaataattagaagtaatgtatactgactgttgaaaaccagcatctgtttgtttgtttatttttatgccactgagctgaatctaataacaaccctgactcatcagggactcctaactgtataagtttgaagctttgccacactgcaggaaactggaaggacctctgaagaaggatcagtttcaagtatcctcccaccttcccttcatgcttctctttctcccagggtaagctgcagaagataatcagtcttacctaagtgttcccagaaactagaacctatctcccacaaaggcaactgtaaaacctagaaatatgtctcacacttcctcctgcctttctgtggaaagcagctgcactgttctatgctccactttgtctcataatacatcgtaagagccttggttgagagaggttctattctctcccagggggaagaaatgttacacaaaaaagtcaagaagaatctgaaccaacacgtcacttagtttccctccagtctattaccattgcactatatcttttggccatgaaaattacttttcctggctttataggtcttcatttctgagaattccatgttacttgaaactttgactaaataatcactgtgtacctgacataatgaaaatctagttggggaagaaatgtgtgatgtgcttcctcatccgttactagggtcaaagctgacactcctatgataaaagacagattaacaagagaaaaggcaaatgaagcaatttaatgaagtatctggagatatccacttaccaaccagcatatgcatacatcccataataaaaagccaagggcaaccccattagatttgcatctcttcctgaaaatgcatcttcaaagtgctgtgtatgacctgcaattaggatgcaaggatttttagagctttgcaaagaattttctattatttgttccaaccctgacatggttgggaggtgagctgccctgttctgactctctgttcacagccaactctattgatactgcaaccacgctagggcaggagtctcaaatgcacacttgttgtcacctagaccattttaaagttcttttgtagatgacgagcaggatgaaagtggcacttaaaataggtgatatcatttccattgtttgagtgtcctctattttaaccaggatagtagactaaagcttctcctattaattgaagttttaagtttgtcaaaattcttagaagataatgaatggcatagtagggatgaaaagaaatctcagagtctgccttgactgaggaggcatcaagaaatgcttgtcctgcctcccacatcacatcacttaacaccctgctgtttatccctggagtacattggacacctgcctcctaaagcagggaaggctgcagacaaaactcactgtcaaaacccaaaaggcttgttcatataaaggttcatatcaaggttcccatgcccactctttgtagaggtaacttattgacactgtattggcccatcccaccattttcttctaaaaatatgaataagaaattgtaccaaacctcaaaccaagttttaccaacgttggcatcaacatgcagactgaacacttttgtccatcacaccccctccccctctatgttgtggagagcgggtatcttttcctttgaatcttttgggtagattacaaaaccagatttgtgttagtaagcacagattcaaaactaaccaaaaaattatctgtgtcatccaccacccccaaggaaaacagcaaatgagattactcaaataggaaaggaacatgttttaaaactgacctttagttcaataaaagggggccaagaagagaaaaggaagaggatgtatatacaacactctcttttaagtcaaatatcagctattgcccacatcatgagaccaagtattcatagtgatagaatatgaggatgggagccaagatggacatggttgtgttacataaagaacaatatttttttctcaaagcaatcaacttctaaatatagttttatgaaaacttgacaaggtgaatcaaaaatgcccattttcctgaaacatttctatgccttaatagaaggaaattatgcacactgagatctgttgggacttgagaggatgctctgcacctaaaaacagaggatctgagttcagctcccagcatccatacaaaccatgtgttgctccagcttcagggtatctgatgccctcttcttgcctttgtaagcacctgtgcttatgtgcacatcatcatttgcaggcatacaaatgtgtgtgcgcgcacacacacacacacacacacacacacacacacacacaaacatgtacacacacaaacacacatctaaaaataaaatattgtttaaaagaaaaaaaacacctatcgagtgttcttctatgatctgtggtctccttagcctaaaaagaaaatatcctttagagtgtagcaattagtaattaataagagaaaatatctaaactgtaaagactgggctacagttcttcaaatgagccactttgagagtgttgcaaagaggcacattgtttctgaacttcaggaacattttggatgcataacagaggccttaggaagatgaaagtaacattcaaagggaagttccaagcctcataagtaaatgcacaatatccagctacaattaggatctgattagagtagaattaaacacatcacacttattggtgaagtctttttcttcctggggtctcagagaaatgtggaaaaattaaatggttgtattacaaatttaaaatctcaattttataaaatttcatagtaataaagaaaatatgactggtctccaaagtactaaaaaatgctccaaatgcagtaatatcctcagggaatttctctgttgtgtgagaagcaagaattggggtgggtttatgttctggataccataagcaataattaaaatagcactgtattgtaactgacaagaaagattcaggagtttcaccatggtctctgttctcaagtaatttgtgatgcaatagcaactgctaaccatgctccattacatgctaaacatacatagatgaggggtcagaaccagctacagactataactacatatcatagccggcattataccaacaggaaaagccagaaaacagccaagtctagaagggctagggattcacccttccgttactttccagaatctcaaaggctctctacagaagactagaaagtcagctcaggagatgaaagctctgagagtgtgaacaattttgcctcctttcagagtggaatgtgagcaggccagctctgtggataccatggtgaattgggacagcaagcccacatcttctcatacaccagctctactgttcaaatggcacattgtgtttattcagagactgaagttttgggatttggtgaaagcattttactggcaggactctaagattgcccactaggctgattaaatggacaagaacagttccctctcccagatagagtaaccaagttctcagtgtttggtgcctctaccaatggcaagggttttcctgaacttcgtcacttccttgtgtattggaattctcctcctgtggagtcattaaatttctctataaattccttttcttggaactgacgatgtcaatgtaaacaatatatatttaccatgcccacatgatatatcagtttttaattgatttgctctaatcatttctcgttatttcctgttgcaaattcagtaaacccttggactctctgtctcttccagccatttccaccaaatctaagccaacacacattaccaggccaaccctaactctgtggtagcatccctcacattcttatcttattaaataggaagctccatgactgataaatccagaagcttccccattcagaaatacaaattttacagagaaaaatagtgtaacaattagagctaagttttttcaactcttttattgtcacataaggatcctgttttttggaatgttattcttaaaccccactgctcttctgtggggtaattgtctcagaataaggaaatgcaaatgagaaaataaagacttgttagtcattttccattattttcaagaactattttatcatatttgttgctattattgaaaagttctgcagtgcaaacaaaggatatattgatctgtacttaaagctatatagcaaattcattgtgtgtgtgtgtgtgtgtgtgtgtgtgtgtgtgtgtgtgtgtgtgtgtgtgtgtttgtgtgtgtgtggagtggtgaggtgtttttttctttttcactttgggttttgactcctagtaattttaatttataccaaaagaattcttagataccttatttttgttgcttggtctcctcttaattctcttgctgccattcgactataaatactaacttaccctcagtgtagcctttcaaatcaattagatgacagtacagagtttaagttccacaagcaaagactaattaaggattctgctagacaagcgaaagtcagtgttagaagagaccagaagcagatacgcagtttaaagcgcatttacttttcagtccatacctttaattagctgtataactccagggactataattatcaggattgctgtgagcttgcagaaggttaggaaaatctggatccgggcactccagctgacactcatgctattcaggaccatcaccacagctgtaaacaaacagacaaagttacaaaaggcaaacccccatgagcacaatgatgtcttaggtccttgtcagtcgaaatgtgatctataatcctgcagtgctggcatgaactaccaggaccaaagcagtgcagaatcccaggctcttccccagatctagtctctcccccattaagactgctctttgatatacattcaagcctgaaaagcttacataaagctcctgcacagtcagagagcctgttttgttctttgcacattggtaagaaatgaacatacattgctgtgcaataacaataaagtaaaatatcttcatcttgaagtcatctaatgggtcatgatagtgttggattaatcctgaagtcatctagtggatcatgatggtgctgcatttgactcaggaaagggtaagaagtgctgattctgaggtcttgttcttctccatcaggaccagccctactcagtgctcttcttggacttcctccctgctttccaaatagatgatgaagggtgagttttaactaccatgcaagtgtcagcttccaatgtgtgtttggctatttgatcaaataaaaatcttggacttttcaactcagtatgcatagtgggtctgaagccaggagacttccctcttcttactgatactgttgacagtttcccaagcagccacatcaaggacagaacaatggctgttcatttgggcattgcagttatcatctctattcctggctagggagataactaacatatttctgttgtgtgagtaaatgaatgggtgaagtaggttcttaaaaatgctaaggaacagttttaatggtgataatgtaggctttcattttcttatatggttattctacacagtgaatttcaactttatattcttgacaaaaacataggcacagtgtagctaaaagcaggtagcagctattacacacctatggttttcatcaataatctttctttttgtaaagatgtgttctccctaagcaaagattttaaaaatgtatctcagaaaattaaaaaaaaaaaccactagcaaaattcttaccattcaaattggaattgtgcaatcaggagttgtcaccatgtttcccttgtataatataatcattacttcagttccctaattaggaattgctgaagtataatcaatatacaataactaatgggaaaaattaaaacaatctatatccaaacagagcctaactaatgtacagtcttttaatggttttggacagccatctaaaatcaatatataatcaataatgtattacatgaaaaggtgtttatggcatgctactgacccacacagtaggttaaacagtcattaatgtgtgcatgaggagatgataaactcagagatagaggaaaacaggatgcctgaagaaatatttataaaataatatccagtatctaaaaagacagaacatcaaaatttttcaaatttgaaatttaggttacagcaacatttcaccacattttgtggaagattagaattttaatgacagcagtcagtgaatgaaccatgcacataaatgtgcttacaacccaaactaaagaggtattggggtgaggtgacagcaacaggagcaaactttcactaggaaacagttcacatggcataggcagattgtcaccacattacacatactaaaataatgcaattttattggcaaaatatatctcagtaaacgtagacattttaataagtaaataaagcagcaggtaaagtcttgctgagaaaaagacaaagatgagggatcagaagagtccactaaaagcgtaatggagcagtaacgaagtatgtcacagaaataatgatacaaatggtcagaaaggcccgagggggggggacacatcataattcagctatctttgaagctgactacatgaggaaataaacaggtcttctgtcagtgctcaaagacattgtttcatcaggaattatgaaaaataaagtaattttctgtctccaatacatagagaagttacgtatcagaaataatcagacacaaccctgcttctctccattttatcaaatgaatatgcatttctctatgcaaattcctatataattaatggatcatcacatgatgatgataatttttttaactaaagaggcccaactttgacaggaaagtggagaaaaaaaaaaaaaaaaaaaaaaaaattggccttgtgtcatcagcagcaagggagcactgtgtttgccctatctcaggtggtacaaagtagaagagaggccctgggagaaagagggaaataaagagacagacacactgggaaagaagaaatagtctcctttgaagaacacctgaccactgcatatttgagaagagagagtccgctgccttctaaatgctcgatgccccctggaacatggaaaacaatgaggatcggaatattattcctttttgtaaacttttctgagacaaatggaagacacaaatcaatcaaacaaacatcaggaattgatcctttcaccttgctttcttcctcttagctgaggaagaatgcttagtgagactgcattccctctcaaactcttctccaaagtcagctttatctgagcatctaatatcccctcattggtagaagctacaccacattccaggtgtgcctcagtgaccctggaatacagtctagtgactaacgaggctgcctatggggcagccagaagatgttctcaggctgctaaagctgctgcttcatcctgtgtctacacagaaggatttaaggctgcaaagtgtgctacttacccaacagtattgaatagcgatttgggattcagtaaacacaggcgtgttctgagtttctgacataaaccctagctgcttcttaaatgtgtaccatctacgcatacaaaagagtctgagccagcactctggtatgaggtttaacccctttgagtaacagttaatttcacacatgaggaaactgggggggggcttcaactttttagcaaaatgaaaattcagcaacacatggacttttatttacttatttattgcagtttcctagaaaccaatatgtagcaggaaaagctatatccataaatcctacagataagaaacccatttttgaaaggagttgtatttaaaagggatgtttagggaaatcttgaggactgatgctatctatgattcaaggactagcaagtatttctttctgcacactccatcatttacctctgtctttcattttgaaaaaaagttacagattattggattgtctctcagagtcatattccttcaggcttctgcctttagagcactttgtgctaaacccgtaaaacatacagatgctatatatgaatgctatatgatgagataaagtgggtgcctccactgtttcctgcagcagctgctgagtttctttatctcttagcatccatttccgagatgcactgatctcagaaagtacctttagaaggcagatggccaactctgtatctatgatctcactgttgggaataaacagagccaggaccgcaaaaatgtaaactattatcttatatcagacatagtgcagagacttccatggataacacttgttaatctgcacatttctatgacatggctgctattatcagtcatgtatttcatataagcgggtaaaactccaggctctgtttaatttgctggtgttcatatacaggcagtgcgtggtaagataagattagaaggtaggaaggcaaactcctgagctcaagccttcaccaccagctcacaggtgcagcaacgaggaaatagctcaaaagaaatgtgtgaactcactgatacaaccagttttttgacaaacttgtgacatctctttttcttagttctctgggagggttcgtgtctgtcttaggatctcagggcacttgaattccacattttatgtatcatccttctgaaggatatggctgctgttccttggtatatgtatatcttgctgcacataactacggaagagtcaactttattgtgctgtagtttagctactggagaaaaggagtaaggatacctaggcttcagatttaaagagatccacaaacacacactgtgattgaaatgccaacacaggctactcatatattttcaatataagttgaaggtgccagaaacacagaaatgacagtactgtatttgtagcactggctggtttgattttgtctttctctgtatgtacatgttttcctgtgtttgcgtgagtgtgggcaggtgtgcatgtgtgtatacacattaagaggccagggacagatgatgaccatctttctcagttgctgtcctctttatttctgagtgggatttctcattgaacccaaagatcactgatttatccctggaggtcgtccagttcctaattcttcagtcctagaattacaggctggggctgaaactcaggtcttcatgcccgctcagcagactctttacctactggatcatcttctcagctgctagctatgcttcacaatcatgtagaaatactgttttctttgtcgctcccagttacttccacaaggttcaagtgtacaacatggctctcgtctatataaagtaaaccatcaaaggttctgagactgagagagatgtgttagggtggatgtgagtacaacccacaacataaggagaaagcactgttatgataatattccacctgagaacatgcttctttagggtgcagctttaaggaccagagccatcggcttgatattttgtatactgaacacatatcctagttcctttgaactgtaagagaagtggaacttgtgatctttcataagtgatcatgtcagaattgaacttagggacataagctgaagtgaacttaaaagattttccattacacttcactgtgcctaacatttttgctaaaatggacaggattttggataaacacaagtgtctcatctttattatttgccagaagtggggtactttgaaaactgtgggtatattaggatttaataaatccctcccctgctctgctattatttttcaaatggttggttaatatttcacaaaagttgaaatgcttttgaagtttgacctttttctctacttaactagagatttagattcctcatttctctctaggaacttgggaggtaattcatgcaattaaactgcactttctacatttccacaaccttccccctgtaacaggcagaacatcacctatattcactttgaaaaataatttgagagatttgcccccaggtaaattactctttatctttgtcttcacccctgttgttccattaaagctaaattccttttaaaggcactttgacttttccaattaagcctttgacttaaattacgtcccactgattcatgagcatattctagttttctttcagtacctccgaggttaggaacttggttcctgatcagcatctgtagtttatgtcagaatttacaaactaatactgtagctactatcaaaaataagatgaaatatcgaggttccatcaatccttcaggctctaaccattcctccaccaaactcaactacaaatctgtgagcccacacacagccgcccgatcctttcttgaaattgttttaaatttggggggagatctgaaattttgaattctctaaaatataaatgtctgcatttaaaaagtttaaaattgggattaataagagtcattcaagccgggcagtggtggcacatgcctttaatgccagcactcaggagacagaaacaggcggatcactgtgagttcgagactagcctggtctacaagagctagttccaggacagcctccaaagccacagggaaaccctgtttcgaaaaaccaaaaaaaaaaaaaaaagtttgtggttctggcaagatggctccagtggaaataaaaatacaaacatcatcatttatttaatttcatagtcaaagcaagctgtgaatttttaactatctatacataaggatttgctttaagatcttggcttatgctttttagttaataacatgtgattttgtctcattcagggaaaaaggatatgacggatgtaaaaatgtctgctagtctaacccttcagtgtaacatcagaggcatcaagaactttccatgctagaggaactcttcaaagtcttaaatatcttacatttctatagccattcaacacacattgttatatcaaaggcattttatcaaccaacaaacagaagcataaataagtttaaaccaagatcaaataacaagaaaccaggacactttgtcccaactccagcttgttggtctctagtaattataaccattgtataagatgattcacctcacaaaagctcatggtgccagaacatcttgctagcagacggttgctctccactaatctccttgcttcctgagaactgaagcttcctaaaacttaagtttaacaggttacaaactacaagtatttctgctaggttttaaaagaaaacttccttagactttttctcataaagtcaatcagtaacagacagcttctgagcatgaacaagcaacctaagagctgctgggtgtctggggatgaagccttgtgcaggccccctggtcccagaggaattccagtggcatttctccacagaagtataaatattcatcacttgccctgcattcgtaataagttgcacgcatcatcacaaatactctacacacattgagtcctcatagcccccacaacactggcataattatctcatgacaatactgaggtgcagtgatgtaagttcaattgctcctaggtttcctgtctgtagtgtctataaatgaagaacttcataggcagctacatcttaattcccagaactccaaaatgtctacttttgagtcattttctttgtctttccagagacgtcacaaaacaactgtgtgtttaggattaagctgtttagttaagaaatccatgtatgtcgtaccagagatggttttacatagaatcactcacactctgtcacagaaaagtccttagggcatctgctgtcaaaagtgcattgagttttatgttattctattaagccactgtggagcaaccctctaagcagtcttcctggagtatacaattcagttattcctgtgtaccattctctgggttgtttaacttagtcaactatctatgatcgtaaggattcagcaaaacatgatttaaatagcaattattatccatttccatgatattctagaatgttatacaaaatgaccaccggatttggcttgttgtagaatattattttaaggtgtgttacatttgcttatgtgtggaacatttgttttgatgatacaaagatgtgttgtattcttttgtgctgcatttgtttaactatgtgaagctgtgattctttgcctgtcaaaaacacctaacggtctaataaagagccgaacggccaatagcaaggcaggagaaaggataagcagggctggcaggcagagaaaataaataggaggagatggagaaaaaaatggaggaaggaacaagagaacaagggaggagaatggcaggggccagaccccagccaggcccccagccagtcctctagccagccacagagtaagagtgaaagtaagataaacagaagtgtcagtgagctcccacttgctcaggtcagctgtctctgtgggtttccccatcatgatcttgaccctttgctcatataatcccttttccctctcatcagctggactctaggaggttggcccagtgcttagctgtggatctctgcatctacttccatcagtttctagacgaaggtgctatgatgacagttagtgtggtcatcagtttgatcacaagagaaggtcagttcaggcaccctctcaactattgctaggagtcttagctggggtcctccttgtggattcctgggagtttctctagcaacagaactctccctaactccataatggctccctctatggggatttctatttccttgctctttctatctctcctcaaactcaaccatctcattccctcatgttttcacaccccctcccattttactcagaagatcttatctatttccccttcccaggggcatccctgcatgtctctcttagggtcctggggaatctgtataggactgaactaggccttctgaatatggatgacagttctgtgacttgggctgtctgtggagccactggtggtaggaccaggatttatccctaaagtatgaactgacttttggagcccattccctagggagggataccttgcacagcctccatgcaggagggaggggcttgatcctgtctaaacttgatatgccatactttgttgacttcccatgggaggcctcacccttactaaggagtgagtggggggttgattgaggggaaggttggcatgggcaggaggaggggagggaggggaactgtggttggtatgaaaaatgaaaaaaaaaaaaacaaatgtaaaagaaaaaaagatacacagaagtaagaaaaggaaaaaggctggtggtagactgggatagtttaagttaagaaaagttgcctagaaacaagccaaggtaaggcttgtatgatttatgtagaaactgggtgttgggccccccaaagagaaaagagtaaaaaacaaacaacaattgcttatggaatcttgtatatgttcctcttttcattttatctgtttcttcaatttccaaatgtctatgccaattaataaaaaaataaacaacttcctaatttatagcccataaacaaatattccagctgagaaaggctactggttatcaaatcttgagagaaaattcttatcatgaccaaaaataggcagagaaaaatgataacagtgagggtgacagtcaatatcactataaacaatacaaacacaatatgcacacccaacatataaacatagcccaaggactactggtgagtaataatttcacatatcactggcatagggttatttctagtttaaaaagcaattcctcagaattcgtcatctgtgagactgtcttttgatccaccatccattcaatattttacccaggaaggagtctttgtctactttaaaagctcaggccccacacttgtgaaccctgtatacagttagcacacactgtaatagaagaggccacttcaaatcttctgttcttgcctctagtttcccacacagatttgaaaccataagcacagagaagacaatttgggaaatactatgtcccccccccaaaaaaatgctaaagaaaatttgcctctaatcacattgttacattacattcttcttttctgttatagctacaatactcactgatgcccacagctgttacgagcttgattgcaagttcaggaatttcacattgaataaaaaatggttccagaatgtatcgtccaaatgccagggatatcacagcggtagctccagggctaagaaataatgtattaaggttaacttcaggtaacactaagtaacagtttcactaaaactttttatctttaggtcttactacctgacaggtggaacctaactaacaaggaagtcttagaacttcatatttcattaagttgccatacattccaaatgaaatattgtctatataagtaatggctattttttaaaaaaaaatctctgtgaaaattagtactactaagagttcattgccaaaatgtgtctaaatatttaatgttgactcttaatttgctagtaaaaagaaatctctaagccacatgaatattcttaatttcttaagaatatttatataaagagaaccactaaataagaagacaaaaaatcccagcctgaggagaagaaaacccagacaataagtcatcccactttagttcttcaaaggaaaaaaagagtgtttcatttcatcttcaatatgagtgcatattgttgccacacacaaggaaacccacagaattgcttaacatctcatgagtctctttcagcttctcttcctccttgtggttacctaacacccaggcctcatccctggattaccagaaaccaaccaccatcacctgtctccagcctgggtctcctaccttcagtcaccaccacaaacattgtaactttcttctcttcctaaagaaccctttctcttttctccaaagaggatattcttgccattttctatcatttggtttgtaaaatgaagtctggtcgtgtggtttcggtacccttaaaccatgctttgacactccggtccaagcttctcctaattcttttgcctttctctcaggatcaagatctcaatcacttctgcccagagctttttcaaatagctgcttttgcttctgccatgaatggcacatgtagggcaacatcaaatagttactttttataccttgcatctgggttcagtcttggtccagagaagtgtcttcaaccctttgcctgagtctgtccaagtgttttcctacacagcaccacatttgtcccttccacactgcttatcacagcagtttttttattcttcttaaggtgattcccagattgaaactctctacttccacttgactttgaagtctatgagaacaagactgtgtctatcactaatcagaattttatcccagtgcactggctagcacagtatctgtcatacagtagaaattcaatagttattgaacatattatgaatgagtgaacttaactttgaagcccccatcatgttctgttgggtgactgtgtttgaattcattttgaaggttatttctggcaatacagacttattttgaaagtacacctttaaccttagagactgcatctattactatttagatgtcatgagtagtactaatagaaaagaaacatttatgtacttaggggatcatgtcctttttcatgtcatatgttattttgtgtgtttgaaagactactccaacagtgtgagtccagtatgacaaaaaggaatacaaatgtatttacaagtttctggaatttatttaggtaatttggctacacacatacactcacacacacacacacacacacacacacacacacactaaaatagttcttcctaaattaaggcaacatctgattatcagctgtttaggagcaggaattgtggttcattccaatttagatctctttatcttgcatttgccatttgcaacaatttgtggaaagaataagttaatgaatgggcaccatatctgtccactgcaaatggaatgatcacactcatagaaacactggtaattagataaagttacacaaccaatgaatggatgaagatggagtgaagtcgaaagacatcagtctgggtagctcaacagcctgacaggccagcattcaaagtgttcctatttcaatgctgagtttgttacattcaaaataagaattcatatccaggatatacagggtgctgatctaaatagtatgaaagttataaaaaggtgttaagacttgttttcatatacttgaaatgggaaaaatacaacacaggtagctaaagtattaaataaaagacatggtaataagttcaatgtcaaatgggatgtagaggctacttttgttttcccaaagaattaagacatgaaagaaagctgggcagtggtggcacacacctttaatcccagcactgggaggcagaggcaggtagatctctgtaagtttgaggtgagcctggtctacaaagctacacagagaaagcctgtcttgaaaagccagagagagagagagagagagagagagagagagagagagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatggccttccttcttcatgacaacagtcatctcataactgagatttaccaagttcctcttttaacttccttacacttgagacctgcctaataagaaagaaaaaatgaagaaagaaaggaagaaagaaagaaagaaagaaagaaagaaagaaaggaaggaaggaaggaaggaaggaagaagaaagaaagaaagaaaaatacaagccaaggactggaaagatgactcagcagttaagagcactggctgctctccagaagacccaaactcgattctcagcttccatgtggtgactcacaaccatctgtatctctggttccaggtgatccagtgccctcctctggcctcctcgagcaccaggcatgtgcattgtgcatagacatgcgcacacaggaaaagtacccatatacataagaaccaaataaaatgaaatgaaaataaatgtaaggaaagaaattttgtttggaatggtatctacaaacatacttgagaatctgtggtcagaaaccagagggcagaggaaaaagacaaggcagcagatatcaaaggtcctgacctggcctttgaataacaataccatttcatgctaagacaagttatacgctcaaacttacctcacttcggcattttagtacattttaataaatattgtttctgtggcatatcaaaatatgggttatctgtcttggggaagaatggattacacatcttgtgagacgttagttaactggtagaatatgttttgtcagcaaaatgaatcgcgattcagttgttctgtggctagaaattgttattatggatgttttcaaaatgtacattaaggaagttgaaagaagagctgttttacaatgagattccatgtgtaccgtcatgtatgtaatgtaaaatcagttataaactaagttgtgtttagaagtaatattaagatgggattggggaagctatttaaactccccaaatggtacttttcaccccatttgaagtgaaagaaatgaactttcatctcgtaaaagacttgcatatataaaggtgataaagagtaggactgattctgacactgtaaacaccacatgacatgaatatactcacctactagttcatagttaatcatgatggacataaaaaaatacatttttatcaaaaaaagcctctgacattgctcagtgctcaaaggtaacaaagtttctgtccaaacaccacctgaggaggctccaagtgtggaatgtaattactgatcagtaatgtctcctgaagtctgagtacacttctctgattcccaaatccaggattatctcagagtcacttggagaatatttttttaagagtgaacaaaggaggaaagactctgggaacacaccctctactctgtcagagtccagacttcaccccaaagaacaatccaagcagctctgatgctatttaatgttaaacgagcttgcaggtagctagctgcaaaagaagtttggagtatttcattaatgtagaactaaaggtaactagttatagtgaacttcttttgaaaaagtaatcaccatgttggtaggttatccagaaaagcaacaatatgacctagttattaaaaagagtcttaagtaacttgcaatttactgtccgggaatcaatacccagccagacccctgtacactttgccccaggtttaaattgagttctgagagaatggaattttcatttaaaggtctcaagctccataactatgtacccagatgaaaagaagttcaaagctggctataaaagtccatatgttgaccttagaattcaaaaagttacaaatcaaatacaggtgctcctctccttacagactgtgactttgctcctctccaccccccccaaaaaaaaaacattcaaaacactagtcagtgagaatttcactgaccatacatagcctagggactgtcctgcacatttgccttgagttagacaaaagcaccctacaaaaagttcattttacaagtgttaaaatatgtcaagtaatttactgaataacaaattcttatcacccagcactggaaggttaaaacatcatgtgccaaaccaccttaaattggggactctgttggtccacattcttgacttacattccctgagttctagagcttcaagtaacagaagaatcttctccttgtatcttgcttgcttcctatttgtgaagactctgtgtccagaaagttcccagtaatttaggtggaaatattatgagggcacatgtctgaagttaacagctcaagcatccactgtggctcacatcacaccccctcagttgctctctgtaatttcctgagtttccaccaaagatggcagacttacatacaaacatatttcctccatacaagccagtgtgtctttaactagctcaaccaagtaatttattttagagcatctgaataaccattgattgtgtgtgaaaatcaaatcataccgtgggagctgcctgtatttaagtatttgaagtccaagaaactggttgtagtttttctgattagatattgatttattctaaatatatcaagtattgtaagacatttaaaacctgggagtacgctgtcacttaagatcaacaattgagcttctctttgcttatcagtacctgcatatgccagaaccactttaatattaacaatggtaaagattctactggaactttcaataactgcattactccaaacaatgaagagaactggaaaggggtaacacacagctgtcaccaaacatttcataaagcataatctagtcacataaatgatgtcaccaagttttccagattcaagtaatttctccatggatctttctataataagtgtgctttcaaaattacttgaaatgtctccatcctaaaaacagatatttaagttctctgggtaggtaactcttcccaaatagtgatttcaaatatcacaagacttaaacagaaagaatgagtggagcaagagttagagcacttggacccagagtagcttggtctcaggtaaatgaagtaactttaaagtgtggtctactttgggatcaaaggataaatccaatttaaaaaaaaatggatcattcaccagtttttgtcatctttacaatggacatgaagagttttatattgatttgccctcctgatcaaggatcaattatttcctcttcagtattaatcctcaaaccaatcagagaaacataaattctgaagagaaaaaataataaccatagtaaataccagttctggtcagaggaacttcagtgagaaatgatctgtttccccagagaccacgtaaatcacagatgatgaaaacagatccaggcatggagagaagactgacacccaagtgaagcctggaaactcatactgagaaacgttctcaaaggtgttacaaaacagaataataaggggagaaagtccaagtcattgcctttgtgccactcacagagcccgagtcacatcaaacacttgtctctccaaggacttatgaaagcatactattaggaacagagaagcctatgaattaaaaatattaaaaaaggcagagagtgccacccatttgttaagctaataaaatgtcagcgatactgctctgaacatccggttctgcatgtaaataggccatgcaggctgcacctcacaggtgtttcatccagcgcgccagctgccacgatgctctaggcatgcctcgcaaaacccaaaccctcagcagagaaggcttgtctggcttttgggggtcatcaaagttagtttttgctcttctcacaccagagaaaagtcagagaagagtccccggcaggaaaggagagtatagcctcaaggaaagactctgagagcattcggtctgatgccaacagtggaccgtgtgtttgggttgtgcacatacctgaacaacagcaacaaaacttcaaaacatttcctgtagtatttgtcattcatctactcctcagaaataaccctttgctttcccagagagccacacagccacacccccagagaagaagtgcactcaccaaaaagtgacagtactccacaggcagaccagaacaccagggacatgcccacgctgcctgtgttctggagtatgcccttgggggagatgaagatgcccgatccgatgacggtgccgatgatgatggagacccccctcagcaaagtgatcttctttttcagaaccactttctcctgcccaggtgcctcttggtcccccatggagggcagcctcccgctcacattgccctgcaggtaacctcctttcgagatggtggtcacaactggctttctgaccatggtagtgtcccaccaagcgaggggagtgaaaaagaaaacagggaaaaaacaaacaaacaactttcaactttggtttctctagacgtgactgatcactgttcagactcggctttctctttgctttcactgactggctctgcactattttgtccacaggtgaaaactctggggtgtgctttagccttagcagctatctaactactcctcttgctcctccggagcacctgtgtgccaccggctccaggcgcagtcagtttgcagcagccgcagctgctgccctatcattacacaccagctcagcttcctcgtgggctcgtatttatgctaccgcctgtcacaccaacttactgggctacaatgatgatgcaaattctccaggtttgcatcagccacatgagaaagctccaccttgggaaagcgccaacattactcagcttttttttttttttttttttttttttttttttttttttttttacagtagtgggcgtgttgctcaactgacccaaagcatttccctgaacaaagcgtacaattaaagaggggcttaaccaatccaaaagaagtaaaacaggaacagatattgtcgtcgtggtgactgtaagcaactcagctctcagagagaaagaaaatggaaaatgaaacaggaaacgattatttcattttaaggagttgcttcttaactttaacatgtgcataaaatgttgtatgcacaactgttttgagaatagaaaagtgccttagggctgcattgttttcaacagcaaagtttagactttataatttgtattctacttacttccccgggtgtttcctagcaacactgtcaaatctaatatttacaaagctagaaagtttctgcacactagagccgaggctactgcacagctccacatgaacgggagtaattgtttcttaagacctgtaatatgctgtgtttaagatcgccatctgcgtttgagaagttcaaagatcccagtgactggagaaaatagtccttttctgattcttgtcagctcggagtggtttcctgaactaagtagaggactccttcatttgcatgttgctccatcaaattaaaaagactctacttggaatcttaggcaatacttataatggcatgaaggtacacatagagcaaaagcttgagaaggaattcacaatgtaatagttggagaaaggaaggggaatgtggtgcatatttttggatctataatctattatgattataatttaaaatgtattaaaatcaacaaattctaagttttagttagctcaaagccataagttttcagtgactgtaacagaagtacagtgtccatttcataaaagtcacaggatttttttttttttgacattaggaaataatgaaattttgaggagatgaagggatttaatctgattttgtgctctacagtgtgcacatgtactgaaacctaacaccctattatatacacagctttcctttttggtctgtcagttaaaaagaaatttaaacatataaaagtatattaagattgcaaaccagggttaaaatttttacattaaaaagatcaaaagtaaacacttaaacctgaaagtttctgcttctaaccaagtgtcttataaaagccaaataaataccaagagaaaaggaatctcaactatatcatctttggctctgggtccctgtggtttgaatttaatgagaagaatcccatgccatcattatcctgaagctacattcagacccatgatcaaatatgctttagaatctcagaataaaaacaaacagaaaatctctgtggaaggaaagttggctgcaggggagtgagagaaagggagaggggtgggggggtaacagaggcaggaaataacctggctagaggggaggggagggaggagcaagagagagaggttgggcgggtgacagaaacaggaaataaacattggaaaggaattctggaaagtgccagaaccctctgttggtccttacctgagaaaatgtttatgacatgatggccttatcacacaaataactgaggccacatgatttcccttttacatgacctacccaagttctgtataatttgctttggatatcccaattggcatttttataaagccgacattaatacctttactcagctgaaatactattatgtatttcaaaacataataaatgggaaatggttctcattaaatcttgtacaaatccctcagaaaggaaaggctctcctcccctctgctccacttctcctgttcttgccctgatctccactcccataactctcctgattaatgaacagaaacagggaggggagtctattgtctcctcaaagggaaacattaattctaaagaaataagagtttaaaataaagcacaaagccccggggcaactgtgttctgtccctgccaaggcaccacactttggtgactaaattataaatgattggactagtaaaactagggtactattcagacaggatgttggaagtattttaaaggaagaaaaagtattcttcaaattttaaataacattctgctccttagcaattttaataggtattcatggagaaaaaattctgaagttatcctaatagccaagaagagggtactctcccacatgggactaagactgaagttttcttcaaaactgcacacagttaataaaaacctcagtatatctctttgaaccactcacaaatttacaaaaaactacaggtttcaaagaaagtggtgaattacctttaattatcagagttaaccttataatccaagaatttggttggttttcaagtatgtgtacatcataaaaataaattcaaagcaaataggtttattgtctttctcctgcttttggtgttattctgagcattttagagactgttcattaacacttacttaatgtttactctgctcaaggatggccctagtccctaaaatcttctcatgtattatggtagctaacaggttacactaaagatgtcagccccatgtgtataaatatagctgtaaaaacctaggcatagccaaacacataattatttttccagttgccgtgtattagaattcaatctgagctaccatatttctaaatagaactagaattaccatttcttatttgttggcagttgtaatgacaaggacatcaactggcagacatgtctctggctgtgttgaaaagacccccatggatatatttacagtcccagtatcacggtactatgtcttcatgaccaagaagaccagattggtgctggacctgaagatctcccattgatcctattagctactggggtgccttactaggagtgctaactggtactccacaagaatatcagtcacacatggatggtgggaatgaatgtgaaagctcctcattaaagattctagaagctggttgccccttgtgatagccattagcccaatgttgttaccagttctggaaatgtgtttaaatctaatgctctataaaatgacttccataagaaagagattatatagttggtgaaagtttggacagtcttcaatataagatagatgagacatatatttgttttgttatgtttggaacaaaaaaccactcttgatacttcaaagactaaaaaaatgagtgtgctgagcagagagaaaagctcaactaattcacatacatctaaccttagtacagaagctaataatttttccctgtaacagacaattaataaatattttaggctttatgctcactctttgtctctatatgtcgcttctcacatatgtatgcatgtatgtgtgcacaggtgttataatgttttaaaaaggtaaagctcatttttagcttctctatagttttcagcatcttactgttattaagatgaaacgatacaaagccattaaaatggcttgtagtaagagtttttgtagacaaagttttatcaaaatacaccatagccactcactaatctatttctaaagcttctttcatgtctcaacagctggcccattgcaaaagagatgagtggaccccaaagtggaaatgggatgtgtctataatgggaaaggaaaatgtgggactctgggacagggtggggaagtgaaagagctaagttataactggccgtgctaaaaggttgatatgtaatacacagaaatgaaaactataaatatagaagaatattatttagagatttggagataaacatcaggaggggtaatatcaacccaggaagaaaaacttttgtccctgaggaacaagaaggagcactcctggggaatgataaaaagcaaggacatctgttcatttcttaatcctattagaataccatgttctaactgattgacaacaaataacacaaaaacagagtgtgctggaaagtaagacaaaataacataaaactaaaaagtggtcatggtggtttctaaggcccttttatttggagaaatgagaggtgaggttatttatctgcattaacaattgaagataaatcactaaatggaaagaaaaagggagagaggagagagggacagaagatgccgcggaaaggaagggaaagaggagggcaggggaggaggaagggtgtaaggcggaaggagcaataaggaatgagaggaaaagaatgacagaaaagggagggagggagggaaggagggagggacagaaagaagagcccaagaaatgagagggggagagaaggcagatgaaagaaaaagaaaaagcagtggaaggaggaaaagggggggagatggggaggaaaagaaaaagagaaggaggagggaagaaagaagaaaaaagtaaaccaaagaaattcatgactcctaagccataaaaaagaaaaaataatactaaaaacctcaataattctaatttataatcaggaatgttaataaaagaggttagaaaaaagcaaagcaagatttaaaattactcaaaccagtagccaaatatataaatcatatactagtatagttaaatgagttacattcacccagtataaggaataaactacatgtttttttttttccattatccacctaggttctagttaaaaaaaaaaaaaaaccatgaagttaaacaaggtaatctcgtcaaaaattgtcagggaggaaaagagtcagaaaaaaatctttacgcattaaggaacaaacatgacagaattacaagtggttcatgattacaactacagcactccttacattgccctcacattcattaaaacaatgagaaaaacagttatggattgcagcaaagttcttgtctgcaccacatctcttctcatccagccccacccttttcttcttattctctaatttatggtctgctttgcccctgccatatgttagatcttctctgaggaccaacttggactgttggagccattattcctatggaagtagaatttcaaaatagctaggaaaacactagccaatgatttcctgacctgaggttgggaaaatctaatactcttgaatggagataaaatttaagacaacctttactatgtgagttcatcttgcagaatctcactgatgtaattagacatttttttgtctccttttaccctctccattctctctcctgcctctcctggttcctccactcctaactggcaatcctggaagattttcctaagcaaatctttttttatttgattcctcatcttattgtcttttcatagagaatactgttcaaggtagttgctattgggattgttgaaaatgcatctgctaaggtaaggggcacaggtttactcacattctggtcacttggcaatcatgcccgactcacaaaggattgttgccagctcttgataggctgtggtgttactatttcaaagactttcacctagaaagaatgagaacagaattgacttacacaggatgtatgcctgtgtgaagtccctttatttgggagtactaaaggcaatgcctttaatatcagcagtaagacaaatccacggtcaatattgtccttaaacatagtatatgtgttcactgactagccatttaaattaaacaatagaactaaagcatgaaaatgtaatgatgtggagaaacatggatgagctttgatgtaaaaataaaattgaatcaatgcacatatacaatagacataaaatcatggtatatcaatttaaaaatgaaatcataaaacatggtggtgtcctcttagaatatatagtgcagatttatctaaccaacaaactctcagaaaaagtaagtttgccatgttttattctaaatccatataacaaaacaagtaagatataaaacaggaatgatacacttagaaacacagtcaaaagtttctagtctctttaagtcacacaaagtgttctcattccattctgctgttatggcaaataccatggcaaaaagtaggtgaggggaaggaaacatcttatttttaaatcttattttgcttacaagatatagtttaacattgagacaagaaagtcaaggcaggagcttgaagcagaaaccatggggaattgctgcttgctggcttgcttatagcttcatgcttagacagttttcttatacagtcctgtatcacccatccagagagtgatgctgcccacagtgagatggacatactctatcagttaagaacccagactgtccctcacaaaggtgtcatattctgacctaaaccagacaattcctcaaatgagttaaccttctcagatgactctaggctgtgtcaagttgacagttataatacagacacaaggcaataagtaaacgacaaacaacacaatagaaaattagcacttatacctatgaaaacatactcaaccttattcataggagagaaacaaaatggcaatgacacacgtcctcagtcacccatgaatgtgcccatagagctgtcttcttgaaactgtgtctattctgtcaaacatgaaaaagaaagtgactgaaatgaattcttacatgttatatgtttttaatgaggaataaagtttacttaggtgatcgaggaaggagagaaggcaagttcttccaaggacgcaagttcatattctttaactggatgagataaaccatgtatggtggctcaccacatacgccaaggactctagcgactgatacagaaggtcttcaccaaattcaagatcggctgaggttatatagtaaagttgttctgggtgacagaatgagaaaacaaacaaaagagggaaaggattggaaaatttatgactttttatattaatgcaatcattgattcaggcaaaagtaagtcataatgaacaacacaaaccactggataaaactttgctggaaaagaatattcatctaattataaatatttgtgcagagattatccatacattttcaaaagggaaaacttaactttacaacagagagatctacttaccctttcttgggtaaccaaagtaattgattgacactgatagttgacataaaaatattaataacccaataacatctatgtacaattcttggcaaaaatgttgagcctgaatcaaggagagcaaataaaagaagaaattcagaacatcaggaaaatttgctcaacagactgtctagtgttttcaaaatattcaatataatgaaaaatgaagaaaaagaataatctagacttaaaaaaagcttgagaaaatatggataagaattataaacccaaataattcatggaaatactatgagttttcttacatgctcataaaggagagcactgttccagatgtacagacatacatataaaatatgtacaacatatacaatttactaacaagtggcttacttaatccaatgtgtaagtagagaagtgacaaatgccatacgctattatagttttaacaaaggtttgtaaatagttctaatcataatccaaaatcaaaagacatattgtcaaaatacaataaagttctaaagagtttatttaaaaaacttaaaagatctcctacttattaatagaagtaaacttgtgaaacataatgtgcactaatagtaaactaatgaaagaagggtaaaaacatgactgtgtatgatctctgcatagatgggataatatgtagctatttcctgtaaattcaaacattgtcttttggggtaagaaggaaactcgtaagactcaggaagctaatttacaagactcagaagttacaaggtttacaaggtctttccccaagtcagggaagcagtaaaacattgctgagaagaggcaatgtttcagtggggctctctcccagtcctgcagagatctccagggatgaagcttccacaatttctcacccttgctggagaggtctttccctggattgagctgcttttgagccatcaagctcctgtatgcagccttttaccatgttataagtagccccaacaaattcatgggctcactaaaagtcagacctgaggttaagcatctctttgatctatctatcatcagctatatcttgggtgaatagatgcttgctcacttgctcacatctcccgagaaaaagtcacatgacatgggaataagaagagcaaacttttaacttcataaaatatttgttctttcggatatttaaccatccttaaatggttaaattaataattatttttgacaacaacaattaagtttaaagagagcaatgaaaaagtgaaaagaatgaggagaaaatgggatggggttaaaacaaaaccaagtataaacacaatgatgagaaatgaggagcaacaattacttttctgaaagctagcaaattaactatgtcttggtcagcatagataaaagtaaaaggagacaagacatagcaaattttaaaagaaaaatgcacatgacaactaacaacaaagtatagatttgaaagtataattgctatgaatgcaacaaaacttcttagaaaacaaatttaaaataacttttaaacatataattattaatatcaaccagaataaatagaaaatttgagtgaaattcttattggttagaattaatgaatagtttcaaatcatatttcacagtaaattacgattgggaaattttacaggggtttctacaaatacttcgaggttatataattcttaatttatgtaaactgctcctccaagtaatacaccatatagactccctttcataaaggcatgtttagttagatatcaaaagctagaaaaactattaaaaacaaggtcaatgagaatcaaattttaaacaaatgcaaatgtgtgctatactgttaataaataaattatttgcaaatgagacaaagtcataaagtctgtgacatataaggatatatgtgtgaatatgtttgaaaagtgactcaagtgaaaacaagtaatggattattcacagattggtaacagagaaaacatataaaaactacctttagatataaacgactagtccacatttatcaataataaatattgcctgaaagaacagtgttgcttgtgaaaatccagcagggtggacctacctgaagtacagagaagggaacaagtacaaagcagagttaagatgcacttcagctatgtcagccacagcattcagcagggatggttggtcgttctcctgtcacagactctaacccatgatgagacgagtaaggtctgtgggatttctttttgtacaccatgctctttccagatctagcctgacaaaaagaatgctgaagcgatcggcatacaagcttcgtctgggcatttgccagccagcaactgcccatctacaagcttatctcatcaaccccagactcttgattacaagttatagtactctagccctagacactaacaaaacatctcatcttctcttctcagccctctcctggccaacatactcctactgaagacataacagagaaaaatggaggggagaaaaaccaactcagacatatttagcatatgtaacacacaaggccatatagtgttacctaaaacaaatcaatcataaaatatttcagggaagaaatatatagatagtgttttctgattacacctctgccagaaaactgaaagatagaaaattaaagtccccattcaaatctctggtcaaaaatacatggtaattaattgatttaataattcttagagataaaggaaaagtaacaacattacatctaaatttgtgagaattcattatggccacattagataacaagaaaaactaagaaataaagagtaagtcttcaatgtaacaataaactcaatgattgcagttagttaagaaagtgaaataaaaaatgaaaacaaaatacagaagctcaatgaactctaactctttgaaaagtaacaaaataaaagtaaacctataacaatattagtattactaaaaatagtatgaataatagaagaaacatcatgctaatgtgattaaattaggggggtcgggtagatgactcagcatacaaaggtgcttgtaccaagcctgatgacctgagatccctgaaaatacacagtggaagtccagatccaactcccaaatagtcctctgtcttctacatgtggagcatggaggatgcaaacttgccctgcaaggttctcccctctctctttctttctgtctctctttctttctgtctctctctttctttctctcttctctcccccctctctctctctctccctctctctctctctctctctctctctctctctctcacacacacacacacacacacacacacaaattaaaaataaatgaaatactattaaagtatttaaaaataccaaggaaataatgttcaactcagccttactggattgaaatcctagaagagacaaatggaccaactgctcaaacttcatcaaacaaaactgacttgtgaaggtattaaatcctaggattaaccagctcttcgttttccttaacatatgtaaaattaacacaagaccaaaaatgcttcatagcagactcctataattgtttttaaagatcagtataatgaaaatttgcatattttaaacccttagttgtaactttaaaaaaagaatgtcttacaggaagtaacctgacaggaatgatcaaaaatctacacatcacaaacaacccaaatcccttctaactggaagacgttaattgattgtgctctatttacaaaacaagagtgtgaaaacatactctacagtgtaccattatgttgagtgaagtctgaccaccattcaatatggaactctcttcatccagcaagcaaaatcaaggcacacacagaaacacatgaataattcctacagggaaagtaaaatcacaggacatagggcacaaaaaagaggacatgaaacctatggacatgggtacccatgacattatttgagaataggaaaattatggctttccatcttgggctaatctttctgttgcaacaaacttagagatagaattctctgtgtcagagatcctagaaaaaaatataacatgactgcattgtgttggttttagatacttttctcattgctctgacaaagttcctcacaaagccaacttagtaggaaagagtttattttggctcagtttaaggcaatgccgtgtaatacagtggggaaggcatggtggtagaatgggaggccaagggtcaggtcacactgcattcatactcatctggtgctcatctcacttcctctattctttctacttcatttttctagcatccaaatccatggagttgtgcttcttacattaaagtggagactttcctcctaggttcaatctctcaataaacaatatgactgacatgcccaaatccaatcaagttgacaaaaaagataaatcatgatgtgtgtcttagggttccataattactgattctttttcagtgtgagacagagaacctagggccttatgcatgctaggcaaatgctctaccactgagccaccaccccaaagtctaataacaagtttaagtcagccagctattttacagaaggaaaagaaaaaaaaggctaaccttttctttccacaagttggcaaaggtttaaaatggataatgtccatgtatttgtaagaatatggaggaaaagaaacttgaatattgactcaagagtataaatttatacaaagactttaggaagccatctagaaatacatagaaaaactaaagttgtataggtactataaattggaaatgtcaccagaaaacaccatttaaaaattctatgtaggacacaaaatcctttcttagcagcaaacaccatcagaggtccaatgtaatgtgtgctttgcccctactactgaagcctatgaactaaatttgcatatgttaatatccccaaagcatcatgttaaatagaaaaagcaagttacactcagcatggccccatctctgttaaagctaaaagcactcaattttgcatgtttttttatggatccatactagaatatcaaggatttccatgaggattcaccagcaaccaaaagatgctaccttttggggtgggtgagataagaaggtgacaggaaaaggttttgatgtgatctatgtattcatttcttaaaagtgaaaagtacaccttcagttcaaggaaatgagcacaatgctgtcagttaaacccacatcctgtgttggctttattgtctgtaaatgtttttgtctatggtatttgattatatcatccataaacctgaattgaatgggattgtgtgacaatctagtgtgacacctgcaactctgctaatgtccctgtaagcatctcccttcccagaaggattctgcacacaccaacaaagcaagcactggaatccatggaattgctcatgtgtccagtcttgcctgaaattacctacactcacctaagcctaaattccaactcataaagaggaaaggaacttggaggaaaatgcctaggctcctggggaatgaaagaatgggctcttttttttgcagtggattattaggattatattaagcaaagccaaatcatccataaacaagcatttcagaacccctttagcacatgagagtgctttcttaacatcttgaagtgggagtgctatcattttaaaaggtgtgtatactccacaaaaatatgtagaagtaatgaaaaactataagagtacaagtgagagccatatgaacaccataactcatctggtgtttctgtctcacagcttcagactcctaagaaatcgtgggtcttggtttccatcaaattgtgagtcatcccactgtaatcacaagcaagtctcaacctggacctacaatccttgttctcgagcagcaggaaatcttacaatctctggaaagggcccgcccttcattactatgagcagcagatagacacagtgactaatggggtcatttgtcagggcctggtgctgcatacttcatcctggcaaaatgcttttccaaggagttaaccggaggaaatggctacaaataagagcattaccagaaggagaaggattgcagattgcagtctctagcataaatagactcatgcctattatccattgaaagacacaaaggtactcatattcattgtgagctacatgtatacaaaaaaaaaaatcacaccatgaaattcaggaccaaattcactaatattgcttagtaaaatgattcactgtggcaggtgtttcaaagaattacaaataaattctgaaatttacaaaaaaaactatgtagttgtttttctaaccttggtttattttaatctgcttatattaataattaatgtatgaattaatttaactaaggaaattttcatacagcttgaacattctttgaatggtatataaagtcctaaatgtccttagagggagcactcaatgtgcaagaacagagtgaagtcagtctatgttcctcctctgagcatctgcccatctatttcctcctttggcaaacatctgataactattccctgtgtagggggaattataacaggaatgaataaacagtggtgcttcacaataagcatgtttcatatacctaactctatataagaacttcacaggtcctaccttcatgagctttgtatttagtaggaaagacgaaagtgataaattgattataattgtaaaagaaaacctacaggatttgtaacagcaggctgaatagcagcaccactgctgttataaagaccaggaacacagtttctacagatcttccttattttacccaatactgcatttctctaaaacccaagctatcttcctgacagccttgctcagtcttctgtcttctctccacatgctaactggcttttctgtaaggaatttggactcatgtttgggtaaatgaaggtcatcccatgcctatgcagagatgcacatgaacacttgcacacaattcttccctacagggcaccaagacacccaaagaataagctggcattgcagagggaaagtcatctctttccagtgtgctcacatccagacaatcacagtctagcttctgaacagaaaatgtaagcaggaggcaagaaatgggtaatgaaggaagagagacagaagctaaggaaaacaagagaatatgaaggaaaggaaaaacagagagcgtacctgcagaactgtgatgcatcttttctcccttctttttcacactttcctccttagctatagactctcacgaatgaacactttaaaactgatatcctcagagtcccttccacttgtggatcacattgagaagcaatggcaggcccctgggtgctgaggacactaaggtcattttaagtaaatctaaggaagctacagatttgatttgggaagagaatggtgctttcatgtcttctgatcacaagtgcctggaaggcaggggtgatttgtttgtgcattggttgaacagcagtatggaaccactgcttcttgcttatgctctgcctttcttaccttttcttcctttacttgcaacagcttcagccattacacacacacacacacacacacacacacacacacacacacacacagtcaaaattgtatccagcacattcttgagatttatttatttatttaaaaagtgggtttcactgggaggtggtggatcacgcctttagtcccaacactcgggaggcagggcagagatgggtggatccctgtgagttcgaggccagcctggtctacagagcgagttccaggacagactccaaagctacatcctgtctcgaaaaaccaaaagaaaaaaaaatgagtaaatgagtttcatacttgatcaaacacacagagaacaactcaaactgaaaatcagatgtgtctgctaaattatgtgttgatataacaaaatacctgggctgggtaacttctacactagaaacaagttatttggctcataattctggtatatgaaggatccaaacacattgtaacagaatcctggaaaggcatccctcacaggacagtagagaactagccagcagccagcagaaggagaatgtgcaagcagggggttgggggtggggcgagggaagagttagagagtgggaggagttagagagtgggaggagttagagagtgggaggagtgagagagtgggaggagtgagagagtgggaggagtgagtgaggggagttagagagtgggaggagttcggattcccctgcaaacctgctggggaatctcctgctcctaacagaccagcattaattctttctgagcacaagcttcccatgatctactcatctcttgctcggttccatctcttaaacctctgccacaggggaacaagctcccagaatacgaccttggcagcacaaaccccagctaagccacagaacctgtcttctcagtctcccagccactcctgacagcaaatacgtcaacatagaatgccgacctttcctgggccctctgtcttctctcattcacattcacttgctctaatgctgtgttttccagtcaaaacagtcagtttccctctgcctcatgcctagcccaacttgttcctccactgagagccatcttcctgccaaccaaattacccatcatggtgttcgtctcaagaaacacatttgttgcacctaagaggcattctttccctgttctcaaattaacaggcagttttccccctctttattacaatttaggaaacataattgcaaaatgaaaatgcaaaagtaaacagaacaaagtctacaaggaatatattgaaaggtaaagtatgctataatacagagtttaaaagtcccaaccggtaacgtgttcaaagctctattgaacccattgtaaagctttttgtaatggtttctctgcatccaccagttcttaaaatagcaataaaaatctagcaaatcaaaaaggttttgtaaagcaatatagggacaggggaaaagactgttaagacgtaggctaacaggcaaacagtaataggcatgctagaactcgggcatagtggtcacgactcctaaaagcctagttgatggtgtttgtctatgagtctgtgctggcgagaaggggaggaccaccctgaaaaggtatccacagtgaacctgattggtaaagctgggactctttaggtcagggacagtggcatttgtgaagtagaagctgcaggattggagttcaagattgttcttagactagtgagtttgaagccagcctgggctacattctctcagaaacagacaaaacacaaatgacaacaaaaaacacagggtaggggagatagctcagtgagtatttactgtaaaagcaagagaaagctgaattaagttctagagtccatattaaaagaaaaaaaagaaagaagaagaaaggaaagaagggatagagagaaaggaaggaaggaaggaaggaaggaaggaaggaaggaaggaaggaaaggaaacagctgttctggagttccaaatacaatggaagtaggtggtattttagctgaacatatgccataggatgaatgaatcattataaaatttataactggaaaatctgatcactgatgattcagtgttggggggaggattttggagggcaaatctctcaggaatgcatgtctaattagttttcttatcaccaggataaaatatctgtaagaagcaactcaagtgaggaaagaggacatattttggtctgtgatttgagaagaatttggccaggagacaaagtggccatactgatagctgtgtctgtaagaatttgctcacatgtgggtagatcaggaagcaggaagctagctggaaggcaggaccaaggaagggccagggtataccctcagggattgattgttccttgatgatccatttcctccaatgaagccccatccctaaaggttggacaaactctcaaaacccttgaaccatcgagggaccgaatgttcaaacacatagcccatggggcatattaaaaccatagctgtgaccttagaagagaggcctcaaagaacacataggggaagggaccatctatgaaccaagaaatagaacctcaccagactagttctctgatgatgctcatttcccatgagaagtcgtgtttatcacgtgttaattactcgggctctggggtttctttacagcatcctaagcatccaattacagtaactcatatttctatgacacacttttacataccaaagaaagacatgggagccagccatttttatggatttgactgaattaaaatatttttttctgtttcaaaacataaactatgggcatctgtgccacgaaaagttgtccaaagaagaaaatttcagtcatatagctccaaaaatgccaaattaggaaagatttattgctgacatgattctgccatgctcctccccacttgtcagctgagtcatgttgctctggtttctactattcggtttcctcataggaatccacaaaggacctcctcataacaaatagccaattcctcaaagagaacacatttaactttacttaggaaaatcaaaagagtgattgtatcagagaaaagcaaggggaatgctgaaggctttctaagccttaatctcaaaggagtattttctgctaaaaatcaattgtggaacatgaaggcaggctttttgtttatttgctttggcttgtttgtctttgcatggagtgttggaagcacacagtgcttgctgagatggagtagcctttcatccgaagtgctttcagaagaatgacacactctggcgaactttctagtgagtttccaaaccttgctgagacacagatactgctcaccccgtttgtaacgcagcaccatcctccaccttcagaaatttcttctccctttctgtatttactagcatcagaggattcacttctcacaagaccctcgttaggtatcacaggggacaggtagtgaattaccagccccatacaatcaaaccttgacttattaccactgtctgaatagcaagaatctgaggctacccttctcacttcgatgcccaccttatgatcatgattttctacctgcctcacagtggcccagtgcatgggaagatgctactgcatgggtttatccacatatctctcctgttttgactgttgcttcatccagagaagcatgaatctcctattcctttctggtctcccttgcttcccacttacaagtgcctctttgatgacaccaggcctacccaggtaaccaaaagtaatcctgtcatttgaagaaccataaccacacctgtaaaaacagagtgcttgcaatttatgatagttccatttgccatattttgactccataattgtgtgaaagtcatatgcattccatagaaactacacttcaaatttccatccgttctcaaggttgtgatgtgacataaaatatactctcctggtgtggcaatggacagtagcagtgagccatagctccaggtgggccagaaaaatcacaaggggaaaaatgacagcctaaagtgcattgctaagcttcgaccttcacagggaaggtgtgcttaatccattttcaatggggatcatttcaatttactatgcatttgtcaagacattaccctatctatacaagctagcatagctactagtttcaggaattaaatgggcatctgtgaatagatatttattctgcttaccactgagagcaagtgaaaaatgaacctctttaaatgaaatggatacaattttaaaaatctaatctgatgtcaaaaggagaaagacacattagaagctaactctaaagtcagatttcttcagtgagactcctagctctggggtcttccacaaattgtttaacttgtataaactcattttccctatgcaaaatagggataatacatggaacagctcttatattagttgtaaggaataaatgagattatacagtaccaaatctgaatagggattattaaacctctcaataaacatgttactgtatgaatgtatgtttaaaaggtaagcgtttggaagtcagctcgggcaggagatcataaagtctccattgccataaattgataaatacccaatatagaaggtcttcaggctgcaatttccatctttcactctattttacatatgtattcatttttcttccaccttcatggaatgatgtggttataagtgctttaccagattcaggtctagacctgtagacagcaaagccatgtaagtggactgcctgaggccttgagaaccaggttcacacctccatgtgaccagaaaaaagaaacagggatttaagtaggattgttgtggaatttaagatttaatattgtttctcctgttgagttttaggctttttggaaaccagttactgctcttttcctgcctatttcttccttttggaagaggaatgtcccacgtctgtcttacattggattttagaagggataacttgctttgttctcaagctcatagctagagagaatttgtcttagcatgaattatgtctttgaatttactcctaagttagacaagaatgcagagtggaactaggtgttattacaaggatattgtggagttttaggataaaattaatgcatgaggcattctgcattccagaagggaatgcattttatttggggaggaagagagggggcatgcatagaatcagactatgaagttagagcatgcaccctgccccaagtaggtgttgggaatttaatcaacaccataatgtttggaggtggaaactgatgagaaaggtttacattaacccacactcatgagtgggttttgacaatcttgaaggacttgaagctataattttgtatcttcatgatatatatgatgtcttcaccatatatgccctctactgtgggttgactaccaggaaggcctctacctcataatctttgtcctttctagcctttagaactgtaataggcatgcttttgctctttacacaggactcagtcgtgtgtgttctgtcacaggagagcaaagtggatcagagacacttagcgttcactgtaaacattttaaatcatctcccatttcatatttacagatcactagacctcacagcacagaagccagagtgagttttgctttgtaacattcagttctgttagctttctcctctgcttggaagtgccctggaaggtcctgcagttctcttctaacagtgtttgctcctcgaatgcctcagcgtatgacccatactgacttctgcactgttcttgggaaatgtttcctcttgacctgcttcaccacacccacttctttactcttatctagaacacattagctgcagaaatctactggctgcctatctctgccttgtttccagtgctagggagtgaaccaatgatcccataggtcctctcaagttgtgagcaataaagccagttcctgcccactctgaataaattagcactttactccatagataatccccaatgactctgtttacattttctccaaagcactttcttacctcctgctatactatgaaacacctacttactgcatcttttacctgacttccccacccagacatacattctaagaaatcagaccattttgtcccttttattcattgccatatcccttttgcctagaacagtgtcacagagacactagctcccttgtttaaattgatgctttcacttgatttctactaaaagagatcctacccatagcccatcactcactgcaaatctctcctccaatccttcaagaagcatattctccattgtcagaagcaagtagtttatgaaaccatcctcctaatatttttttaacacattcctggatcacatacttaagctcataattttcacaggggaaggccaaatatggctgggaaatataccataaaagtaacagccaggaaatttgataaaattctccctgtcatagtaagtcctcttccactactgctgttttactttgataaccagatatcatctcattcaaggtttatgagactccaatgggatgcacactacaatcccatgttacagatgaaagaacagtcttaggaaatttaggaacaccatagatgcctgtaatcatcatgaagaataacgtgaacattgagttgctcaacccccggagtctacatggttttgccccttctttctctctaggaagaattggcatccatgtaaaaattcgtgaaaaccaaaaaccacactcaattttctgttgatccctagagaaacattagtagctaaagtatatatgaaaatatttctactgtgtttatactccaatcaggaaaaatgctttctttaaatgcttcctatgtgtaaactccaaatataactctacagcaaaacctcctctgtgtccctgtagcaagcagccatcacttcttctgaggaaacaatggcttagcaatcatccacatagccatttaagatcttagtcagaccccagaagacacatattcgtaaagttgactaaataatggaaacaagcattccccaaataatataacataaaataaggaaaggaaagggatgagacaacaaaaacatttgagttaatctaggttctctctgttaagaaagaaattaaaataaaaacagagaaaacattcggaacttggcttttaaaaagttaagccttctgaatgaatagtgccagatgtcacattatgctctccatgctggagttgagctgccatcactaggtcgtagaggggcccatgtacttgatacagtgtacatactgcagcttcctaagcaacgaatgttcatgcagaaggagcatcactcagagcccagtgaaggattacagtttagaagaacagagcccatgtctctgtcctgcattttcttgagatcagtattgagcttcacaatgtgtttccaaaatctattcccaccttttttcccctatcagaaaaatgtcagcaactaaaagtaccagtttgactcctttatttttcaatacattttattaacatataacatacctttacacttatatatggagaattggaaactaataaaagaaaaatgtcatcttgttgagctgactctgcaggatgcatcacttttggtatcatccttcttttccaaaagcataaatcggtctctttcacattgccccgaaaacacttgatctcgtcgaagacaagcaactaaagtggatccctgcaggttgtctagtgttaagcccgtggagaacagtgatcatgtgcccacccagctgatcagtgtgttatgcactgcatgctgctctgttgactaacaactcttttatttgactacactgcaatatgaaaccaaaatacttgaaaacaacatttaatgattttaaggtattagatgaatcataacccataaaatataattctgcttcttattgcccagggtagatattcacaagacactgatcttgtctttcctctatttctaactgactcagttcccattttaggcccctcttactaagcctgaatagttgcatgcctagactaggatacctgaggtggatttctgccctccctcctcctcctttcttactttcttcctttctcctaatttccttcctttctcttcctctcttctctctttgactctgtctgactctcccctccttccctctcctttcttctcttccttccttctcttccctatcttctctttctttcctctctccctccttcccttccttccttccttccttccttccttccttccttccttccttcctgcagtctcactatatagcctagctaggacccaagctcataatattttttccttagcctgaccctgatgggggaagtacttctgtgtatgtttatcttattgattgttaaataaaatactgtttggccaatgagacagcaagttagacgggattaggagtcaaagaggattctgggaaatgtagtagagaagtggtgatccaggcaggaagtgacatagcaaggagactcatttaaagaaggagaatcaggaagtgtccctccttttcccttggcctcctccagcggcggaatgtgatccaccgacaaggagggacaccaataaggtgtccgataagataagtcttataaaatatataggtttatgataggtaagactgagctaacagatgagaatcctagtcattggccaagcagcattgtacctaatacaagtttctgtgtattcatttgggacctaactcaggaggacggctggcgtaaagctcacacatggtggtggggctcaggcagcttttggtagaaagatttattgtaacatgacccaagtgcttggattgtagacatgcaccattatgcctagctgacattcacagtaaatataccagcaaaactccattaaaagttgggggggattctggttacattttggcagagtaaaacatttaaaattttaaataaaatttaaaataaaaagtatggacagaattagaaattcttacaaagtctactgagttgaacaataatctgaaattttagtgcattcaatgtatattcttatatggcatttattttaaacaaaaccaagtggccaatgaaaatgtgttcattagaaacccattctcaacacctactgtgttaataagctttgaataactgtcacaaataccaggaagaaattgtctaacaaagaggaaaggcttatttggactcaaagatcgatcagagatgccaattcatgatcgagtacgcctcagtctggggcctctggtgttcagagtacatcaggggacaagtcccattaatagcacagtgaggatgaagaaaagagaagaggtagggtcctacagtccccttttattgcacagcctgagtgacctcattctacattccatgtctcagtgtgctttaggagacattccagatccaaattgtatcatatactacctaagcatggtaagagacaaacagctccatttaagaagcaaatcagtaatagctggttttcaaagctaagtcttcataataactatagcatgatttaattttctgatcttcagatactaaaatgagctctgcattcacggacaattctaatggtcactgttcacttgttctcaacattgatgacctcaccacaaaccaacatgcagctgggtcctgttttaacttatggtcatcttaatttgaaatcatatcattgagatgattccaattgtttgctatgttaactagcattgtcagttcccttggtcctcacaagaacattagaagttaactcagtaacatccaatgaattttatatattttattcatttaaagtgcttgattcctgtcaataagaatgccaaatgagtatcaagtaccctgttcacacagacagcactttgagttacagatggcccatattcattctttgcttagctgatatgacattggaaatagtaaacgtaagagaaagggtgttccttaatacttagttcttttcccatgaatttctcttccctgacctcatttttgtggttctcttctccaaattgaaacattcactctttgaacaggaatgctcctaagactcgggaagctaactaagaccctagaagttgccgagttacaagatttggaaggcttcaccaagatcataaaagcagtaaagctgtgtgcaagttgtgtgttattcagggagcaccaggaatatacttcgtgtaaattgtcatctgtgctaaggtaggcttttccaaaatgcaactgtgctggttcactgacacttctgtaaataacttcaataaactggatggcttgccaagtcagacttgggtagaaccattttatcagtctgccataggtgacttatctgggatgaatagccatttgttcacatctctgcagaaaaagtcacaaaacactttactcacaaacctctacttcatgccctcttgggtgtgttccctagcttgagagtgaccattgaaatctcagtacaagatctgtcctactattgaaacaatttcaactggaatatattgactctgatatgaaactgtctgcttcaagatctacctatttttgagtctttcttcagtttgttccatctcttttaagtctctgacatacctataaaatccctgacatcttaatattctacttgtttgtcttttatattgacatttatgctctttatttgattcctgggaaacagcaagctaaggggaagtctggggttctgccctgtacagtgtcccaatttattataacttgtaaactttagagatgtttgcatcaaggagattgccagcatgcatgaaagaatgatgatcttatcactcaaaagtatgttaaaaaattgattacctgagtcaaattcttaagtaggctaaggactatataatggtgaaatatatctccaagattcagagttcttatgtaatagggctgaagttcaagaataaaaacacatacttctacctgcttaataaaattcatgttttgttcaggagaatgtacaattacacaaggggcccatgatatccaaataatcagtcaccttggtatttagaaagcattgtactataattccaaactttatttgaatcataaggagttttaatcatgctatatcagaaagactatgaaattttacatgggctaacattacaaagctatataaatttaatatataaatcagaatttcccaatgctagatttttattggaaaaatgatagcatagtcttatgttctagaaagatcgttacaggaaagtacaaatacaacaatccaaaaatacttaagtctagctctccctatccattgaataccacttgttaaagggactttatataaattatttattgtgtctaggtcgcaattttatcatctgaaaatgaatgatttgcttcaatctaaggttaatttgaaattttattaatttttctaatattccaggtaattaaagacaaggaaatacactacatatgaaagattagttgagtcaccacatcctatatttaatacgaatgacattcagactttataactgaaagttaatgccactatatacactattgttaaaatcaatttataagctaggctactctgagcagttttataacttatcacaattaagaaggtttctgtaataaacattcccttcatctgtaagtaaaaccattctctattatgcaaagtttaaaaggaaaatataacatgcagaaattttgaggttggtgacttttaaaaattagtaatgtaaagcaattataaaaagtaaatacatattctgagtggcatgatagtgtcatgttagggttgtttgttccattattaggatataattgttactgccaaactctcccttctgggcccctgttctgttcttaacttagaaatgctggatgaactcagagaaaaacccaaaagcaataccaatgcatcattttggcaaattacagcagttccccaagcatgggtgctggtacacatttcatgagcagtatgcttctttgtgattatctctgcccatatcacctctgctattcaatggtttggggaaaatgtatctggactagagaaacatcaacaccgaggaccaagatgccagggacgaatgatgacttattgtaaataacttatttcaggtaataccagagatttattcagctagatggttggtctctgatgcctgacagctgtgtgagggttcagaaatggtagctgcttcttcagaaattgtcacaaataagagattttgatcatttttttccccttcaaatggccctttgtcctgggaaggaaaatatcagggagagtggaaatcaaattgtttttgctcctccctgctagccacttataaacagatgtagagtttgtcctgctaaggaatttcctagtaactacaaataactacgttttcaaaggaaaatgaatgtggtcaatgtccctataaatgtgtcagctactttctgggtttgtcctggtttgtctcagcgctcggcatctttgcttaacacaaggttgataatgcttgtgagcatgtattaaaggaaacattgtttgaaagagaaagtcaaaagaaaggtccaagacataaagattgtgaggaaaccctccatgtggccccattcttccctacttgggtcgctggactttgttgtttataagcagattcttactactagattggaaatgacacaattctccagctgagctctctacatgtacaatgcaaaggaatttttgtttccatggatgaagtgcaagtgctacaataatacaatagctctcattaaaggtttctagatactgtctctggtattactatttattcttggaataacctttttggggaagtgaaattttgaaattgtgtagcaactgggtcctttatttttaaaatatatttacaagcaatactacccaattttgaatccccagccttaaggacacatgtacagttttttatccagtgacccgaggacaggtcacacttcatcagactggacgtattatgtgctgaccagatccaggcctgctgaatcaattagaagaggcataaactgaaatctaggctgtgactgactggaatgaaaactcagacattggacctgttatttagtttagtgcacacccttgatcttcagctgtcagagcaacttggggcattgtgcattttttatgatttaacaaatattagcaggtctgaagacaaaattcttttaagcaaagggaatatttcttcaaaattcaaatgacctcatgaactaaatgcctagactctaatcttattattatccctgggatatttcaccataaaaatagcaaaatggaaatctagtatttcatggtcatatgttaaatataacatacacggctttaatgtgcatgacaagtctacaatcatctaaagcacatgtatgtataacaattccaagccacacaactagacattactgtacagtttagaattttaccttttttttccggagtatgtattgagcacaaatttaacaactcatggagtcacaaaccacaaccttgtacatacaataacaagagctagagatctgtttcccttctgtttctgggattaattccttggaatttggaacatcaaagcaaataaagtttagagagaaaagagaacacataagtgctaccatctgtgacccatgtcactatcacagcacttgggtagctacagtgaggaaagaaagcatgaattcacagtgcactcaagcaggtcttcctgttacattgatcccctgtgtgtagttaaggctacaaggaatgcatccccatttgcctctgtgttttttcctcagtaataataataacaaactcctcaaacattatttgccaagatatacattcatccaaagaaaatgattttagaaaatggtgttctattcaatgagtataattagaagcacaaagcacccaagccttttacaaatccctctccaatattgttgaaatgtcaaaataggaactgctgacattcatggattattgggtcactgtgtctaagtggaaaagatagaattggaaaaggcaatgtaattatgtttgtccacagcattttatattctcaggagtgttttaacgtatttcactgtatttagctatggcaacaactccatatcataatttatttatcatcacacacacaaagacttctctgcatagcagtttcttcccctgtactcaacctgccttgcttttctgcttttccacatacagcaatgggaaagcactcaagtatgacctgtcaggccactcacaaggaatccacttctgtgcatccgaattccagaccaagggtgaaatgtcagcaatttaaattgatccctactgtgattatctgaacatcccatgtccagtcacagaggtagaatacccattacaggctgagacccatactgtgtctgttaaaatatacccctgaataattcttcacatgcaaactcacatacataacacatatacatttgtgtgtacatgtgatcattattaatattgcaaactcaaaagcaccaaataagcagcatcagggtcactatgacacaaaatattttttttatcccctgctggaaaagaggtcttttgaactgggtgttttaccatttgttaaaaaaacttaaacaagaattttaatgtgagccaggtgttggtggctcgcgcccttaatcccagcactctggaggcagaggcaggtggatctctgtgagtttgagaccagcctggtctacaagagttagttccaggacagcctccaaagccacagagaaaccctgtctcaaaaaaaaaaaaacaaaacaaaaagaacaaacaaacaaacaaacaaagaattttaatctgaagtttgtctaagtgctggcttcacctaaaactacaagcattagtagctagcccattcaaaggccttgacaaatttccagaagttcaaaagtaatttcaatatttaattcttcatctaaatgaataagcatgaaatgaatatcaaacacccacagctttatgaataatttcacccgaaaggttttcacttgggcagagactgccccaggcatcctggttccaggcatttaaaactttctcttgagtcatcatgcatgtggctttcctggagtgcaagtatgtgtcacatataggtacattcacacctaaaaacctagatgtacatgttgatttacatagggcttgaggtatcctctggaggaaaaattaataaaacttagggatgtatttctaagtacttcctgagccctctaggtctgggaaagagccagatgtccctgcagtttcagaagcaaagacagctgggctaacagaaagactttcgtgtcaaaaaaacactccccaccaagtccacaggcagccctgggtgtccttcagaatataagaggtgggagggaggagttaagagcaactgaggaaggattgcattgtcacaagattctgaaagtttagcaatttaatgatgtcatctctcctaacactaaagactgctcattccttccaaccaaacaagtgctctgctgttgaagaagtgagttgatcaacctagagagccagttaagatgaagttcaaggaagacatgcttatactgagtttcataatgtttctatagttttcaatcattcctctgtgcaattgcattgttgtgagctgtggcagaactttaagaacattctactcaatgagtaagccccttgtcatgacactaaaggtagatctcctggtccactcacaatgcgaacaagttttatagcacctggatccagaaacacagagggtaaaaaataacggaaaacatgaagtttgcagaggcaaaagctagattgtggaaaagtttaccaatcaccagacaaatgtataaattggggttctctagaggaacagaacagacagaatcattatatgtatggggtttattagggtgacttacaggtcgtggacctgctagttcaacaatgactgccactcaaagaaagttcaagaatccgtagttgttcagtccatgaggctgggtgtctcagctgatcttcagtacatgatggaaacctgaagaagtgggcttagtgacagtgagaatgagggcaagcagacaaaaagcaaaggcttctttcttcctggtcctttatgaggctgccacaaaaagatgtgacccacatttagggtaggtcttctgccctcatctgatctagatttaaggtaagtcttccaacctcaaaagatccagataaaggtggatctcctgacctcttgtgatattagtttaaggtgtgtcttcttacctccaatgatcaaattaactaagaatctcccacaggtatgatatctcttgagtttttagttagttccagatgtagtcaatttgactaccaagaatagccactacttagctcctgcccggtggcctcttcccatagctgtcgctggctccaaaagccagttctttctctggtgcttcaggcttgggtggcaatggcagtgttctggaccgtcctatgctcaccttatagtcttctcatgcaggtttaactcttttctaatcaacatttgaaatccctctccatcttgaccttcttgaggtcaaataaataggttgagaattttcacccaaactgtggcacccgtcaaaaccatatggggttggatagaccaggaaatgtctatatacaaaatctacataaaaaaatgaagaaatttctacaaaccaaaaggaaaaggggggatctcaaatgctcaaatgtacttggatttctgcttaatctacaaattttctcaattcacccctctacagtgagctctcctgccagctgaaagctgagggcaagtcccacattcctggaacaaggacttgagctctggaaagcccctgacaatctcatctctctacccattctctctatttgtgctctgctacaaatgcccactatgagaaagactacaatttaggggcttgaacttatgtgagcaaggctgaacaatgaagcaactgggtggggcttgcttatgtccttctgttcagttacacaaaatcgttcatctctttcctttcacatttttccagttccaacttcctgtgattatgcaaataagattaaaagataaaatatatagggcttacattttaccttcaaataaacaaacaaacaaaaaagagtatgtcacatgctagactggaagtatactaaggtgttcattacttgtctgaaattcaaagttagctgggcactttttatttatatgtttttatcatgtctgtttttatcatggagataaattttaggattagagatctactaattcatcatcccacatgtaattcagaagtgaccagtgaggagaggagaaagtccttgatatgaaataaaactgaaattctgaagtagcctgcagcaaactgcaattatctccaagaaagagtgactgtaaatctaagtgtgccacaaatctcattaaagggtgacacagagagaaagaaaagaaagttcatgcttttgagtgcttccagttttaggtgttctcaaaatacagcaaattgtggacaccatgataaccaaatgcaagcacagattgtcattaattcaataacagatacatcaccctccttgtgcatcaataactataaacctatgagcagatgcaatgaaatttggaaaaacagccatgacattctttgaggacagatgcaaaatttttgatatgaattcagatacacacccaagaaccaagatagtttcggaaataaggcctctcaccctctttttcaaggctgccttctggacacagacctatgactaaatgttcaagtggggatcttgtgtctactgccttcatggactgtgctgaagatgctgatgttgctgtagtctctaaggtgcttttgtgaaacatggatgtgtatggagtgatatttaaataccagttctgtcaccattgtgtttttaaactaaatatcattttaaataatgaagaaaaagatggaggagaagacatagtgtataacttggaagctttctctgaagaatttggtaacagcatcaaaacaaaaataaaaacaaaacaaataacaaaaaacaggctcattgcctataacagctataacaggagatgtctaagccttttgtgacaaaaaaaagtatgtaaaaaatcctggatctgccccaagagataaaatttttggttcttgattagaatgagtcactgagaggactaaagattggtatctaaagtaagagaaatactcttttcctctatgcctcagggaatgtcatgagctaaagatgcctataataaaattccatatggaagatcaagagatgtccatattcataacttttttaaaaaacaaaagtcaatgcaaagaaattccccacaggattctcatgttttgatgacttgatctaaaaaatttttagaaatcattcaaaggttgtaaaattaagccaatggacaaaagtcactactgtagtcagagttgatatttctgaaggcaaacacaaggtgcatgaataatagacactgacagttatggattgaatgcttataggatggtttcaatatgtccaccaaaaactatatgctgggcagtatttcccaaagtatccacattgggagttttatatttacaccaaaaactatatgctgggcagtatttcccaaagtatccacattgggatatgggacctgttgagaagtgactagcctataacgattctgtcaccacaacttgattaacgtcctattagtgaaagtggggtcacatgaaatagcatgtatggcaatgcacctctccctttcttctctgtgatagtcttaacttctgccaggaccataacttagtacacttcagtgaattgcaaattatccagccaatagtattttgttacaacatcacagaatggataaaggcaatttgttttttacctcccccaaaatttcttcttcaactgtatcccctaatgtgatggcatcaggaaacagacctttgtaagggagtgaattgtggatgaggtcatgagagtagggcctatgagaataatgtgctcacagagtgtcaccagagtttcctatcttcacagcatgattcagcaagtcacagcagggaagatgccacttaccagccatgacatagttctttatcaagaccttaatctaccagtactttaatcttagactttccagacccccaactatgagaaattaatatctgatgttaaggcatctagcacttctactagaagcccaaggtgtcccctattctggggttaattaagttaatttgggaaaatgaaaagaaagtcaaagtcactgaagaaagacaaaagggttgaaacatttacaatcatggaaatttctgttcaagattttgtaaaacatggctgctctttggaacagtgttcatttgataatgtcaaggtgtcttagttagggtttactattgctatgaagagacgtcatgaccatggcaattcttataaaggaaacatctaactgtggtggttcacttacagttcagaggttcagtccatcatggtgtcatacaggcaggaatagcactggagaaaaagctaactttcctacattttgcagacaacaggaagtcaactgtgacatgaaataaagcttaagaaaaagacctcaaagcccatcctcacagtaacacacagaaggtatggcccaaattaaaagtgtgccctccagcctcaaggtctggttaaaggcaagtgtcatccagcttcctccaacaatgccacacctcctaatagtgccactccctaagagtttgtggaggccaaatacattcaaactaccactcaaaccctaaaagcaagcaaatttagtcatgctacactgtctcctgcctgagtagtgcttgaaatctgattgtactttggtaggtgttgagctcttggaccagtaggattctaccagaaataaggtgtaatgtggaaagtataacttgtaagaacatagagaaaactgttttcataagtaatcaagaaaatgttatccaagaatgaaataagttagtcaccagcagattagaaaaacaatgcaggtttatagaacagcgcataaaggaattcaagtcagaaagaaatcggcaagtttgacctatcaagtagagatgttcagctagaacatgttgagaaagcaagttgtggaaaagaagttaaagtggggaccagtgaaatggcttagcaactaaaggatctgagtaggaaccacatagtgggaaagagaattgacacctgagaattgtcctctgacttccacacgtatgctgtatgctgtggtgggcatggcacatgctacatacactcagaaaagaataaaagtaaaaacctattcttgagaaagaaattgagtctttgttattaagaggaaaacagatcagtgaatgaaagtgattggtttaaagaatgaatgattgcattccacatgtcaggtaatttgagggagaaaggttgctttaggtacagagaacagtggtactgttacaaaggaaaggaaataaaataaatcctcagaacctccccaaaagaaaaaaacaagtaacacattaagtcttgtagaaaacagtgtggttgtggacacaaacataggattgttaggtttaaaagctcatgaggctacacgtgaagaaagagacacacttctactgtcagaagaaacccagtccccacatttgaaatgtaacaggacaaaataaagcatctttgttctcagctttgaaagtccaaaatcatccctgaagaccagggctgtggaatatcctgtgctgcttcaatcttttagtggctctaccttcttgttcctaagaagagtatactagttagggttttatagtggttgtggctcaactagtccaacaatggctatgtaccaataaaaagtccaaaagtataattattgttgaatccaagagactgtatgtctcatctggtcttcagtgtagaatataatcccaaagaagtagactctaatgccagtgaagtattggacttgctagcaaggcatgagcaagtttccttcttctacgtcctttccataggctgccaacagaaggtgtggttcagattaaaggtgtatcttccacctcaaagacctggactagaagctggccttctcacttaaaattatttaataataaaaaaaatccttcaaagttgtacctggacattttgggttttaactaattccatatgtaatcaagtagacaacctagaatagccatcacaagtccacctcttgtcaacttgacacacaatcatatctccttctgtaatgcttaatttccaaatgaaaacaataaccaggtcataattaggcctaacataataaaactatcacatgtacaactgcaaatgcattataaatttagaagaggttacaatgtcccttgaggcacattcttttgatatctcaaccttaaatatggtaaccaccaatattctcttaattgatgtttcactacatgaaccaaacatgactgaccaaaataaataaataaacaaagtcaatgaaatgattcctaatgaattgattttgctgtactcacagatcagtgctgagtccaatcatcatcagagacacttcattcaccaactgatgggagcagatgctgagacccacagccaaacataataggccccaagtcttcattgggctcctcctcttagagctcaggaaaccctgagggagaaggaaaggaggaactgtgggggctcacagagactggagcagcaaccacagcacctgcatgggtctatgctaggtcctctccatatgtgttatggctattggcttggtgttgttagatgactcctgaaggtggaagtcagagtgtcacttttgcctgctcttgggacccttttcctcttattagattgccttgtccagccctcatatgaggatttgtgcctggtattattatatcttgatgtgccctgttcagacaactgtactggcctgtccctggggttctgacagcatatgcccagctgcagccactaagatcaccacctggcctgcccacctcccatttctctctctctctctctctctctctctctctctctctctctctctgcctatctctttgtctctcctttctcccccctcctcaagtccctcttctctcctgctgctcctgtccccagagactggtctcccttatcccctcccccactttctcatttactttcccctaattaaaacacacacacacacacacacacacacacacacacacacacaccactcaagctctgttgaatggcatctttttctcatatgccgattttttacattacaacaatgtcccttggagacctgctctttttgtgggggagggaagaaactgaggatagatgtgggtgtgggcaagaggagaggtattgggactggaaggagtggagggaggagaagtacagtcaggatatatcgtatgagacaagaacaaataaaaatctttttttcaaaaagaaatcaatcaaggaaagagaacacaaatatcggtacaaacgcattttttaacgaaatgccccagaaatactcatgttggttgtataatctttgtttctgtaactgctcacattacctcagctggtatttatagctagctttctctactatccattctgtatttcctccaccttctgcaagtacctcagcaggtcttgactctttcctggtgtagtgacccataccttcattctggaagggtccatgccctttgtcatcctgctgttgtagtttctcaatgactttaatcacaggacatggtaactccaagggatgccttaaaggatctcttgtactccattcataatctttcttacttccattgtgaagaagcaatccaatttcccctttgtaatctggatcaatcactcttctaatactgtcattcctttcttagtgtgttggcttaagggcatcagaagcccaaagtagcctgagggaagtcttagcttccagttcaatagattatttgttgtagctcctggcaggagctcactccactctggaaccaaaacttctaggccaacagaacttaaggtcacaggaacaggaagcaaaaattttcctagtgagtcactaggggtcatatgagtgaaattatttttctcttttccaccgcttgcttcctggattattaaaaatgaacattgaacataattaataaactggctcacaaaggaactaattatatccttataggagaagattatcagtctttatatcacattacacaatccttcactaattggaaactctatttttaaaagtatatttactgctagtgtgtgagagtgcatggtgtatgtatgcacacatgtgccacatgcatgtgtggaggccagaggacggttttgtagaatcagttctctcgcattttacatgcactgtaggaatcaggtctgtagtcctatgtggcaagcacttttacccaccaagccatgtcaccagcctctcatgaaaagtttttgttttcaattttgttgtatttagtatggtatgctttcaaatttcaaaagaaatacctgctgattttgacatagaaaataaatattgtaaaaaaaaaaacaatgcttacattctcatcgccttcttcaagtttaaataactaatatttgtaactgtaaaaattcagttattcaagtatgttaaattttgattgctggagcatcagaggaaggcacacttccaccaggaggagcatttaccagaagctctgctctccttgtgcctgaaggagccatcaatggagccacagcccccaactataccaatcggagaaagagagaacccctgaaccacaagttccacctataacaattagaggaagagatgtatagacaacaaggtaagaacatactcaacaatataaagagcaatatgacaccaatagaaactaggtgctacaacagcaagacctgataaaaagcagaagaaaacagcctaaaaaatgactttatgaggatgactgagttccttaaagaggaaatgaaaaatgcccttaaagaaatagaggaaaaaaacaaacaaaaaattggaaaatgtcaacaaatctcttaaagaaaaccaagaaaaagtaatcaaagaggtgaaggaaattattcaagacatggaatctgaaatagaggcaataaagaaaacacatactgagggaattctagaaatggaaaatctgggtaaatgaccaggaaccacaaatgtaagtacaaacaacagaatacaagagatggaagagagaatttcaggcactcaagatacgatagaggaaatagactcattgttcaaagaaaaatttaaatccaacaattccctaacataaaacattcaggaaattgacaaaaacctaacccaagaataatacagttggaaggaggagaaatccaactcaaaaacagaaaatatattcaacaaaatcatagaagaaaactttcccaacctaaagaagaacatgcctatgaaaatacaagtggttgctgggcattggcggtgcacacctttaatctcatcactcaggaggcagaggcaggcagatctttgtaagttcatagccagcctggtctacagagcaagttccaggacaggctccaaagcaatacagggaaatcctgtcttgaaaacaaaacaaaaaagaaaatacaagaggcttacagaacaccaaatagactggaccaaaaaaaaaaagtcccctcaccaagaaataatcaaaataataaacatacagaataaagaaagaatattaaaagctgtaaaggagaaagacaaaataacatataaagacagacctatcagaattatacctgacttctcagtggaaacaatgagagccagaaggtcctggttagttgttatgcaaacactaagggaccatggttgtcagcgcagactactttactcaggaaagttttcaatagccttagatggagaaaacatgatattcatgaaaaacaaaaacaaaaacaaatttaaacaatacttatccacaaacccaatcctacagaaagtactagaaggaaaatgccaatccaaggaaatcacttatgttcacaagaacacaggaaatagatgaatttacagcagcaaataacaaagacaggaattgaacacaaaatgccactaccaacaataaaaactaagatagcagaaattagcagtcactggtcgttaatatccattaatataaatggtcttgattcacatataaaaaaggacaggctaacagattggatatgaaaacagaatcaatccttctgatgcatacaagaaacacacatcaaattcacagaaatatcaccctttacaaaagccacacacaaaaaaaatatcttgggctaacgctaaccaaacaagtgaaagatctatatgacaagaactttaagtcttgaaaggaagaaattaaagaagataccagaaaattgaaagatctcccatgctcttggatcactaggatcaccatagtctaaacagcaatcttaccaaaagcaatctacagattcaatgcaattcccatcaaaatcccagcacaatttttcacagaccttgaaagaataatactcagcttcatatgggaaaaacaaaaaactcaggataaccacaacaatcatgtacaataaaggaatatctgggagcatcaccatcccttacttcaatctctactatagagctatagtaatgaaaacagcttggtattggcataaaaacagagaggtgtaccaatggaatcaaatcaaagaccccattatcaacccacacacttatgaacacctaattttttgacaaataagctgaaaatataaaatagaaaaaagaaaacatatttaacaaatggtgctggtataactaactggctatcaacatgtaaaagaatgcaaatagatccatatctatccccatgcagagaactcaagtccaaatggatataatacatcctcactaaacctcacagaagagaaagtgtatagtacatttgaatacataggcacagaagaccttcgtaaataaaacaccagtaacaaagacactgaaagcaacaattaataaatgggacctcctgaaactgagaagcttctgtaaagaaaagaatatagtcaacaagacaaaatggctccctatagaatgggaaaagatcttcaccaaccccacatctgacagaggactgatctccaaaatatacaaagaactcaagaaactgaacatcaaactaccaaataacccaatttaaaaatgggggaacagatctaaacagaattctcaacagaacaatctcaaatggtagaaagacacttagtcatcagggaaatacaaatcaaaaccactctgagattccatcttacaccaatcagaatagctaatatcaaaaacaccaatggcagcttatgctggagaggatgtggagaaaagggaacatcccttcattgctggtgagggtacaaacttgtacagccactgtggaaatcagtatggcacttgctcagaaaattagggatcaccctacctcaagaccctgtaataccactgttgggcatatacccaaaggacacacattcacaccacaaggacatttgctcaactgtcttcatagcatattatttgtaatagtcacatcttgaaaacaacttagatgtccctcaactgaagaatggataaagaatatatggcatatttacacaatggagtactactcattggtaagacatcctaaaagtcgcaggaaaatggacagaattagaaaaaaaaacatcctgagtggggtaacccaaaaccagaaagaaaaatatagtgtgtactcactcataagtggataccagacagaaagcaaaagatacctatcctacaatcctcaaacccagagaagctagaatcctcttccagaaacagattgaaacagatgcagaaatccacaactaaccaatggttcaagctcctggagtacaatcaaagtgagggaggagcaaaaatatgaacaaagtagtcaataccatgatggggaaacccacagctgacacaagctagtgagagatcactgactcaggtctaacaaatggggaaccagcataagaccaaaccagactcccttaatataggtgacaatggtgtgactgggaaaacatatgaggccactggcagtgggtccaatgcacaaactaatgcacaaactgacttaatggagcccattctatatggagagataccttgcccagcctagacagaggagtgtgggggtggagaggttccttcgacctgcctcaaggagatgagggggaacacctagtagacttcctaggagaggcctaaccttctcttaaggagcagatgggaggtagggggagcagtaggagaggagggagtgggaactggaattggaatgtaaaaagtaattattaaaaaattttgattgctagcatagactcactattgtacaataatctttgtgatgatatctgtgactttaagttacattttaatgagacttggagaaaacatatgaaataatatggttgaaataatttagtgtttttaatgaagaaacatcacagtgtcaaacataagcaaatgtgtgaaattatctttttatttttaagtgtgaatgttgaaattcaggggtcatctacatggttaagcaactccagaagttggaaaacctaaacctttataactgaaactgtaaataaccattatgaattactcagagatatgctgagaaatgcctaaaagacatctctttaatctagtctaggaaaagagtaactctcatcacaataaaacaaaatgaatgctgaaaacgtcatttatatatctttgaattcttaaaaaaatttggtgtggttttatgactaataaatagcaataaattaacccaaatataagtatacatcactataagtgtttgttatttagtttggaatttgtataatagggttgtgaatgagcaagtgttcgggattgctaagttgactaagttgacctttggtgatatgatttatctgaaatggttacactaaaacactaagcttctttgtttttctactacacaaattactctacaggtaggagccatagcttatcttagtctcagaacctgatacctcagcatgctcaacaccactttcagagtgaacctggactgttcaaagaagttctgggcttggggatggctcagtgggtaaatcctcctatcatattaattgaccctgatcccatctgcataagtcatgaagcagaaaaataacacattatcttataaataaaatgcactgctgatatacactaccattaagttgatgctccaaaaatatcgaatgttgtccatccattctttagttgagggacatctaggttgcttccagtttctggctattacaaacaatgctgctatgaacatggttgaacagatgttcttgtatgaatgggcatcttttgggcatatgccaaagagtggaattgcaggatcatgtggtagattaattaccattttcctgaggaaccaccatagggttgctcatggaccccagactgatagctgggaaaccacataggactgttccagaccccctgaaggaggaagtcagtttggaggtctggacaatctatggggccactggtagtggatcagtatttacccctagtacacaaatgaactttgggagccctctccacatagagggatactctctcagcctagacacactggggagggtctaagccctgctccaaatgatatcatagactttgaagattcccccatggaaggcctcaccctccctggggaagcagaaaggggtcaggatagggggtcggtggggggcaggggaggagaagagggagagggaactgagattgatgtgtaaaagaagcttgtttctaatttaaataaaaaagaaaaaatcgaatgttgtcttcgtatacagtgtgtgacaacacctgaaaattctgtcacctccaccctaccacatataatccatcactctgctatataaacagctatgcttctctctctcataaaacaacataagtgtgccaggaatgatatcaataattcttaacagaacattcctaaaccatggacatgatttactttgcagggggcggggcctgggaaaaagcatgtgctaggagtttcctggcttatttctgcccctaaaccatttctttcctaccggatccacccttgtgtgactcactgttaaagagcttcactagtctctccaagtatcgatgtcctggcttaccacctgaaactgaactcacataagacttcctgtttaaggatgcatctggagtgcatgcaccaatcctagccagatcctcatgtctgggaagactctagttctgcctgttctgcttcttacaatgctgttaaagcttcattaagtgttggctgaacaactgatgcctaagaagtacatggagtccaaaaacaccattaacaagtgagactaggccttcccattctccacatggctaacatcttttggtaaggtgttttttttttttttccttctaatccaccaatccacctgcctactgatgtgcatacataagattctgtttactgtacttcccccccttattttaaaggcaatatgaagtacaaggtaagttattgctttgtgttgatttttgctacaggcatgtcattgttcttttactctctgaataaataagtcaccacttattttttgttaccagattttaataaaaacaaatgtacaaaacacttgagttctcttacatgctgactgatgggatgctttctgggtttttactctttaagaaatgacttcttgtaagttaggaaagttgtttttcagaccatttaactatacaccaaaattgagcttttaatttccaaaagtatcctcatagtaataggaagcttgtgttaaacaaatgtaagcaaaatttatctaatatctaataaaacttaattaaacattgttattgaatgacttttgtatgaaacaaaataccaggcatcgtggggcaaagaaaaatacatgggataatctgtctagtttcagaagttcagagattacaaagggttcaagacagctactagaaaggataagattagttatgatagtttcacacaatacgcaaagacctcctctgttaagaaaaagctataaacatgcaaattattaagaaaagaaaagcaactgaatgtgaaaacattgagtcaaaataatgcaattagtcaaaaagtacctcaaatgcatattttcctttcaaatgtcaaaaaattattttaattatcacacctaaggttatatgacgattatgctatagtaatatagtaagttttttaaaacatttttataggtattttttatgagtgttttgcccgaatacatatctatgtaccacagacatgcctggtgttcatggaggccagaagaaggcattggataccttagggctatagttacaaatggttgtgagtcactatgcaggggctgggaatctaacccaggtcctccaaaagatcacccagtgttcttaaccactgagccatctctctagtcctccttaacttaacaagttaagctttgctgttaaattaggactggaaatataaatataaaatcctgcaaataaaatagagagtaattactaattcaaatgcattagcactgggtgagtggtcaattaaataactaattatcttgaaaaattaactgactgcttaagtggattgccacaccccacctatcttttctcaggccccacaagtgtcccagagctcccatacttctcaactgactcagtggtcttatttaatagcttaaacactctctctctctctctctctctctctctctctctcacacacacacacacacacacaatcttaactattcagttgattatctttttattctataagcacagaacaaatgttaattttgggccagggactatgttagcatttataaaaataaaaaacaaagataattactcatcagccaattaatcttcctttcctctctgcttgcccccaaatctaacatattgcttggctatggaagtgcttggatgaacctattccttctacttaaacatagtcctaggatggcacattaaaggaaaaaatggaattctcttgagatttgtcaactgtgggttgcacctgataatttggaatgttagccctaaagtttgagaaatacactagaaggtgaattttagctactgtgatggtaaacctttataatatattgagaataaatgtgttgtgagtcatttctatatcatttccacttctagaaatgcctgacctaaaagaggaattccagaacagctttcagtatttagatatagtctatacacagcaatgaaaattaattttctcttaaaacttcccttattcaacagaacagctttatagtaattggtcttttagtaaatagaaaagtgtctgcatcaagaagtggggatgaggaggcaggagtgacagtaggtgacctaaaatagaatttagagtgaaagacacaggcagtgacccactacttgtgatcatcactgtcaggaataatcagaaatgtcaaggtgtatagggtagtcttgaaatgtttatttatttatctccttaaaatttaaattagaaacaagcttgttttacatgtcaatcccagttccctctccctcccctcctcccctgcccctcaccaaccctttatcccatccttttcctgctccccagggagggtgaggcctttcataggggatcttcagagtctgtcataccatttggagcagggcccagaccctacccagtgtgtctaggctgagagagtatctctctatgtggagtgggctcccaaagtccagtcctgtactagggatagatactgattaattcgcatttccctgatggctaaggatgttgaacactctcatcaaaacaccaaataatccaattagggtacagaatagagaattctcaacagaggaatctaaaatggccaaaggacacacaagaactgttttgacatgagaagagcttcagagacctgacaactttcagcttgttattgtgaccctgatcctttatgcacatcattcttatgtagctcacagtgacctctttcagtggaatgtgaccgcatacatgttcatctttatattctttctgaactgagctcagcatgttctagagtaggagaatcaggaggggatgattttgactcgtcatgagaaacaatagaatataagccaaagctaaataaatgacttgtttattatgtgagtgtctctgactgtatgtaattgatttccgtttgtgaacctgcaatctacaaaattgactgttttaacaagatgtgctgactggtgatatgctacagtagcataagtgttatggaagtaactaaccattttctgattggatagaaagtctgctccatgtgatgggacccatacctggcacaggtaaaggtgccgaaaacatgtagctagaacatgtagcgttctaagcaacaactccatactaatattttgctaaactgacatcagtattaaaatgactcctaattaatgactcgatgatatacttatagttcagagcatctcccagaccttattagagaaggttctccttgaattcgatggcaattaataccaatattttgtgttcaactagtcagtgtgcagagaacaacaaactgtgaaatgctgagacttaataggatatacatatatcacactcctccaactcaagacccaagactcccatcctgggaagactctaagagccagaaatgataagtaacatcaaagaaacatttttgagcaggattgtggtagtgcacgcctttaatcccagcacttatgaggcagagataggcggatctctgtgagttcaaggccagcctgatctacgggaaaagttccaggacagtttccaaagctacagagaagccctgtctcaaaaaacaaacaagaaaagaaacattttttttccagacacaaccagaaagctgaacaggagccagtggttatgacaacatgtacaagacctgaataaacttaacagacaaaatcctagtgtaacatggaaaaaaaggtgtgcacaaaatcccaccactagccaaagagctatttgtattttaaagctagtaggagaaagtgagtgttctttaatgatacaactctgtaggttggccacactctagggcaggctccattcccaagtctacttgggcaacacaagtggactcaagggaagaaaaaacaaaaagaagaaaaatcaaagttgggaatgaatatgttaaaattacattttatgaaattctcaacagattaatcaaaccattgttttagaaaatcatccaattacagagtccttctatatcacaccctcttcctctatcataatgtctatcatttctccatgatagacattatcttcttcttgctgtctattcattgacatgaattgagggtcattaactattttattgactccttattataagtacctgaagaaatgttgagtcaatcaattttaatatcagaaagttctctgctatcttctgatagtttctcattcattcaagagcaaaccataatcagaattagtaccaaaaatgtttgtggtgtttgaatatagcaacatgattctctaaaccttgttattgaactcttgccatttatgattataatgtataaggtaaaatgattttactctatagagtaaaaaataatggctgtttatatttctgcaccctctcaaatgcaaactatagagccaaaaactgtgggccaaaacctgacacaggtgaagaaattaaatagggaaaggaacagaacctcatgttcattaaaatggtttttttgttagcaaactgtaattattctaaaagaggaaattattcatcagtctgtaacttgatcctgcataattcaaaaatatattatatattaaaatttaaaataacatatatgttatgtgtcatatgtataaggcttgaatatgcatacttatgaaagcatatgtatatatagtaattaatatgtatatgggtgagttatatatgtaccacatcaaaaactgaaaattcaaaacaaacaatacctagaagagggaaataattatagttcacagagcactctgttctctgagctgtgctggtattatccacaattgtgtaacaattctgtacagtagatcttgctttcttattatttgaaaagcaaaagcaacagagatattaacttgttccattaagctgaagttttcagaggacatttgggctccttctgaacttatggttgttattaatccatttaagattaatgaatttaattgaactatcactacattcaggtatggcataggagtttagcaggcaataaaagagactatgaacctgacagaaataaatgattggatcaataaataagtggaaaaagaggcaagtcactcataaattaattctgaatagcttatataagtattccgtattttgaggactggagaatattttcttagccctagattgtaggctaagtttattggcttagcagttttctagcaagaaatagagtttataaagggaagagaggaggcacaataactttacagaagggaaaccaaccctcactacctcaacaggtgagcattgataatgttagccatgtagacagcatgtgcacctgacaggccataaggagaatggcatctcatctcttcattccccttcctaaaataaataggcaagtctgatcatgaaaaagtacatctaacatccaacgtgtactcctcaaaaccataacggtcatcaaagtcaggaacatccacatagaaagacgaaaaactgtgagaacatctgtaatgttatgccctggatgagatcctggggaaaatataagacattaggcagtaattagtgaattctgtctaagagtggagttgagttgataatgtaagagtgttggtttcttggttgtgacaaatacgccatagtaatgtgaaatgttaccattgaggaaaatggggaaagggatagatagaaattctatcttgcaagtttctatctagcgattctaaaaccaaaaattaaatacatacatgcacacacatatattcagtatcttggacaagaatataaaacagctatatttccattcctggccaagtacctttattgactgcctctccaagtgttataaaatgtacatcctctcccaacacaaacacacaaaatattcagacttgaagcatgaagatagtgtttaaacttggaagagtcagagtgagtctactggctaagctgaagagattggagatcataattatgcggatgaaggatggtggctctcctaatttcaggcctggatgagagcttctgaatgttccttcctctgtaaaagaaaaggttcattaagaatctgttacttgaggtgaaactcagaagaaattacgcagaagacactgggagtagactaaactagggaagccatgggagtggtaaaacacaggaaagcagttacaaaagatcccttggggctcagggaaggaaaagttactctgctcagtggaatgtgatggaatgaccctgggagcaaatccctactgaggccacacaggcactgatggcactgtcgtctctcaggtaccatatgggcatggtagagcagatttatgagggttttctggtgttaattaaatctctccctacagcctgtgttaacaacatttgcttgttaggatgtgtatttctcccctctgagacaaactggtggttggttttgttaatcctttcatagtgcaaacttgtactctatgtctctgaagtcttgaatgtaagcatgcaggtataattctggatttgagtgaagcccaaacaaggaaatggggacttcgggaagcagcaccatgaggcatacacttgatttttacctttcttattttttgtgtcttgccatatctgcactgaactaaagaactgatttagaaaaataaggtggttttttttttttgttttcaaaataagatgtcttttttttttttaaagaaccaagagacacattttttttctttaagaaccaagagacacatacttttgaggcaaaataaaaaatatatatctttctcctgggctctgatcatttacagctcttacttatgattgctttccccaggtgtaataatttattgcctattagttcagtatatcaaaggctcgctttctctctttgactgcatgggtgactccattagtggtaatgaactgtttcatgggtaatcacaccttcaagacccatccacctaaaccctaaagcctgaaacctcagctgtttgtcctgcagagagaaaaagagcaatgacctgcaaaaagagatctgagaacctctggagatattaagtttaagcttaatagtaagtcattaataaataagatgcagcacaattatcaatatgaagcacatttaataattaataccttgcaaacaaaagagaaatgaaatactaggtggaattaggcagaggttatattcagttccccttgaagagcctgctttgaaaggaaattcacaaactgtttaaaactatgaaagaaccatttccgcaaagctccagtggagagccactttgcaattgctattctgaacactagcttacctctgggctcacacatattctctgtgctccattctaaaggtacaacttctcccttttagtcacaactttctctctttcaaggaagtaccaaaagttcaggtggatgtgtgtgatcaataaaataaataaataaataaagtccttaatatggctgtaattcttactatcttggatttttagggtagtgtttgttgaccataagatgaagcaaccaacatttattatttaccaaggtagtttgactaccatagtgggtatgtcatggaattctctaaataaacctgtatggccactttcattaagtgctgttcatagactagaggtttcaggttgagataatctaaggcacttgcctaagattaacagtgtggatagtgagttctgagaaattcatttctggtcttcggaggcctaagaatatcatccttggactcccaagtgactatatctaaagtaatacatttatttaagtattattttttaatcaattgcccacaacatctggcagctatgctatcagttgtctggagactaaaaacagtaagacttcccaagtcatgattcagaaaggcttagctactctctggcattgctagccaatcaagtcttccagcgttgctcatgagcctggccttttcgccagcctgtggctttttgcaggagccactcaactctattgaaaggttgactgacagtgtcttcccaatgctgccaccaagcaggagctgttctaacctgcagcatagtatgtgttggccttagactggaataaaaaaaagtgatacctcaggatatatgttgagtttctcagctctaatgtgtatgtgaatgctttaattccttggtcttctagatgaccaaccatttactaggccaagatctccttagaatgaactgttcagttaattctgagccacctttaccatccatgattccaggagtaaattgaactttttcttttctaccaaacatgttctggctcactgtgaatacaataggaagttcactcattccacattaaatgcattgacttatgtttgaatttcatggtctattcacaacactcatcaattccatttacattgcctaaagtttatagccaaatcctactaaaaccactctgtaagataacattaataaaaaggaaatctgttggaaactattttgcaataataaaagcattcaaacttcaaggtttgagactctttagagtgagtctttattataaacactcaataagtactagagactagaaatatggaagtttgagtcatgtaggattcttaaaatctagattataggtttatttaatacagttatatcaatgggatgtttttctattcttctctcttctatttattctctgacaatgtcatgcatgcaaataatgaatcagttatattcataccataatctccctcctacttcccacacacaacacatcattgagtccaattggtgctgcttcctggaatgctgataaatcttggcctcatcttgtgctggtaaccatagatgcagagtccacaaatgtggtggtcatgccatgtcacagcataccttccagtcctcctgatgttacattcattttttaaacagggtttctatgtgtagccttggctgtcctacacctcactcagagatccacctgcttttgcctccaagagctggtattaaaaggtgtctgccggcagtgctcaactgctgttttgatctttgtgttccctcttcaattatattccttgaacctttggaaggagttggtataggcaactaatttatagctgagcacccaatagtaacttattttcagtactgtcaccagttataagtctctgaattacttctgactactatagagagaagtttctctggccaagtttgagggcagcactaattgatgtagataaacataaatactcgagacagtttaatatcatgtctatttagcaaaacaccccaagctacaaacttttaagagcccttaaatctgaatcaaaagcagttggttactccataacatttgcaccactattgcatcatctttcctggcaggtccagcatcatagcactcagggttcactgctactggtaccactgatggttttttcccttcagcagcctgccacggcactttctgacactacgaaaactgaccagcaaaggggaatttttcaagcccagcttgattgctttatgtgctgtaaccaaaatgtcttcagattattatgttggcatctagttatgtgagcaaacaagagcaatggctagtaatggcatatttattgacaatcaaacataactttcaactgaagataaataggggagtattgctgtaggttttatcagcctaatacatttcaatgcttaagtataaatatgtagacacaatgttttatcacgaatgatttctctctaaataaagttggacaatacaaggaagtcttagagcttagaaatgccctttcaaaggccagacaattggtgccatctactataataaaaaagaagacaaacagagtcatctctggtggtatgaactcagtgtagagagtctcctgctcaaaacaaaagtaagcttggatcccctatatttgtacccttttatcagaacagccacaaaacaccatattcagcctcttccaggaaattcggtggcatctgtgttagctctagttatctctcagggttcagttcctcaaatttgcttcctaaagcaattgatggtaaatctataaagtgtacagatatacccctaacaatgatatgtccatatcagtacttatatccacagataagtgaagtctctacctctcatcatggaaattgctctttgcaacagaaggaaaccactacagaaaacctcagtgaatcaaattgtggagttgtggaactcagtcccagttgatatatctataaaacattcacactcctaaggctttgggaacatgcagaagatagggcagaaaggttgtaagaggcaggagatcaggaagtttgctgtgaaactgtttcctagtaatatcagaagctacacccatgacgtctcaccaacatgactgcccaaatgcgagctgaacaaggaagatacccacagacatgccaaaaaggatgagagaaaaccttcaaggtctcaactctatacaaagaactatcagctactgaagaagctgggagctggaaaggtggttttctccagggaagagcactccaattggttgtctagtatggtcatccctgaaaatataaatacatgtaacaaaacaagggctgaacaggttatatttaggaacatatatgtatatacatatattcatgtaataacaattaataaaagaggccatgaatttgaaggagagtggaaaggatacaaaggaagatttggagggagaaaagagaaagaaaaaatgttgtaattatactaatctaaaaaaaaatagaattagcatctaaaaatgtatgcctgtattgtaaaagtagacctatgacacaagcatgcatcttacagtttaaggtactgcaataagtccatatcacattcccttctcttacacataactgtgctttgtgaatgcagacgtgtctcctccccacataactcttctgtaacaaggactagaaacatactgctctccataaaggcctgtgggctgactactaggacaaaactaattaattctctggttttgagtgtgtgttctgcttctacagtgttgcatgaccattccattagatgtattttgtagccttacaactcaactgtgggggtttctctggtcctggtaggcaaatattctccatttcctatggatccaaaatgctacatttcgttaaaacctgtcctcaattacccccttgtccaggaagtcccactaaagctcttgtctctccatacctgtcatttcagtgatgagtatatgtcttaaaattaatgcctcacagtgttcctctgtgttctatggcagacatcttatctctgcaaaatgttaagctcccttgagggaaggggaggcaacaaacagctcctgtctggattatcatgagctttatagccaccctcaactacttttttaaaatttatttaaacacacagagagtctgtaactagactttcttagtatgtgccagtcttttctctttttaaaaagactaatttttatgcttaggaatgtttgtctgtgtgcatatatatgcaccacatgcatgcctggggttgtgaagtccagaagagggtgtcagatgccctggaattgggtggtgctgggaactgaacccaactgctttctttgtaggagcagtatgtacccttaaccactgagctgtctctccagttcctattctcccaactttaaaataaaatgttttaagaggctctcaatgcctgaggacttccaagaattttttaaaatttctcttcctaggttttcctaattcatatttagcctgagttctcttttctaaaaatctaaggagtcagacagtatgctacgtctgcctgtctttttccatagtggcaaacttatttagattaacttcatccttctgagagaacaacagtaaaagtctccacattgactctctgctaaatgctcctgctccatagacatatgcactaatgtatgcggtgatatattatttatgatttattaaagcttgcctgaggattcagaaagcaaagtcaaccacaagatataagggtcagtggtggaacacacctttaatcccaggactcaggagagaaaggcagctggatctctctgagttcaaggccacactgggctacatgatattgaatcagtctaaaagagtaacagaactcatgcctttaatcccaggactcataaaaggtatttaagacaagaacagggtctcagagctggctttcattacccagccacattgaggataggaaggtattaatttctccagccatgctgaggcttggtggagtcagtatctctatttcattctgaggtagagtaagagctagtagcccattactttgcttttctgatcttcagcttgaaacttgaaccccaatatcaatctctgggtctttatttttcatgctacagatgtatgcactgatttacatgtggacatatgtgtgacgtatgcatgtaagcagattctgtaagtcctacacagaaggagctgtctcttgagaccttagagcgacagaacatggaggtaacttttacacctagagattattctaacaactgtattttctgtttttaaatttgcagtgtagagaaaatcataaacaattttgctcttccaaaaacgattaaaattgaaatctaactaaggagttgtttttgcttgttttatcttaaagatattataagattgcaaacacatttaatataaagaaaaggaagaaaatttgagtgttcagggatggtactgggcataagcttttttttttccttttttaaattaaaatagaaacaagtttattttacatgtcaatctcagttccctctccctcccctcctcccttgccctccaccaagtccctatcccaaccctttctggtcctcaaggaggctgaggccttccatgggggaatctttaaactctgtcaactcatttggagcagggcctaggcccggccccatgtgtataggctgagagagtatccctctatgtggagtggactcccaaagtccatttgtatactaaggataaatactgatccactaccagtggccccatagattgtccagacctccaaactgatctcctccttcagggggtctagaacagtcctatgctggtttcccagctgccaatctgagcttcatgagcaaccccttgttcaggtcagctgtttctgtaggtttctccagcctggtcttgacccctttgctcatcactcctccctctctgcaaatggattccagagttcagctcagtgtttagctgtgggtctctgcttctgtttccatcagctactggatgaaggcattaggatggcatataaggtagtcatcaatctcattattggagaagcatatttaaggtagcctctcaactattgcatagattgttagttggtgtcaaccttgtagatatctgggcataagcttttaaaagcagcattagagcttattaagggagggtttttcaggctggggagatggttcagtcaacatcatagtaaaggaggacctacatttgattcccagaacccaagttaagcagtcctgtgataacatgtgcttgtaatcccagagttgggaaggcagagatgaatagattcacaagccttactggtcaatctggccagccccagttagtaagttccaggcccctgagagaccctatctagcacacagcccctatagtaaggcactcaagactgacctctgacctccacatttacttgctctctctctctctctctctctctctctctctctctctctcgctctctctctctctctctctcgctctctctctctctctctctctctctctctctctctctcacacacacacacacacacacacacacacacacacacacaaactcatatgagcacctccaccaccacccatatgcacatacatacatatagagacaggaagaaaatgctgcagtaaaaacttaagtatagacattagtggagagagatgcaagcatcagcttttcaaaggcagatgttgtgtacaaattttattgtggttttatactgttacaaccatctaagtatgacatatcactatttggatatgtgtgcatgtgtgatggtcaaatttttaatctagacaactaaacttttattttattatgtgaatacctgaagacaagtaagccctgtacaattttacctgtttcactggtttatttgtcaacaactgtatttatccaacactaatattaacagtttccctgttgcaagccttttggtggcaatagcacttacttcaaaggtaaactaatgcctttcttgaagtaattgttagctttcaatgagaaaaaaagtgaagttgcttttcaaagcacagagaaaataaatagaaatttgaagactagaatgcattgatgaaaagaataaatattggaaacagtattcttttttcagatttttaaatttgaattagaaacaagattgttttacatgacaatcccagttcccttctccctcccgtcctccgctaccaccccctaaaacactacctatcacatagcctttttgctccccctggatggtgaggccttccattgggtgtcatcagagtctatcatatcctttgggatagggcctaggcccacccctgtgtgtcttggctcagggagtattcatctatgtggaatgggctcccaaagtccacaactatgctaggaataaaaactgaactactaaaggaggtcctgtagattcccgagatttcctcaatgaaatccatgttcctggggtctggatcagtcccattctggtatcccagctatcagtctggggagcaagagttccctgatgttcaggtcagttgtttctgtgggtttcaccagcctggtctggacccctttgctcttcactcatccttctctgaatctggattccagttcagttcagccataagttgtgggtgtctgcttctacttctaccagctgctggatgagggctatccggtggcatataagtcagtcatcaatctcattatcaggggagaacatttaaggtagcctcttctctgtggcttagattgttagctagtagctactagtagctagtagctagtagctttgtggctctccagacatttgcctattgcctgatttctctgtaaacctaaaatgcctccctctattatggtttctccatttttgttatcatctattcttcccctgactcaaactttctgctcgctcatgtcctctgcatccctcctcttcttcccttctcattctcctagctccctgccccctcttcccgtgctctcaaccagctcagaggatcttgaccctttacccttctctaggggaccacgtatgtctcttttagggtcctccttgtttactagcttctctggcagtgtggattgtaggctggtaatcctttactctatgtctaaaattcgcatatgattgagtacatatcatgtttgtctttttgtgattgggttaccttgctcagaatgatttcttctagttccatccatttgcctgcaagattccattgatcttttccactgagtggtactccattgtgtaaatgtaccacattttctctatccattcttttgttgaggggcatctagactgcttccagtttctggctattacaaatagcgctgctatgaacatcgttaaacagatgtcctttttgtatgaatgtgcttcttttgagtatatgcctaagagtggaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttttcccagtctgtgggctgtcgttttgtcttactgtgttctttgccttacagaagcttctcagtttcaggaggtcccatttattaattgttgatctcagtgtctgtgctactggtgaaatattcaggaagcagtctcctgtactttgtcttctaatatggttagtgtggccgggtatattttgaggtctttgatccattttgacttaagttttgtgcatggtgataggcttgggtctatctgtagtcttctacaagtctgcatccagttatgccagcaccatttgttgaaaatgttctctttgttccatcgtataaatttggattgtttgtcaaaaatcaggtgttcataggtgtgtgggttaatatcagggttttcaattctattcccttggtctacctgtctatttttgtgccaataccaaactgttttcaggactatagctctgtaatagagcttgaagtcagggatggtgatgcctccagaagttcctttattgtacaggtttttttgtttgtttgtttgtttttgttttgttttttggctatcctgggtcttttgtttcttcatataaagttgagtattgttctttcaaggtctgtgaagaattgtgttgggattttgatggggattacattgaatatgtagattgcttttgacaagattgccatttttcctatgttaatcctacctatccaagagcatgggagttctttccattttctggaatcttctttaatttttttctttagagagtcaaaattcttatggtacaggtctttcacttttttgnnnnnnnnnnnnnnnnnnnnnnnnnnnnnnnnnnnnnnnnnnnnnnnnnnnnnnnnnnnnnnnnnnnnnnnnnntactgttctttcaaggtctgtgaagaattgtgttgggattttgatgggcattgcatttaagatgtagattgcttttgacaagattgccatttttcctatgttaatcctacctatccaagagcatgggagatatttccattttctagtatcttctttaatttctttttgtaaagactcaaagttcttgatatataggtctttcactcctttggttagtgttacaccaagatattttttgttgtttgtgactattgtaaagggtgatgtttctctgatttcttttttcgcctcatcagtatatagtagggctacagattttttgagtttatcttgtatcctgccactttgctgaaagtgtttatcagctgtagaagttccctggtagcgttttttgggtcactcatgtagactatcatatcatctgcaaatagtgagagttcaacttcttcctttccaatttgtattcccttgatctccttttgttgtcttagtgctctagatagaacttcaaggacaatattgaagaggtatggagagagtggaaagccttgtcttgtccctgattttagaggaattgcattgagtttctctccatttaatttgatgttggctgtcagcttactgtatattgtttttattatgttgaggtatgttcctgttatccctgatttctccaagaccttagggctgttggatgttgtcaaaggcttttatggcatctagtgagatgtgggctttttttcctcagtctgtttatatggtggattacattgatggattttcatgtgttgaaccatccttgaatctctgggatgaagcctacttgatcatggtggatgatttctctgatgtgttcttggatttgatttgccagtattttattgagaatttttgcattaatattcatgagggacattggtctgtagttctctttactagttgtgcctttgtatggcttgggtatcaaggttattgaagcctaataaaaagagtttggcaatgactcttctgcttctattgtgtagaggagaattggtattagctctctatttgaggagaattggtattagctgtaccttgaatttctggtagaattctgcagtgaagccatctggcactggagtttttttggcggttataggtctatttatgttgcttatctgttcttgatttaattttggtaagtgaaatctgtccagaaaattgtccatttcctttagattttcaacttttgaggaatataggtttttgaagtatgactgatgattccctggatttcctctatgtcttttgttatgtcccccttttcattcctgattttattgatttgtatgttcactttttgctgtttggcaagtttggataaaggtttgtctatcttgttgattttctcctagaaccaactcttcattatattgtttctttgtattgttctcctagtttccattttattgatttcagccctcaatttgattatttcctagcgtctgctcctcccgggtgtattggcttctttgttttctaaagctttcagttgtgtcgttaattctctagtgaagaattctaaatttacagtatggtgctctgataagatacagggggttatttcaaatttttttgtacctgttgagttttactatgttgccaagtatgtggtagattttagagaaggttccatgtggtgctgggaagaaggtgaattgttttgtatttggatggaatgttctatggatacctgttaagtccatttgtgccataacttccattatttcctttgtttctttgttaagtttctgtctggcgttcctgtccagtggtgagagtgggttgttgacgtctcccactataattgtgtgcagttttatgtgtgatttcagttttagtaatgtttcttttacaaatgtggatgcctttgtatttggggcataaatgttcagaattgagacttcattctgatagatgtctcctgtaatgagtagaaagtgacctccttcatctcttttgatttattttaatttaaagtccaatttgttggatattagtattgttaccctcatttgtttctttggtccatttgattggaaaagctttccctaacctttaattcttaggtactgtctgtctttgaagttgaggtatgtttcttgtatgcagcagagggatgtgttctgtcttcttatctattctgctaatctgtgcctttttataggcgagttaagaccattaatgttgatggatattaatgactattgattgttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaccttctggctttcagagtttccatggaaaagtcaggtgtaattctgataggtttgcctttataagttacttgactttttcctttgctgctcttaatattttctctttattctgtatgtttggtgttttgattattatgtggggaggagacctttttttggttcagtctatttattgttctgtgggcttcttgtattttcattggcatgtctttctttaggttgggaaagttttcttctatgattttgttgaatatgttttctgtgcctttgagttggacttcttcaccttcttctatacctattattcttaggtttggtcttttcatggtatcccatatatcctggatattttgtgttagggatttgttggacttaagattttctttggttgatgaatctatttctgctagtgtgtcttcaactcctgagattctctcttccatcgcttgtattctgttggttatgcttacctccgtagttcctgatcatttacccagcttttctatatccagcatttcctcagattgtgctttctttattgtctatatttcagtttttaggtcttgaactgtttccttgagagatttgttgatatcttgtatttttggtgtggtttttctttcatttctttaaaggattttctcatgtcttctttgaggtcctctatcattttcatgaagatgtttttagggtcattctctttggttcatctgcattgtgatgttcaggtcttgctggtgtatggttccaagtctccgtggttgtcatattgggttttctgttgttgaatatgcttttacattgtcctcttctcatcctttcttctggtgggtgtagcaggagtctcttcctttcctggtgggtatgggaccaaagttcccttctggtaaatgcaaacagatccaatactctgatatctgtcctcttctcgtggatggggaggaactgttaccctgctcatggcagtgtccagggttgtttggatctggtgagcagatccctggcatcagatgtctctgagcagggcagccgaactgtggaaacagtattatttcatatgaactatatgacatgtttcaaaggcttgtgacatacacatacatgtatgcatgtgtcttttctggatgaaacctcttaccagcacagcatcaggaattcaatacagtcaacaaccttggcttcaggcctttctttttaggaatcttgcctgcatccccatttatagtataagacatgtctcaagccctttgtgcaattctagtaccttttggttttaccatatcagattataaccctatctaagccacctctgaagtcacccttatagtcacacttcttcaaataagagagaggggggaaagtgtcttaccagttatttgatatgggagccacctaaacaatgacttaacaatgatcttccatttagaagcccagtctacttagatatgtctttttccttccctggatatctctcttctacctttcaaaaagttcataccaaaaagctctttttaggagtgtggtttcaagagagggtttctctttgggttttgagactgtcctggaactagctcttgtagaccaggctggtctccaactcacagagatccacctgcctctgcctcccgagtgctgggattaaaggcatgggccaccacctccaggcccaaaaggctcttttaataaacccagactctgctgagctcacaccctgctctcaagtgtgcattgtcatttccccccaaatctttctttaaattttaataaactccaaatctgcttcttactttctcatcctaaaactcctttctccatcaaagctaggggaactgagtggaggcctctgaaaacatctggggctgcttccagtgacagtatggagcatgtctcttcccttcctgctactgaccaggtcatcttgtatgttctgtgtctgcctctgtgttcctggacactgatctttcttggtgctcatgactactctacaatgtcggtttattcatctgtctttaaacagttctggcactcaaccatgcctcgaactaggtatcctggcaccttcattgttgcattagatacattcagtttgagggaagggctgcattcagaaccagcttccttctccccagcaaacagcctggacttgccagctgctcccagatttgccccttacttcctagtctcctcttccatcacatttctcaggtgtctgctcactcagtggtccagtcatgcaggacttctcttttctcacgtaggctgtaattttccaccttgggtcttcgagggtcattccaattaaaatacattccatttggtatgcagtgaaaatcaaggtcaggcttaaatgctgctacctctgtgctccctgagctctttgatcataacactaatatagcacgaatcacattgtgttgtagccagtgatctgtctttcccaccacactgaaccctctaatgagcaggagccctctggtttgtctttgtaccttcagagaggttaagtgattggcttaagatcaaaacactggcaaaaaaaaaagaaaagaaaagaaaaagaaaaaaaaaacacagaccaacccttccattctgcctccaagtccagtatgctaaaaatatttcttctaaacttccttctgcttttataaagctcaagaacattttactaacattaacaatggtagcagatatatacatgtatttttattgtatcttttcaaataaaatgtctgcttcaaaaaccgcaggggaaaaacaatgtataggtaggtggtaaagtgtgaggttcttttcaggaataaccctcagtggaaacctgcctacaaactcctaaaatatcatctcctctggccatgtagcttcatttgctgacgttttctactcccaaatagattctggagcacaagacgaaggctcgtgacagttgactaagttgcctagatatccctctatgtaaagtaaacatctttgaaatatagttatatgagaccctattctagaggagaaactgcctgttaaacagtgaagaaagccagcagcaaccagtcgatgcctggtctactttctgggctgcacctttagacctcctgcacatttgctgacagcagttcaagtgctcaccagagggctcggagggcgggaggggagagaagcttactttaaggaggccaagcggcttggaatacatgcagtggcctgagcacaggtccaggagtcttaggctttcggaactgtaatcctagctcagacactgatccctcctgctcccagggataaattactcaacctttctgccttgctttccagatctttctaaataggggtaataatcttgacctcagaaggttggtgtatgaattaaacatccgtgaggcctcatcttaaaatccagcagaactaagcagactcagtaactcttttgatgtgggttaacaagaactatttctttctttctttttgtttttttgaaaattttttttcattttttttattttacttagaaagaagattattttacatgttaatcacaagaactatttctgttcaagaggtgaaagatacctgattctagcagcctccgaaaggaaggcaaattcatgaactatttctgttcaagaggtgaaagatatccaattctagcagcctccgagaagaaggcaaactcataaatgaaagaagcagaaagctaggaacaaaaacaagcaagccatcaaaaacttttacttcaccccaaaccatcacgcctgactggttcattctcccactataatgagcaccgagtttggcccttaacaagctttgggagaatggctgcctttcaggacactgggctacagactgagcctcagcatattttcagggtcttgtaatagttactggacacatttagttggagaaagattcaattgtgatcactaataagagagaaaactttttaatatcttgaagttttgttgaaagtaccatttataactatacggaaaaagattattatcttagcaatacaatttaacacataaaaccaaatggctttcagagtaagtgagggatgtatgctagatgattacatgtaattccagatccacactagtgaagcttgactttcccatggagagaaacataatacattctgggaatggttggctccaaagccagcatgacatcttggttttaggttcgtttgcttcctaagcattacctctctcatttggatctcctcccttcaactaacagcagagcataacacacagtgcatttgtccttcatgtagagttaaggatcgtggggcctcaggcgtgctagtctagtactccactactgagatatgttactgtgtgtttgtccttgaacgagttatccactgttatcccataacttaacctcaaaatgtaaagacaacattaggtttgttatttcacaatttctcttggtctggaatcagggtgaagcataactgggttccctgaattatggccactcaaaatcatgatgtggtcaagaggagttgtagtaattgccaagcttagcgaggaaggggctgcttcacagatgacttggaacacagttggcaacaggttatccacagtttccaagaggagattacatcagaatagcaaaagatggggatgactgaagccacctgaaggtaccgtgatacagatttctgcatactatatactgtatctaacttcctttcagcagtattcatattctggaggattttattattagcataagagttacttgtaaaacactgggaaaccagcatgggactgatccaaaccccatgaatgtgggtgtcagtgaggaagcctcagaaatctatggggcctctggtagtagatcagtacttcttcctagcataagaatagactttgggatcccatttcacatagagggatactccctgagcctagacacacgggggagggcctaggccctatcccaaaggatgtgacactctgaagaccccctatggaaagcctcacccttcctggggagcagaaagggtatgggataggtagggtgttagtggggagaggcaggggaggaggggaggaacagagaactgagactgacgtgtaaaacaatcttgtttctaatttaaatttaaaaaatggagaaaaaaaagaatgtaaaatcacctctattagtatcatagtgaatgtttaaatgacagcaaaggagtcagtaagaccactcaaggaaacatggaagttgtaccaactgcagcttgaaggcagaaaacaaggaaggcagtggggatgtgtgaaggctcagagagccttatatatgacaatagtatcaactcgtctcacaactcattcagatggaatttcaaaataatatcactctcaaatcaagaggtgggggcagggaagtttcacagactgggaacatagctccctggtggagaatttatccagaatgcatgataccctgggatctatccccagaatcagtctctcaagtttggatcttatgctgtgtgaatatgtttgtttctgaaaacaagacctgcattccatgtgtgtgtacatgggaagattaagcaaataattttgaatggatactgtagtcaaaatgagatatcctatcaggtttcaaaagcatttcaagcctgattttgaaaaggaaaagttattgctgaaatattttcctactcagtaccagtaatatattcatttgtttagggtgtgtatttgtgattgtgtgaagcctgtggagagcttggggtcaatgaaatatcttagcatctttatggaaatggctcaagctatacagcctgcaaagtgacaataatgttgcttacagaccccctcattgcagtaatcatttaactttttaaagataatcctgacatgagaaggccatgcagttttccctcagatgttgttaaatgtgtattcattaaaagtacacacacacacacacacacacatattgtatgagtgtgtgcctgtgtgcatatgtatgagtgtgtgcatgtatgtgtgtgtgtgtgtgtgtgtgtgtgtgtgtgtgtgtgtggtgtgtgcccttgcacacctacagaggccagaagaggatgtcaggtgtctgcctcagtcattctccatttaataatttgagatagggtctttcactgaacctttaactcactaatttgctaggctgcaggaagacacatcaatactacagctgcatggacatatggcttttacatggctgctatgtgtctgaactcaggtccccatgcttaagcagcaagagctctttccgtctctgcactaagtgtaatgtttatcaaaggagtctcattacagcagaagcttttctcacgtgaagccacttctgacatgcagccttccttgtccccacatgctctatgattgctgtttccaaacatggctatttgagcacctccaggttagcaatctgtgacaagatgaattacaaaagacatatttctacttctgtgtcatcagagagaagatgaagaaaaataggaagtctgttttttttcttccaaactttgtggatttgatgaagtagctgctgacatagttgagaaaaatccccttccacaagggtttcaaagcatcatttctgcatctgaaaagcagaaagtcattctgagtcaatagttaaatctcaatgcagcatgcactgagttaattggggacacacacacacacacacacacacacacacacacacacacacgtacatctggaggaggaggaggagaaagagagagagagagagagagagagagaacactaacaactaaccttttcttctcttcattttcagtcttgggatcaaattgcaagtgatcaagcccggtgcctgtgttcatcatccactgggctaacagtgttgtaagagagagatgaagaacttgtgagtgcagtattggtttgtcgagctgccacaagtgccacctcatcccagggatttaagcaatagggatttattgtctctcagtcctggagtgtggatgtttgaagtctttcctagagcctggagggtacatctattccaggcctctttcttaagattgtattggattatatcttcccagtattttcacactgcctctctgtgcaaacttttgtctaaattgtccttctcataaggatatcaccacaccagaataagttccacccttatgaactactttaactcaactacctctgaacccaaatgcatgttcaccaaataaggttgcattctaaaaaacaagcggttaagatttccatacatgaacttgggaagaatactgttcaaactacagaagatttttgctattgttgtcattttaattgttttatttattgagttagggtcttatgtaaacccaattgctctcaaacttgattttgtagttaaggatgagtgtgagcttctgatcctcctgcctttgtatcctatgtatttataggcatatgccaccattgattttagcattgcagctggaaccttgggctctgtacatgctagacaagtgctccaccaactgagttccatgccaagcccccatattatttctgtcatctacaacaaaacaacgcggatgggataacttataaacaaggctgggaagagctgagtcaatgtgctgttagactcagttatctggtgtttcctccagagatggttgtcataccaccaggtcctgaaatgacaaaaagtacaagagataccctaagtcatctttggcaaggaaattagtctcatccatttaagaaagcattacaatacgtataataattactttcaagtttctaaaggactaggatagaaaaaagaacgtgatttttcagggatattctaacatacaaaacaaaaatgagcacatgaaatcagggaaatgaaaaatttgcattaaataaaggaaatgcattctttgaaactctgtatagcatcctataagacagactttggcttttgtagaagtgcaaataataatatcaaatcttatgattagtagtaactgcttgatggaccttgaacttttcttcagtctatctctctccttgactattatcctgcagtgcaagaggtctctagcaactatttccattgcttctgtaggaatgaaatgagatgatgggcagcactgtgctcagggatactagttattaatattgttactattgatttttgcagtttcccaattactgtaagatgttgagatcattcctgcaattaaaacagtggctagctggccatacacagaagaagcaggaggtaggttgagtggctggagtttatgtattcctacttcagcaaaactggagttgctattgcttgattgtatcactcctcagatacttaatttcataagctacagtggtattttcccttgtcatgtgtttgactaatgttgaaaaatacctgtgcaaacatcaacatcaattttaatgtaatcttcagtgtcaaatattatcacaaaaaagcagcagtgaattatatactgaggcagctactaagcattgaatgtctttaaatttttattacatttcatttactcagtgtgtgtgtgtgtgtgtgtgtgtgtgtgtgtgtgtgtgtgtacatgcgtgcacgcacgcataatatggcatacccatagagttcagaggacaatttgaattggtagtgtccttccataatgtggccctgaggagcatagccaagttatcaaccttgccagcagaagctttcacccactgagacatctcatccaactttaatgcatttctttaaatgcaaatcctctgtgagcttattggaagaaccatgaattagctcttccttatatgaagaaatatagacaatacattctgcattcactcattaatttctaaatcatccaaacaccccccccccagagaaccctgctaaataatcagagagcagtttcccataagaatgcaaaattaacaagcttggtagccttccatcactcacttgctggtttcctactaaatgcaccagtacttattttctaaagtatacaaactatgagaaatgagctcaggttactgaagaaatgggcagacgggctcctaaccacattttcaatacaagggttgagctgaggaagggtttctaagcttataactgaagggcagtagacatttacaggtggaaagaaagctgtagaagagataaaaacgaatatgtgatgttcagagaaagaaaggccatgtatcaaaggaagaccttaagaattcccttggatttagaagaaatgaagtctgttgtaatatctcatgagtcagtagaatgctaattgatgctccaagtcctatacatgaatacagaatggcctgtgtaacattataaatggttgccagtgtcagaggagtccacacactatttaagatctcttactcagacaaataaatgtaagacatcataacatacattatactgagatgaaaattcaagtttttctatgttgtgcttctaaaagccgaattctttatttccttttctttgcagcaaccacactgcccagctctgtggaaatgtggagccatggatcaccaacactcttctctcctttaaaaaaatgaaggatgtgctattcaacagggagtgggtttttccaatggaaacatgaataggaatggacttgctttattaaggagaaaaatgaactctctgtggttctctggagaacatcccagacagaagcgtgggaatcagatagagacactcaaattttgttgacagatccaagtccgaacccagtttactgctcctgccctgtgtttccaacttttttctttaccccggtgaacatagtccaaatgcatcagttcatttcacgccagtgtgcctttgttatcaaccctccctctatctcaaatgtccttgcccttgacatccagtgccctgtttcccaggtaactgcccacacatacttcaagactcatctctttaaaatttctcccatgcccttagttcacacttggccactcatttctccatgttcttatgttaacccttacctgctgtaaaactgctactcgtttctgcacatttgagaacacatttctttctctccttacagcctttgatatgatcagtttccgatgaatgaatgaacgaatataagaatgaatgaaagctagtccagagcattaaagcatagatgcaaaagttagacttgcctgtttcaaaccctttcttgactcctaccagacatgtgaaattttggaagtaatcttacgattcaatctcagtttttcaattataaaatggaaatcataataataatatatgaaaaatcaaaatgaaagtgcaatgcatacttaatacatgaactggcagccctggctttccaaaatcgtgtgttcgtgtgtgtgtgtgtgtgtgtgtgtgtgtgtgtgtgtgtgtgtgtatatatatgaaaatttcatttaatttttttttattaaacattatccatatgtaaaattcagttaacatgatttcattaaacatcatcagtctttagtcaaatttcaataactgcagtacacccactgtaactcacctatgtaaaaaaaatgtaaaaaaacatcaaaattgtttgcagaccaggtgtggtgaaggccagttgtggtggtgcacctcctacccccttttacagattttaaaaaaaaaaaactcaccttgaaaaaaattaatgcaaagaactttacatgaaaaaggttaaattgctcatgtggaggatagagaagggtcccagccttaggggtcagagtggagcaaagcctgactcccctcctgaagacatagtcacagggctgcctgcttcctgatcccagagttcccagcacattgggtattcctccagctgagtcttagctataactatgcaccatactattctctcccccgaaacctaacagcttagttgtcccttctccaaacactccaagcccccaattcctgttgcactcagcctcaagatgaggggttcaactgtttccagccttatttatattggtaatggggtcaggaaaagaccctaggggccatagagaccatcttgccccaccttgatgccccctccctatttctgacttctctctctgttccttttccagtgtctcctgccaccgtctatcttagcataggctgctagagctcctaaggaagctctgccaggagggacctccagggggttaatttgctgtcatctaattagcatttgctgtacctcagagttttctggaccagaggaagcagcaggagtgggtgagatgaaacagagctttgatgaaggccctgttcagctcctccctggtctggcagaacccctccaggcctcaggtctcactgtgcagggggcaggcaggggtggggtgggtgtgagatcagtgtgattttgcagttcctggtcttgggggatatgagtcaatgaaacactgtgtgtatggcagttgctgatgagggataggcatcgattctggtcctagtcccctagttcctctgggctttgatatgaggacatccctgctggcagcagtgtggcctcatatagccaaccttcagatacccagtccagtccctatccagctgctcagatattcatgggcctgtttgggagttcagttctgggccctgacttgggcactgtatggtgttaacgataaatctttctgccaaaagcggcccaagccctaccaacatgtgtgcgctttacgccagccacccgcctgagttagggccccaattaatgcagagagagacttgtattaggtacattgctgcttggctaatgactaggattcttcatctgttagctcagtcttaattatcataaatctatatattttataagacttatcttatcggacgccttattggtgtccttccttgccggtggatcacattgggcccctggaggaagaacagaggggtaaaggggccacttactgtttctccttgctaaatatgagtctccttgctatgtcacttctggcctggatcaccacgtctctactacatttcccagaatcctctttgactcctagtcctgtctaacttgctgtttcattggccaaacagaactttatttaacaatcaataagataaacatacacagaagtactttcctcatcagtttggagataggatggagcttgatctcttagaagaaagcacccatactggcccagtcctacaggtcatcgactagtgtggtggcattctctatttcaaagaagggctctggggacaggcacctgctaccactctcatctcagggatgttggaagaaggatgaggccaggaaggtctcactgaagtccgagctgtcaacagcctgttccactggagatctacagatagcagggcagctgatgtgttagccatggacagtaaggtccatgtctcagcaaggggcatagccctagggcctctggtgaactcagctactcagccagagtgccaacctggaagatggcctgccagtcaaagttggctttgaagtattctagctcaccctgattattcctaggtcaatgggaacttggctaccctcttaggcagtggctgctgacatttatactccagcctgcccacccctgtgctccaacccaacaactcatctgtggcctcctgacactcctgtaacaggtgctgggtctccatttcatagtcaaaggcccacctagggagcagtgctggagtcctgtgaggcttggcaggcaaaagcagggaggatgtgaactagcagcagcctctaaggcccagctaagctaagcagaggctctacatactgagggtcaatgcaacagaagctctcctctccaggttcatccttctctcaaggcactttgatgtagcacttgtacagggacaggttgtggcagatggaattctgccaggtaggatctgcatggctcaaagagcagaagtagttgttcatgattgacttgtacatggctaacagagtgatcatggtggttttgctagtttttctgcagttagatgagaatggtgaacgaataaggcagcttgggcacatgtatgcctttaatcccaggaagcagaggcaagtggatctctgtgtgaaggccagctggactacacagagacttccaggacagccagaactacataatgagaccctgtctcaaaaaagaaaaaaacatctgagtcatacctgattgctatcacacaactaacaatgtaaacaagatcttatcgtcatggaagatggtcattaacctctctaagtaccagtaagtgaatgttttattgtttgacttgaactatttccaggagattttagtgtgaggtttcttagccagggctacttcctccaggatatcttcaactccttttcatctatgtcaactttcctttcagtgactcctctgggactcatatttagtaaccctcaaatgacaacaatgctcatctttcagctatctcgccatctccccaatcagtatcatggctttgtacttctttacaactcttgcatctactgcacaattcccgctttccattttgttaaacatcacacatttttgtcacagaaagacacacaggcaacacacttgcacggtttgctttctatgagtccagtaacagatatgcactgaagcaattgtttgtacaatgatttctggactgaaagttcatcctcctaatctcaaattgttgtgttcccataacaccaaacaattaagggagaagcaggtcactccaataccatccagagaagcatcttaccctgtcctccctttccttctcatttccctcatccctctccttctgccatattctctctttgtcacctcctctccctgggttatatgtatttatcctccacacagtcccagttatggaatctcaatttgactgaggccactgggattatcttttctgacaaccatctgctctgaagtggtggtaaagggttcctagtgaaggtccccactcttctatgatttccagctcttgaaagtagaatatctacaagaaaaaaacctccctgttggtagcattaattctctcttatagtgtaactggatatgcaatattttcatgttttcctcttattatgagaacaaggaagaaaacagatgttaaactatcataacttttggataatgataatgaatcattctaggaaataccaaaaataaatgattgggattttatgaaaaatactttgttttcccagacactttctcacacccaagactttccagtaaattatgtctagagaccatgggacacagataatctgggcttgtgtcccatggtgggtttctggggtgattctttggaagcagattcctgggccccattttgaattaatcatatcacaaccaagtgtggggatgcacagatgcaaaatggcattgaaagttgcattttagtgagttatctggatgttgctaatgaggtctgaccatcttccagctctgagaaggaatatttacagtgcggccacttcatgtctctgtctatgctctttctttctgctccaggctcaaaccagtcttttcctagagtctgaactagaaaaaaaataaataaaaggtagactgttgcaaagcccctgaaaacttggcactatgtttttaagataagataacataaatattctgaatataaggagataaaataacctgaatacttttctttcttatagctaaaacaatggtaggtatggccaaataaacgcaaaaggtgacttttgtaatatcaaaggtagtagagtgaacacaccagcctataccaaaggagagcaataactcatgtttaggccaatctccctgccacagccccactccacattactcgaggataactgctctgtcttcagatcaattcaaggaagattatttgccctgttctctaagcatttcaaagcacaccttcaaatctatcttatcttttccaaggctctttctagtgacttttcacaaatcacaaatcttctgatcttccatgacaacagaacaaaacaatgtgctgtcaatattcaagagctgtttcactaggcaacatagtgctgttcagtaataagaaagaagtcctattcaaaatttaaaaatcagattctctttaaatgttcccttctgctatatttcccataaatattgcccccaaaacatgttactagaaaacttaattcactgtgaaaagtgttgtgtgtagtggtacccactggtggtgacaaggccacaagtactttgccctcttaagtggatttaatgttgattatgataatgtttgagaaagtgagtttaatttctgaatcttttcatctccctgttctcttttaccatggataatcatataagaaggcctccatcagatgtcagttccttgatcttggtcttcctaacctccacaatggtgagccaataaactatgttcaatataaatgacagaacacaatgttctgttaaagtcattgttgcatagcaatttcttctgaattgaaatttttcttccaggaaagtaggggagagaaggggaaagcagctcatgagactgaggaactgaacaaacttcgcatttctgggaaagctaaaatctaaaagattcacagggcccttctccaaagttatagaaacagtaaacaattactgagcagctgagctgcctagaggagactcttgggcatgttcatctgtttaaagtcatgcagagagctcagagttgcaatttctgagtcattacctatgtcaggatgggctttttgatgatataactgcttttgagtcctccctcctcctgtaagtagcctcttacccagcctcttgctagtattcccagtaagctctttagttcacattgctataattgttatgttggtatgtggtgatttccatatctggcatgagtgcatgcatgcattgtgtctcccaggcaaaggctcatataatggtaacatattaagattaagtattaattaacatattaagcagcaggttaagacacatccaggtgtgaattgcagacaatctacccaatgcctttgccagatccctgatttcatcttcctgatggcagtggttaaaaatacaagtcagaatataactaaaatccatggctaaaccatctccatctactcttgatgtaccataaatcagcaaaataggcaagactctgaaatagtaacataagtagtatcgtgaatgctacttggagctaagatatttacatgaactagaatagtgaatgctacttgggctgtgagacttatacatggaaagaaatgaccagatactacctgacttagctgcagtcatctgaacaagtaagcacatatgcaaattaaaaatacatcaataagatgctgtacccaaatgcaactatgtttcaaaggtatgtataattccactctgtatctgtgtaacatgtaagtcatatagtcaatgaagtatgccatttacgctttttgattagtccatcatccccatgttgtatgaaaacaaacacatctgtttgataataataataataataataataataataataatacagcaagcataccatttttaagtatcatgtgccaatgagatagctccaattatgtttagagagctacctttaaaggtatgaggctacctttgaagtccaagcgttactgaatgcagtttccaattgtggttgaaggagctaacataaatcagttcaatcattgccattttaaatgtagagaaaggagtcttccataaggactagggctatttacaaggcagaattagccaccaaagaaaaccacatatccctttgcattatggctcaagtcaaccaaggcagagagatcacaacagcccctcacagtactgtacctaaaaaaaaaaatgctgccccaccatttatatgggaccactccaggatctctccatccccctaaatgttttgaaataaggattagttaaccccctgcccacagaactaccttgttgggaatagttttccagcacagacaataactaagacactgttaagggaggattctttgctctctcctccctaaactgtaagagtgaagacattctgaaaattgtaggtgcggctcatttggtttcaaatttcccagaacaccaaaagataccacactactttgtaaccccagggtctatccagatctcactactgttccctctttcgtgcccccacaacacatactgactatgggttggattgtgcagccattacttagacttatatctgtataaatactagagattcatattgtcgacattatcagccttaattcatcaattgacagtcatgaccagaagcaacaagtttagcatcactccatgagggcacagatgtcctccatttcccagggattttcttacttgtagtataccgtcttctatcaatttcttcccccatcacattttcaaaatatatgaccataataagaatgccatctaggctggttaaggcatttgttcattaaaaagccaactcgcagctaaatgaagagccaaagatcattagaggtgacagagcatggaatgtctgaaatgagtgcctcccacaaggcctcaaatatcaccttggccatttatggctctatggctctcttggtgtctattttatacaccatttatttaaaacagctttgagagaaggtcattcaggtatttggatgtgggttaacatctaaaatgaaccatggtttattattcttcttattgtccatttactaaggatagtatagtgaatggttgaagtctatggcctcatttgataaagtgcaaaaacagcattttttgccagtcatattagaatggatatcttgatatttaaagccctagccctgtaggaaagagtgctgatttttctgcatataaatacatctgcgccacatctttctaactctagagcataatattctaactcaggcagaggagagccacagcaaaaggacattagtgtctgcagcaatgttctctttaaatgaattggatctttaagacaatcttatcaggcttgctttaatgtaagtggcagctttatgtggaagcacaagagcaggtagtgaagggtatcatgctgcatcataaacctgcaggaattttacaagccaaggtagatgtcaagataatgagaacagattcacttgtcaggtgctccgatgccaaaaccggagttttccaggattttcaaaaggaatcctccacagtgttttctttttcatacattgacagcacgacagcgcccaacagcatttgatgatgcccagaaaggtggataaattaatattaaaatgacacacctgcctctgctgatcatgaatgcctctgggtaatctgagagtcactttaaatgcagattttttttcacattactatttgcaaacaatctcacgttcattcccttcatactgaaactaatcagaggggcatactcagactaaaaagtaattgatgcaagattctgagtaatgtttttgtctctgttcaaattgctttgttttgttttgtttaattttgtgcaggcagggactcaagtcatctagaatggctgcaactctttatgtaggcaaagatgactgtagactcctgactataacctcctgcttcttcctctcaagtgctgggatcccaggaacatgcttagttacacccttgctctgagaaatatctctctaaatttctgaacaagtgagaactcaggaaatgtagtaaccaaaggtcaaaatataaggccgagtcatttaattacctctacaatgaactaagaagaattaaatggtcacagctcagaatataaagaaattgatagtgggacacacccagagcacaatttaaaactgttaatgtttaatgaatttattaacctagaaagagaatggcttgcaattgcaaatgtgtacacatgttgcagaagtctaagagaattcagcaatgaaaggatcataagggtttggcagtggttatctgaattcttctcaagatgccttctaggtgatggaaaaatgctttcgcactggaaccatggctaaagtttctatccagagaaagtacttaggattctgaaggtgtgtggaaggtggaaaccaggaaatgctcaaatcgagactataactagagaaagaaaagattcagtgatttcttaatcactgatagcatggtcattggaaatggtgaaaataatctatccagcacatgtttagaattaaagaaactaatctgggaagttctaactgacttacaaagtcaaaactgaagatgaaatacatttttttaaatcacattatatgaacagtggtagaggaggcatatagtgaataccatttatattttagtttgataagcaaactgggcatggttttgtttaggaatataaagggttttaaccattttatcctattatttcccccaagacccagtacccccagctgctccaaatggtgcaggaaaatgaaattagctgattccctggaaagtctgtagcattcagctttggggcgttgttaattctccttctcctggggttccaagggaggcatgcctgagggcagagcaaggaggaagggagaaaagaggaattaacaagctttctaacttattgctacccttacatcttccaagggaattgcttaatttcactttgtacctccattcagatcagctcaagtttgaagaaaagagccaattaaatagatggagaagggagacaaaggcaattgggtgggtagggaaggatagctagaatttaaacaagtaaccacaatctgagacattcccccacaatacttaagcataagtatttcttttttctttttctttctttctttctttttttttttttttttttgaaaatctagccaggacaggactttttatgttttgttaactcttactttttcttaaaatatggatggaacccctgacttctatttttttaatgtagccgattcacagggctggcagttgcctgatccatacaatactcattcatgttcttcacaactccacctgttcctaacaagtgttctaaagttgaaattgagaaatatgtacctggaggaagcaatgctttgggtgacaaaataagggaaggcatgaatgggaaagataaaagagtgataggtagaagtggacagcagggatgacactatgaaaatagtaagtacacaattaagtgcacaaaagttacccaaggacaatggccagcatgctgttaaagatgacaggaatgagcactgacatacacatttgttcaagtcactagattgtacgaaaatcctcattatgaccccagctcaggaaacctcactgaaacaaatgtttaagtgctctatggagtatcgggatcttaaaattacctgagaatgtctcttcttgcttttatatgatacaacttagaacattgctgctcataatcacttttcacaaatttgactccattcaaccataaaaacatgagtatgcacagagtattgttgatagctatcacaatagcttaagcttaagcttaataaagcttaagaagtacaactttggttcaggactgtaaacaaaatctaaatctatggctgtccaagaggattccccatgtagccttaggaaaattacttgactaagatagaaactaaaattaaatggcaactttctttgagaaaaagggggtagtaagaactactgtgcaaaattgtcaggttcaaaggtgcagctgtttcataaagtgactgacacaatacacatccacattatttctgtgctcaaccgtcgtcaaacttagagatatgtctttattactattattagtagtaatagtggtatttgatgttctaatactgtatccttaataaattctcctattttttcctaaactctgtctttctggaagataacatgaaaacacatttcatcgactttccatagactccttactatgttgtttgtaaacatagacctgaataaagttcccagatagacaatcttccatataagtacataaaaggagtattaaacctagacataactgtgagttattaagcaagaaagactagcaagcaacagatttaccttcctgtctgaaggagctggaaataggttgtataaaccaagattctgaagacatgggcaacaaagggcagtgaactctgcaggctaagggatgagataatgctggtaaagctgcctctcgctccccaaggagcttccgggctattgtggagtgaggagaccttgactgctaaagaggggtcagaccatcagaggatcttctctggctacagtggaattaacttagaaatcaacaacagttgaggcccctgaaaaagtccccaaatatttggaaaggaaataatcctttcttaaataaatggtaagtcagtgaagactctgagaaagaaaccaagtgttttgagctgctttggcataggtcctgagtgtcctccaaagttcatgtgctgaagattaggttcccaattcagcagtaggacatttctggtggggaaatgaggaggactgtgacctcaaaagtggattaataattctatagactcagatcataacagtttgggagaaattatttttataaaagggctctctctctctctctctctctctctctctctctctctctctctctctccctccaagttaaaggaattttgaggaaaaggaaaagtctctgaaaagagggctagaggcattggtgcaaatactgctgcctaaaccaacactgtgttgtcaactagtgaggcggttttccataagggaaggtggtataaaggtacctaatgtccagaatgacaacatctagaattcaagaggcaaggaagttcccttttcttcctagtcactatgaggtgagcagtgtggctccaccatacccttccaccatgctatgctgcttcaccacagctcggaggacaaggccaagaggctatggattgaaatctctgaaactatgaaatgaaggtaatctttccttcctcatttcttatgagcctagcatctttcctttttaaagacatgtttctcagtttcttagatgtggctgataatcagctttcggacatcccaggaatgaagcaaatacttccatgcagtgtccctcatcctcctgtgagcccctcccttgaatctgaggtctaaggaaagcacctcctcttcactcaactgtgggtttagaacacagatagagttgccatccattttatcaggacttccgtgaaaacagtagctgaaataaccatctgtcagtctgtcaatcatgtctttacttcaggttggagcagcagtgctgtgaaagcaaatacataccagccatatctttaaccagaaaatgtgtcctcaagagattaaagtgtccagtgtcaaaagaaacccatgcctttttgctctcttatcagtacgagcaagccagatgatctctaatacaaaaaccatatgccacatacttatcaatgaatctaaaagtctaatagccaaagtcatagttatacagaagactgtaattagcctgtgacctaagtgtgatttttgttaaataaataacaaaatcaattaatttataaaatcatttgatttaatgtcttttgcctaattggtttatatgtgaaattcagatgagaataaaaaggccaaaaacagataagagaaaaatagagtgaaatagtctttaaaataggagtcatttaaatatctaatatatgttttaagaaatattgggtacatctaaaatttttaaagatgcaaaggagaaggtcattcattagcatgatttatgcaaaaggatctacatattgttgcaccaatttttattagaaaatgattagctacacacaccaaaaataaaatgctgtattttattaattaaatggctgtatctgcagtccctcaaagcatggacttctcataatcacaaatgtacaacaggcactactgcccccctgagtaacttgtggtactactgatataattctcatttgtgtgttgctaagagatgaacgaactctacttgagagagagaaataagaagacctcctttgtcttttcaaatcttgccagataacatcttccatttttcttggcaacataaaactctattagagcttgtagtagaattgcatagtccaaaacagaacattgagtctaaagctgttttcacaaataataaaaagagagagagaaaaaataaagtcacagtattttgaatccacaaagaacattgtttaaattaatgacatggtttaatttgaagaaatatttatttaagatctgccaggaataactagcagtacacacatttacattcaacagaaatcatagatgtccacttcaaaggctttaaaacctaagaagttttttcaaacctcttttgggaaggtaacagtgtttatgaagagtgtgaagaaaatttctccaggcttaaagtgtccacaacactgatcttaaatctactctctctccaaatctctcactttgtctactcccaaagtacatatcacactcttgcaatagtgaaaagatacaatctcaaggtcagcaaggagctattaaatacagccaaatagaataatgattaaaatagtgatgacataactttttttgttaaaaggttacattaaaatatttgttatttttctttgagaatttcatgcaatgtattttggaaggcagctatgctcatcactatattaccaatgctccacattatattttgaacatattcatatccctgtcaattcttcatttcctacctaccattaaaatgatcttggtcctcccatcccttctcattcaacttttaatttcttattctttctccctctctccctccccacctccattctttctcttcctccacctcctcatttttcttcccctgttgagtctggtctgtgttgcccagttagttgcaggagtgggccctagcctggtatgcagtcaaccttccagaggtcacgtcaataaagaaaactgagtctccctcttcaaatgccagtagctcttcagatggtggtagaaaggtttcctgtccacctttccctgctttgtgctgggcttttgtctgggtggagtttgttcaggtcttgtatctgttgtggtgagttcataagttcatatgccctggtgttcctagaaccactgttccatttatgtaattgagcatgcctggctcttacattcttctgccctcttcatgaagatccttgagacttggtagagagaggggtgacattagtattccatttagggccgggcactatactgtttattctcttactgttgtctaacatgtattgttccacctcacgcaccgtttgcatactcttgatgcccaaaggaagcatttattagactcttaaccctcattctttgcttagtatttatatgcaaatcagaccaacctcagacttcctgtgacatgcacatggttaaaattagtgttcttgggaaaactcagcatgacagtctcctacaccctcagttcacccactctatccatcgcctctttgaacctctctgttctgttacagaatcctttatcagcaggttctgcttattttttttttatagatgaaagtcatcaaaccttgattttactttcaactccattgttccaaactctgtgacttttaatggaccttgagaacacaatcaggatttaaggaaagaatacactaagcaaattggagttcagtgacatagaatgaaaatattaagacatttgggaagtatatgtacttttcattaccatctgtttagacctcccttttatgaatataattttctccttcttcttgtccacccctccttgccagcaaatggtcctgtctctagttctctaagactgactgaaggtcagtatgaaattgaaatttgagaactggaagcagcttagttacatattcctttgcattgaatttcaaatttattcatttgcttgttcaactaaatggttttgtgtgttgccatgtaatgctaggtattgaatccagggctttgtggatgctaaacagattctctaccacaggactactctcccactctcctccaaaaatattttttgaagtcattatagacttacttggtacttaacttcttctagtttatcccagcttgttctgcacctatattacttgagcatttgtctgtttccctctctgtggccacacctttcatgaagaaaacttgtgttattgtacgcaatactgaagcatatgcacaggactcagtttaatagtttaggaatgtagaacgttccagcttcttgttctacaattcaaggaaaacaacactctggaatgtaagggacttttccaatctcatatatttgatcattggaaaataccaaatgaatcattaacctttagttctttctgtaggatgagtctagttgaatttgaatctttaacagatattggaagatgattgatcgacatgttaaggtgtggttttgttttgtttttggcattcagcaacccatgctgattcaggagggtttttataataaagggcagtgaggtggggcagggtaggaggcaggaacatcctccttgtgttctctcaatcccagtacaagactcagcttaggggagaggcagaactctgcaatggcacaggaaagctgaagcattaggaggtttgaggtactgaatgaggaggttctcaggatcctcaagcattgtcctcagatctctgaatacagaaaatgaataaatcatttgtttgcatcttctgactcaaaaacaaacacaaaaaagaatcaagaggtaatcaactaccatcgtgtttaattgtatttcactccaaaccagttacaaactcaggcagcttttttttctttctgtcactaaaggcacctgacatccaggacaggcttcttgtgcctgttcaggcttaagaacagtactgtcctattgtttctaaaggcctatccaagaactacagacactgaatttaatcctgtttgaaactgtgcccccatgcctggactggaaacctgagcatcgtggatgatctcactcttcctctttctaattcagcctcttctgctcattttcgaggctctagctccagcctcagagagaagggtcatagtgggaatggctcagcttttggagctaggtgatatttcctcccacctgtttttgcagactcctttgagtgtttgtctaagtattcaccaagtgtgggtcaattgaggcaagatcacttctctagtgatgcccatgactaatctgagttactgctgaattctccttgcctctttgagcagaccttctggttgctgccctttaggagctggacttctgccagtttcctttactgggatttatttccctagaatggtgaggtgtgtgattgctgatcccaggagcagggacatctcattcatcagagacacgacctccactactaagaagagagacaactccagtggaaaaactctggcgcacacctttaatcccagcactcgggaggcagaggcaggttgatcgctgtgagttcgaggccagcctggtctccagagcaagtgccaggataggttccaaagctacacagaaaacaaaacaaaacaaaacaaaacctcaaattacatcttcagacatcaagatcatgactaacacatgttcaagatttattccttaatacatttgttttaattgctatctaaagtcattaaaactacatgctttgatgggtactacctgttgtttcaagatatgtatatatcatgtgatatttaaattgtgttaaatatctttatcacctcaaatatctacaattcccttatggtaacattctttctagctgtttgaaatacatggtatattcttgatactcccctgtaaatatcacaccaaaatatttaatctttataattatgattactcaaaaatcaacttttctttatactgtcttctcccagctccacagtcttcaagctctgaaaaccacaaatatactctcaatccctacaagactgactgttgtagattctacatatgcatgagagcaagtagtcactgtttttctctgcctgacttgcttcactagtgtaatgatcaccacttctgttcatcgtatgactttatgcaattttggggactatttcccagttcttagaagaatgtcatcagcattttgacaaggattgcccttaatctgtatatcaatttgaataatatggatatttaaaacatacatgtctggggccagtgagatgatttgatgggtaaagattcttgccactaatcttgacttgggtttgattcaagaaatccacatggtagaaggagagaatagactctcataagttcttctctgacatccctatgcaagccatggtatatgcatgtctgcacacaacactaatacaaacaataaataaatctaattataaattttacaaaacatattcaaacttccaatccatgaacatgggatgtcttttttccttccattatcttagtgtcctcttcgatatcccacatccatggttatcattgtagagatcttttctgtctttggctaaacttattcctagataatatttccatatctgttgtacatatggttgctttcttggtttcaatttcagataatttggtatttgcatatagaaatgctgagttttgcatgttggttttatatctttgaatatgccaaacttatttgttctaattgctttttgctagtcttcagaattatgtttgccatagtttgaatgctgcccattgtccccaaatattcatataataaaggttttctcaccagggtggtactattgaagcagtaaaatctttaggaagtagagcctaatgggagttatataggtgacctgggacaagcccttgcagggcacagttgaggttgagtctttatctttctgggttttgtcccccccccccatcctgcacccctgtgatgtactagtgcagacccaaagcaactggattgaaacaatcatgaactaaaactccaaaactgagccaacacaagccttacctcttcccagtgtgtgttataacaataggatgctgactatcacagtgttcacttgatcctttcttgatccctctcacttaaagaaggctggtaattacaggctcctccccaacccataggcgtgcctccctgaagccatggagcatataataactggtatgagcaaaccccatttaagaccaccaactttgcaagcctaaaccctaatttataatgtttcattattcaaatgtggatctctggagacagatcaacagaagttccattgaacatattataggttcaatgttcttcacacttggatcagcttagaaaatgcaatggttaacctctaaacttcaggtttaaggacaggctagatcccacttgatgcataatccctcagtgccagcaacctgtttcggcaaacaggatcctgagagtgaattgggatggcaactagcagcctttaattgaaaaaatactactacatctatactactatactctgtggttggaaataggattaaatggaagataagaagcatgagagctggggtagagcctaaatcagggattgagggatccagcactgaccttgacaacaggcatcagccatatgttaatagaagggccacagattcttggtagagataagaatatctccctttttagcaagcaagaactttcctcaagcccccaggaaatggaggcccttatccaaacatttgaccttggaaaagtatttcttcttgggagcagacactatactacaatttcttagtcttattatacggtcctgttaccctcataatgctcactaaagggaaagtcctgatgtcttactcttttcccattatacgacactattctagtttctctacatttattgactgaactcttgcctttaattgtctcaggttctggatctgaggttctggatctgattataggcattttattctcaaggtcaggtgtgtccagtaaatctctaacatttctggtcttggtgtaattgggaaggcacgatggaattcctggttctctgagggggtgaagggggggggttccaaagaagtattttgtttagagaggctaccattttacacatttatatcctttaccaaagcccacacaaaatttcccaaatggaaaggcattaatattgggagtcattaaaaatgaaagtaaaaaggtcctagagaaatgtgctctacataatgttgaattgctggaactttgccaagcagcaatagtcaccatgtggtccatgccacctaaagaccttttagtttttaaaagttaatagctcacaggttccctatgtatttgatgaccacaaacaaaaaaaggagaatatgatgcaattcagtaaatatctccacgttacttagatattctttatctcatcgcttcccttttgtttgaactggtccatcatgacaacacaaagcttgctatttcacagataacaaaacccaactgggataaaagaaatattttgaattcaaataaaccaactatgcaggtaccacaaagcttagaaaacataacaataatagcactggaaaggttaagaaatatggaaatagcattgctttctttaagataattactagtgatgataataaatgttattaacaaaatttcatagtcttcttcctttcctttagactctttcattcaactgtacttgtatgtcttctttcttgggccagatattataaaatataattagggtcatgtgttctcctggaaatttgttgtagtttgaaagtttcctcagttactctacatttattgactgaactcttgcttttaattgtctcaggttctgcaggttctggatctgaattataggcattctatttccatatatatatatatatatatatatatatatatatatatatactggattctagattagtccttcctaaatctgatctgagtaaaattgggctcagagctcattgcttctcttagtgagcctgaatatacacatacagccacccatagcataagtgagcaatttagatatcctcatatgaggaagatggatgatctagttaacattttacaaggcacattgaacaaaatcaacagatattctggcctctcaactaaccctgcactggagggttttcttttcctggctttttggtgtgtctctgctctcttggtgtgctccctttgacagcagctcctacattattgagaatatggtttaaacatgtctgagtattagaccatccctattaaggcttgcattgctcatcttttttttttgttgtttgtttgtttttgttgttttttttgagacagggtttctccgcggctttttgaggctgtgctggaactaactctttgtagatcagactggtctcaaactcatagagatctgcctgcctctgcctcctgagtgctgggattaaaggcatgtgccaccactgcctggctctgccctgttcatcttaagctctatcactttagtcttctatatgagatgttctcctttcctcaatatataatcctgtgaagtaacagaaataacttttctctctgattatttctctgtcctatttattagtattgaatgtatattccttattagccataacagttgcactcattcaggtgacccaaatacagggcacagcactggtagggaatggaatggatagtgtcatcacttgcctgtggaagtttgtgagtcaacaggccctgaggacttggccagaagacaggctttgctttccagggcccacatgtttcccagctctgagaagcacattccacaacactctatatttctaatcagacggctacaaacttgttgaggtagaagtgatcacagtgatccagataattatatcttgaatttataggacacttttctgaggagctcagaatttgtccatggctctaagactccccactacctcccttccctgagtcccatcttctaaacagaagtgattataactataagtaagacattctgtgagtttatgagggctttgttagatggagttcttggaacactctccctgtaactctgggaatgatgaataagaagctggcagtgagctctggctcctgcgatggttgtaatgtagtttgctctctgcctgagtaaagtgttaagacatgcgtcaggtattgttagagatggtgttcagcaactgtcagcccccaaataattacagaccacaggcatctcagatgtgctccacaggggctgaaaccgccttccaccactgttttgttggcactgtagagcaagaatgtaaaggatggtcctaggctcacctgaggctactaattatactgtggctcttctctaccatgtacacatcaaatgttctgtattgtagactggaaattttagaggaaaagaaagaagtcaatgcagattaaggtcaccatcgacttcctcaatggctcgtgtgtgtgtgtgtgtgtgtgtgtgtgtgggggggggggagagagagagagagagagagagagagagagacagagacagagacacagagacagagacacagagagacagagggatcaacatcttaacatcttgcaacacctttaagtcaatgtagaaaaggaaaagtggtataaacatgattccagtcaaaatgatctcttcaaattgttgctaaacaatggaaggatgtccttgatggtgtcacaatgactcccactggggttatttgcatcctgtaggtcacacatatctttggtaggctgatttcaaggcatgttttacaaaataaccacacagaaaagtatacacatcaagagacttcagacttcattgacattccttaaataatgccttcattcaggaagggctggtcttcatgtgcctgagagaccatcattttaggccagcaaagctccttcttacgcagagaaaatgaaagccctttgaagattgatgcatcatctgtgggtcttcattcattttgcaagggcacaaccacgctgtttcctgctctgaagcaatttaaggagagcgagtatcagcctcgcttgagagaaatgaatcatgattcagaactctctagacttcccatatttgcccagcctccagatcattatgcccaaactctgctcctccagagaccactgggagttaatactgagtcttgaagcaaatatgaaaatatatgaagaggtcagaccttttgcccaagccatcagtgtgttttggttagcatgtaagaacattttgaaatggcatttggagtcccttggaatacttctttagacaagtatagcacacacaacattatatttccctaaagtgcatttttaacatggctcaggctcatttacaggaaaacaaagctgtccttttgtagctttctggcccaggcccctaatgagactttgctttgctaatctccaactcctgtaagtggcttctttttttttttttttttttttttttttttttttttttttttttcccttgcatttgggcttacagctgtgtggctttggcactgagattctttctttaagctttgtttaaaggcaatccatttgatcaaagagttctaccctctgacttcatcttttatcattccccagtcagacctgggctatgggtagaatcctgccgttattttatttaacataaaaaatgatttcattttcctgccagaagcaggtcttactgatcatttcgcttgccacctagcagcctggagaatcatagcttttacataacttgcagtagtgggaaatggcagatcatcctaattaagaaaaaaaaaaaaaacacggacagggagaaagactacaacatagaacaggaagaatagcaactctggtgaagtcattattcccatagtcctagagactgagaaattgtcaaggccgcaggaagtgctttcaagggcagactctatgcagctcagtgcatttggtcttccacctctctttcttcacttcaagtgaggatttcaatttaatccagtgccacaataccagcagctcagaagaaaacattgtgaattcagaacagaaaaatcatctaactattgcagtcaccacatttgggttcaggaggtctgaatatatttccccctaggcattctttcttcttttttcccaacttcaaaccgtcagtcagtatcttctatttgaaaactcaagagttgatagaagagagggcaatgcctgtgtaccatggctgctttagatgatacctcacgtgttaacttgggttcccaactgttacccaattgttggaatgccttgattatagccccgagccatggaaataagcatcatacagggtactgtggcatgagtgctaactcagaatgtagacatctagaaaatacaagattagcagcaaactgtagccggttttatatatgtgctgcctataattgatatcatgtgttctatgaacaggctttgacaaaaggaaccactaagcaagtctctggaaccatagacacaactttggcatcagatgaacatacacgtgtaaacacattaagaaatagcactggcaggtgggtatttcatgatactcacaagctcagtggcttccaattgtagtgagcagatgaacagcccacatctaaaagcaactgtggacaaacttctggccaaagaatatcaagaatctcccatcctgaaatgttacagaaatattctttagcatgaaatactacctgtagtattgttatggcatttaaaggatttacctgaaaggaaggaaggaaggatactactgttctttcaaccaaacaaagggaagatatgactttctgttttggctagaaagaaactagaaaaataatttcaatgtagtaggtgttgcttatcaaccccccccccccccccgtgtgtgtgtgtgtgtgtgtgtgtgtgtgtgtgtgtgtcacatttattgtcactagagtaaagatattataaccttttagaattagatacgaagaaaatgatgaaacacattcatactcatggttttttattcctattctatttgccatttctttactaagtactttaaatgtttaaactcatataaaactgcccagaaaaggtgactattttgtcctaattttagaaatcaagaaattggaatgtgcaatgctggaattatttttccaagtcaacacagcaaaactagaaggacaagattaatacgcaatcccttctacaagctctaataaccaagtggctcagctatgataagctttactggctagaaatcttagcagttgtaacttgcaggtcatgtgaaatagggtgagccaatgaatcaccactagctattgcaatacccccaagctgacagtattcaccagggaaataaccacatttacagaatgaaatctagtatcaggtgtttggagtctcgtcctggtgtactggaggaagtgctatgttcattcatgcctatattatacaatacataagaggtttgaccatgcaactttcctgaacttataatcaagaaactttatagaaatgtgaacactgcttttcatatgaataaataaattcttagatcgttttcctttgtaattgagctcctgtttaattaaaagtatacctagctatcatttttgtcaaaattgtttccaatttagaaagagagatccctgaagttattgtcaaccaagatcacatggttttaggttttgatagtgattgacctagaaaaatcataaggtatcttaatataaatcacagacaaaagatatattgtataaaagaggaggcttgcatctccattaataaggatagaagaggctgtggagcataaaatatgaataaacatgcagcattgccacatattttgtgtcacataaccactggtatttcatttaaaaaaaaatgaaactaaaaggtggacaaaagatcctgtgaaaaagttttgaaaacattctcatattgtccccaaaagccctttccaagtaacttaattaaacatatttttttattgtacaatttaaagcctatggcacttctttactgggtatatgaggggtccggctcttggaggacatcccaaatatcagtgtgtacccttgtatttcccagtgtcctctacagtatcagaccattttgctataaccagatataaacctctttcttgccaagctcctatcttagtcattttccaagcccagactccccagcctgtgcatctggaagtgcaagtctctgaaatagtaaagtcaaccaataggagagcttctgctccatcagtgcctgctgagagcacaagtggaggctgtggttgttgtgtgaaaggatacatgtataaacactagctaatggtgccatctggggagcttgtgggatatttagtgaggagggcctagttggaggaagtggatcactgtgggctgggtcatgagctttagactccaccctcctcatcacctgggttttctctgacttttggtggatgacagatggaaagagcagtggctccacgcttctgtcatcattgatacaactccccactgccaaggttctctgtcctgaaagactatagcttgaactgtcagccaaaataaattgtctctccctgaagttgcatttgtatggaaagtatttggtcacagtgatgacaaaagtagctaatacagcctcttgactatgacactctgtaatttctgatggatgagaatgaacctgggttaaccaaaaagaattgttccaaaggctgtcagccttattttatgacttttgatttactaagtatttataaagttcctgtaaagatggataacataatgaacaaaggacacactcaataccctctttacatgaatttgacctggagcctatgaagtactctgtttacctgttagcacaagaagatagtcaaacaagtgtttcacaatatgcctatgttgttatatatccattattatactacatatgcactcatatgtatatatttatcatatatctcatgtaaacacactcttattggggtccgtacattagcctactgaatatatagagtatggattttataatgactacttcctaggtaccgtatatggaaaaagtccaatcagagaaacacaaatcaaaactcccttgagattccacctcacccaagtcttaatggtagtcattgagaaaataaataacaaaaaggatgacagggagtggataaaggtgagcccttacacagtgctaatgagaatgaaaacaggttaaaccactttggaaatcagcacgcagctttctcataaaactaaaaatagatctatgaggtgacaaagctgcaaaagtctttggtatttacccaaaagacttcaagtcaatatatcacactagtgcaataaaattatgtagccagccattgtatctaacaacagaggaaaggataaagaaaatgtagtgcacaacagagtgttttccacttgttaccaatgtaaacttacatcacgtgcaggaaatgcacgcaactagtaacaagcatactaagtgaattaagccagtctcagaaaagaaaatatcgtttgtgttttctcaaagcaaatattgcatgtgtggttcctagatgtttaatcaatacataaagtaagatctgtatatgtgatatgaaaatagaagagaacctatctagaggaccaaaaaagtctaatgggaataagaagagaagtgggggtatgagaaagatatgcttgtgtgtagtatatacctgcatgaaagtgtcctcatgtagcacaggatcaagtagcatgaaaatgcacaataaaattgtcaaaataaaagtcaagaaaaagaatgctgtgagacacgaaacttgagttaatcatttggtgttcacagcagattcctagcggtgtttcttctccttgggggaacagaacagaagattcagtcatgtagaatcatgggctgacaggcctacagagttagcttaatttagccttttatattgaaagcatagacctatagaattccagtttgacacccaacatgatggcctctgcacattattattaagcaagcatgagattttcccaagatagaaagctattatactgatttattgatcttccagaagcccctccatactcaactgaattagatagccaaagaaatcctcccaacaatggtgggtttcgaatcaaatcccaggacgtgagggtcacaacaatgattggcatgagaagttagatgaaatactacatgacaaacatagttgaaatcagctatatacctatagaaagaagagaattgaaccagttatagtggtgtgcccttgtcatcctaggtttcaggagagtgggatgtcagggtcaaggccagcctgggatacatagaaggcccaatcaaacaacaacaacaaagcaaaaaaaagacagagagaaagggaggaggagagaatgaagaagaggagaggcaaagaagattagaaggagggagagagaaagggagaggagataggaagcaagcaaacaaaaggaatagcattccaaggctggcatattaatgttcaacctggtacatatctagtaagattgatacaaaagaggattatgaattcagaggcaaggtctagcctagcactgagctgatccaggattccaggtctgggtaacatttaaatttcacatgccacgtttggtttacctttcagatacaaatatcttcctgaaaacccacccccagggccatacctcctcctgcaaagcctaacctcctccaacaaggacacacctcccaatcctttcctgacagctcttcaactggagactaagcatgcaagtatatgaacctgggggccagtctcactcagaccactgcacagattaaggccctttctctgtgagagaagacagaaagttggagctctcatgataattgcaagatactatcctaacagatcccaaagttgtcatctattaagaaacagcaagatctaaagaagagggtagcaccaggtatttcccaagctcaagtgtgaagctgtgtagccgactgacaatttctgccaagtatgatcaccttcattcagctggatttgcccttggcctcctgcaggggcaagacctcctcccccatcacatgttagtatttgtctattcagtcgatgaaatggattagtccatggttggaatctgcttcttggtaaaatattccagcaaaagagttgttttactgcactttcccctcccaaccaagtccagagaatgcaacccagcttcctagactccagcctgctgcccggagtcctttaccacccaatgcttggttgctatcaggcagactgttctgtggcgcacagctggggtccactttctatctgctaagaccatttaagcgtgttctgctccattgctcagcattaaaagagtctgtaggcaaatcatttttgtcacaaatgtacaacctagctcaggttgagacattcttgagcagcttgagctctggacacatacaggcacctgaacaagttaagtgactttatcacaaggttagttaccacattttcactgttgtctagactttttataaatagataattatagatagatagatagatagatagatagatagatagatagatagatacacaattttttcttgttgcattatctgtccacatgtggcttagatactaatgacggtgttgaacatataatcatatcaaacataacatcaccttacaatgaattccaaacagagagtcttgcttctttttctttttttttccgtatttcagttttagtttcttgaaattattctagctccaaagattgtgctcctatgcaaactaaggaacaggctgatgttaagtggcctgtgctgccatctgagcccatggtgatccatgatgcccccaagggtaatttctgaggctgttggcatgctgtagtcaggatctgtgctggtgtccgtagcctgtgttgccagcaaaggccatgtggatgtccatggtctaggctccaaagtcatgttgatgtgagtggcctgtgctgccttccatctgaggccaagttgatgtccatgattcaggctgcctcccagggccttgcctgcatctgtggccctactgcagcagagggctttgttcatggtctgtggtatcaccacaattcttgtggaagcccatggtctgtgctcctgctgactcctactgacttgctgcaaaaataacaaggaggctacttttgcagtgataccaacgattgaagatgcacagttgagaaagagggacatggaaggcttctatgacaacccctaaccccacctcaccccaccccactctaaaaaacaaacaacctaaagaaatccatcaaaaagaactcttaaaaaatgtgctaaggatgctgaatttggctctccacaattgatggcttctggccaggatgcgactcagtcctatttaaggggcagggccgctttgaatttgaccatgctccattgagtatataggtaacacaaattggacttattttttgttttgttttcttctttatttatttggttttaatttggagagggcaggaagtcacaagggtggggacatacatggaaggactgggaaatgagtgtgagtacctggtatgaaattcccaaagattcaataaaaatattctttaagaagcatactcacatgtagagatatcttcccatatatacagcacagaaacacttcaaactattccagcattcttagagtcagtgaatagcagctgtattgaagaaaatgctgggagaagcccaagccaggaccgagagttctaaagacacccatagtttcattattcaagaaaggggaacatttgatttcagtcaagtaataaaaacaggaaatcaagcattggttaaactagccaaagaacatagcctacatatcccttcctcattacatttaaaatatttagaaaccagagacctcaatttgaagcatgaagagatggtttaccattgaaatgttggttatctacatgttgctgtttgcatcacccctccagtggaccttagctatgaaaaagggataactttaatttgaaagaacttagaattttacctgcaacagaactagataaatccacccagagtctaagatcccagtggataacttttgatgctcgtgttctacatatggatgaggggaagatagttcagattgacgtgcgcaagttcctggtttgggtaattctctctggctttatttaattatcctgtgacatttatttaaaattagttagaaaggtcaatgggagctgagagctcagttagtaaaatgtttgctatacaagactgaggatttgagttcaatctccagcacccatcataaaagctgagcatggttatgtggatatggaaatccagcactggagagtgcaggaaggaggattcctggggctcactggccagttaaacatctggtttggcaagattaaggtcccatgggagacctggtctcacaaaacaagctggatggctcctgaagaatgaatggtacctgtggttgacctctggtctcctcatgtacaagaacaaagaacacacacacacacacacacacacacacacacacacaagtaaataaataaacagtggaaaaatcagtggactgttggaatttccttctatttttcacctagttccacagtacagtgttaaaacattatgggaggacaaacagttcccccacatgccagagctttgtgtcttagaaacaaacacaatgactttcaaatgctgaatgagaggcaggaatgtggtcccttgagcagcagaatctcatcaacttggggaagtaagtgaacatttgtaaggttcaacagcaaacaaaacaaaataaaaacaaacaacaaaaaaactgatactggttgttctgactaagatcacaattcctgtcatgaaggccaggcagccattgaccctgagaatgaaaacaggaatctctcctggtatttcagtgggcaacagagagggactaactgccaagactttcaacatgagcaactgctgggatgtaatgcagttgtcacaatgaaggatgataggaacctgagctaagacatggcaaaggatgccagaaaaggatgctcaggagatttgtaatgtattaacagagcttggtgacaaattggatgcttacacctgtcgagtaagagctttatcctgcaacctgtagtaggcagactgaaagtccctcaaagactgcattctaatcttagaaactaaacggaaaggtacaccagaaatggcgtaccataaagtaatagagaaatagagtaccttggcttatgcagatgagtttgatgggatcacaagggctcttcagatgtgaaaggtagattcagaagagccagggttttgagagccttgatagacactgctgctttgaaagtgaagagagctgggaacatgagagagttgggcagcactggaagccagagaggctatgaaaattctttttggaaagaaaggcagcccctgctgggaacatgttgatctgggtggcctgtgctgccacctgaggctagagagacatctggacccttggacacagcctagggctttgtctgggtccatggctttgcagtggcaggggtctggggtgatacccatgactcctgttaccaccgagggctctactgatgcccagggtctagtcagccacctgagagcctgctggtatctgagggccatgttccccctaggaccatactgacctgagtggcctgtgctcccacaggggccatggtgatgtccatacctgagctgctactgagggttacgtttgggtccgtggccctgctgcagatggggtgtgtgatgatgtctgtggtccatgttagcagggtgtcattggaaccatgctgtgctgagccagccccacccttcactggcactggaatagctggccctgcccctcactggatactgcagcatgagaactggacctcccccttaggtccacctttccccacccctgcactcaagagggatggctccactcacccttcactacaggaatgcacctcacctgggcagcacactagagctgaccctgttgtcaggggcacagatgagccagccctgagggcataagagcaggagagttaaccctagccccacttgtatgtcccttacagcaataggaagagagggccctgcatctcacctgagtaaaacagtggtgtgagtgtgggtaaatgggctatgaggacctgagagcaggggaatggccctgatccttgctacagcctgcactgggtgagctagccaaggcagtgttgcagagttcactttcttagtgacgatgagggaaagctggcaggctgagcaactcagctaccatacaggcccagaacaagggttatgagttgtcccacctcaacatcacctcatctatgaactgttagagcacacgaagtggatgaacctatagatccaaaactgcaggatctccacaagacaggatacccaacaggagccccagtaagagcccatgatcatcgtgtagcagaatccagatgcctgagccagaccaatgaccccaatggcaatgaacacttgcaaataaagatgaatggactcaacagaccgcactggagcctccatgatgagattcttctttttgttgtgtcgttattggtttttgtttttatgttttcattagtttgttttgcttgtttgttatgtttggtctttggcttttcttttaaattttgttttgttttgggtggggaggttgcaagggaagagggaggatgtgagggggtaagggaatgagtgggatcagaacggatgatgtcaaatccacaaagaatcaataaaaatttcaagaagaaaaatgaaaagagaagaaaggtagctctgcacgtatctttgtgttaccccacaagacacatgtccacaattgtaggatgttatctgaagccaggaactttgtggaattttgatccagaatttcatggcttaaaaggaatacatttaccatttgtgctttggtaacagaaccatggtctctcagattagtttacattgttatcacttttatctttcatatgctttatatccttctttgcatgctttatagctcagtgtttatagtttatttagaatccaacttttagatagtaagcacaagctggctagaccatacctactactgtgttactctagtactctaaactattaggtgtatttcctgtgaacagggtagcccatcaaattacttccatagaaactagaaggcaaagagcattttgtgatgcagtctccttctcctttgcttatctactcatcagtcaactaacgtagtttgcaagcaataaataatttagtaacaaaatttaggcagctttctgtcacaagatatatttattttgctgttgaattaattaatgtttgggaaatgccatgtaaatgttagctcttatcctttccttatttatagtaagtaaataactttcaatttaattccctacactaagaaatgctgtgaagtgtaagttctaaagttctaatgatggaagaaatattgcttgccctcgtggctttctctgtaacctacatataatattcagaacttgaaatgatggagataatatcttcagacctagcttggcccaacagtcatgaaacatagatgtgaaggattttggctcagagccttaaaaatgaatggagctttctacagtgtctatatagctttccaatgagggaagtgatagagatgagaaggtaagacattgttctcattgtaccctgagggcaattaaaagttgtatgtgtttacttaaggacccaaattgcatttgaaaatagattttaaaaagagactattttaattctgctttaaggtctcaaggagtctaacgcagtgttcatagaagggctcttccttgaatgatggataacaactggaagaatgttttatgttcagtaccaggtgtttttaaaggtcaacagaagacagtggcctgccaaaagataaggatcctatcgtcctttgcaggcatagaagtgctgggaatattattttcttacctaaagtggcaggcagccaaccaggtgagtcagcaaagaatccgatctctaggttagtcctaggtattatgctactatccaaaggacaaaagaccttcaagtggatcaataacaggtgcatgagtcttgtgtgtggaattgaagctgatttccaggcacaaaatcagcaggagacacccttccttagaatccagggctgtctagtctatgcgattaagctacagagaaacaaaagccaatataaaaatgacactgagtgctgtcatttggttaatgttgaggtaccatagtttcaaattacagacaaaataataaccattcaaaatattcaaaaactgtctggatttctgtgagttaggctatataccataaatctcaaagtgcagggtaattgcatcactgtggcaagtctgtttgcagtgtaaccctgtatttgagcttctctggagggcgaaggtgtaatctgccacagctgtgtaattgagaaggctctgatgcacagagccatacaagtaatttgcaactagcagggctcagggtattttctctcagaatgcaagggtagggttctgggttatagttgtatttctccctcacaaatgcttacaaaagcttcttgtggtgacagaagcagttctaaaataggcagtgcaagtatatttcacctcaactatgtaatttcaaaacaacttttaaatgccataagaaaaatcccacctgagcccaggtacacggtgtatctttcccaggaatgttgactgtaaatgagttttgagtaagtaaatatcctgaaatccttcaaatacatgtccctattaacttcctcctactaaatactgaaaccaagtaactcatggtatgttcaagggaagtttatgcctgtatatacatagatgtttccacttatcatccaagctcagttgtaacagcagattcacagcaacttccactgcctttgttctatgaaggactttctatttcattaatccgagagtagctgtgctgtttctaagcctttctgcatgaatttctaccatgcattgtcaagatggtttgatttctgccttctctcttagagttacatttacaaagagcaagctgtaggccatacatagacataacctaatcacaatatcattcaatagttatgtcccaaatccttctttcatctgtgagaacctggctgaaaaaagggccacggggtctccagtaactactaatgagctcctgcctccctatgggccctttcaaagccccacatcatctgtgtaagttggacaaggaagactctcgattcacacaaatgtaccttgggctgttcttggagtcactagctgagagtgaagctcatttcaaaaactgactcaaactcaggacttacctggaaagacagcttttcccagaacatggtttgcagaggacagtcaagtcaagaggacataaaaggagagaactggcaagccgacttcacctcagctgggatcagtcagcaaggaggagtgtcacagagggcagcatgctaccagttctcctttgtctcctactaaataaatttacccttattgttccacagcatatggtataattattagtagccctgtcatgaatatattagaattaactcttacagatccagtttgtgcatttttctgacagagatgaactctgaaggagggccataatcatttttgcctgactgaattagtagtccagcacactgacctctgggcatgacatgacaattgcctcttgaactctcagtaactgtgagtagcccccaggagacctgtataggactgaggcctggcccaccaatgtgtctgtcccagaaaggaacaggatctcacactgtcccacccctctttgaggatatgtagacaattactaggttgctaagagagagaacaacttgtcctcagtgatgcagccactggtaaattgaccatgttcctgtcaataacccctcatccctgtggctatgaatgagctcactgagcagttcactaagttagacgtgagtggagtcatttctttggtctgtgcttgctgctctgatctggggtgaatagatggctagttcatgctttcagaaacaaatgtgcatgcaacacatagtacttcacagacagtgaatgtcaaagaagaattgattaatttgtcttttcaaaaactgtcccacagatatctagtgtctactaaaagggaggtcaggcccctggaattggtacaggacatactcagataccaaattcttgaccacaaggagatttattaccccagagggacaaatgaggtggggagaggctgcaaaggttgcagcagcagcaagcacaagaagcaagaacagcaagagatgcaggagtggacttttatggataaaaaaaggggagtttgtgctaggggagtctgtgctaggggagtcttgctagagggagttggtaaatcctgatgggacatattagccaaataatgaattttgattgtaggaccttggtgttttgtatgaggaatgagtcactggccagataagggaatagaccttgggggctggctttaggaatgtaatgttttttagcaagggagaggaaaaggggtaaaagggcaaaacctgtctgcaatgcttgccatgctcaggcctgttagagccctttcatctataccttccctagaaggagtattttccaaatttcatgaaattgaatgaagaaacatgaaataaatacttaaggtaataatgatacacagatagagtgtcacaagactgattgaagcatgaattaatccttctttgtttaccaatgactcattaaatagatgagagtgagcgtaaagacacctgtttggacttaggggtatttaagaacgtgaaagtccccactagcctgagacaatttactgcagattgtgggcaatgtgaaataagggaaaacattatcaatctcactcaagagttcattgcagatattcaataaatgttaagtgactgactagtaaatggagattggggaactcactgaaaataaaggctgaattaacaatgaaaataaattctgactaacccagggaatgtacccctgctattaaattctgtgcaaacacagaggtgcccagatgttaattattttttgtttgttttgttttgttttgtttttgctttcacagattgcttctatttcagtgggcagatccagaagcagggcagaagtgcagagtgtgccatgtgggactcagaattcttggcatttttcttcagattcataaaacagaagaaccggaaagatggaagagcttggtttgcacccatcaattccccaacctctgcatggtttctcttctcttggaacacacaggcagcttatgatctcttctcctccctgaccagctgtactagggtgaggacatctgtgagacgatattgatgagaagacagacctggcatcttcaggctcactcagacaacactcttccctgactcaggggttcagagtgaaacatgcttggtcagaagcatgaaaatccccactcacaggcttcctaccatgggcagataaggtgttctctgagcatcttgcctggccactgggctgctgtctctgtccttgaggtctggtggcaatactccatcatgacaatggtacttcccatgctttcagtcagaaccagaaagatagggactacaaatatggctcatttagcaaatggctgacatttaaccacagggacttgagtttggattcctagcacccacatttacaaagctaggcatggcaaaatgcaagtgtcacactaatgcacggtggagggagacaggaggaactttggaagtcactggtcagccagtctaacagatgagtgtgcaccagttgagtgagagaccttgcttgagaaaatgatgtgaagagcaatagaagaagaagagagcagacgttgccatttggcctcaacatgtctgcacaaaatcaggggcatacacacaacacacaaatacatagaacacacacacacacacacacacacacacacacacacacgcacacacacacacacacacacaccctggaaagactaaaacaaaatgacaagcttcttgatgtgtctctttccttgtgtcttgttcagacaaggtggttacagccaaaggcaagggagaattgtggagcccagatcaagcatgccactgatgtgtaatgtgtggctattctcatcaatgttggtgcttggcttgtgcagattcccgtgtcagactatgatgtagagctcaagggatcatcataccctctacatgctctcacatgtatctacctacatgtgagagcctaccaaatgaccaaaacagctgccaatcagcaaacaaactcttacgaagaaaagccccatgaaggttttcatatcttattggagaaacctgtgagtgcagcaaccaatgtccttgaggtctctgtagtttttatgacagtgctaggccctgtaggtcagggctctggagaaactgctggccttggactctgagtgcagcattcaacgttcatgtggcttctgtgaaaattacttaacttctcagtgcctccacagctttatctataaagggagacgatgctaatgcgtctacctcacaaatatatcttgaaaaagtgtcatgcttgagagaacccacagaagcaaatgctccctaagcgttgcctgagtcaaccttggcatctgagtagactgtaagaagtaaaggtggggaaaaacagtgagtaggatctgtggtcttatgaaaaaaggaaacattttcatttagaaatgatttcaaaactgaaggacagaaaaatccttgggcacataaatgggaaagagacccaaggctgtttggtgtcaattatttgcaagaagaaaggtctctgcactaggcaatgaagttaaatgtgttttgaatgaacatttataaactcctgtgattgaatcagccaaccattaaattttaaattaagccaagccctatagaaaagataggcagctatctaagcaacaaaaatagagattagaaaccctgctaatttgattttcacatagtcccttttatgatttatataaatatctgcaaagtagatgacttaaccaaaatttcatattaaaatgggcttatattagttattccaagtaaatcaagcaagtttcccctataaaatatattttagatttcatatatgagaatataaatatttagctatttcaaaaaatagcatgtatagatatttcaaaagaaagagtaagaaaacaaggaagaaacaaacatacctcaagcaactaataatgttgttagccccaattggaatgtatttatataatgatggcatgaatgaaataaagaggtcaaattcctcatcaccgtgttaagattatgtaaagaatgattgaattttagagacattttaaataattgatcatcacctctaacttccaagttttaaaattgaggcctacagaagacagacaacttttccaaaatcataattaaaatgatttcctggtgtgtctcacagaaagatagcttttctcctgtgacgagaacaacatgaggttgcatgatggaattcgtttcctaaggctgccataacaaattaacataaactggatggcttcatacctaataaaggtataggcattgctgtcttccctctgtgagctccagaggggcatgtgtctcccatgcttccagtgtcttctggcttccggtaacagctggtattccttgatgttcacctcatatttctcaaccacactttcccatccatcaataactcctaatttcatcacttcaaacacctatgggacaataataactcagaataggtttcctcctagatccttcactgatcacatttgtcacataaggcattactcatccctttactctgtaaagcaatagtcacagaactggaggtcaggatgtggaaatatctgaaagtagaaggtagagaggtaggaagaacaacgctgagcccatcatagctttcagtagtagcaagcctatgggtgtttctgaaatagagatggctttagggtaaaaccttagagaaggattacctttttccacttgcccaataactcattctttaggtgtttgtattggcctgcctttggagttctgagagaatacaatctaggctgttgccactaagagcaccacctctgcctatttattatgttccctttaaaaagggccctgccctcctctcattgttctctctcttttttccctctctctgtttgtctgttcggttctctctctctcccatcctaccccccctctctccctttctctctcctttctcccactgtacctatcctaggaggctgctctccctgctcccctttcccttttctacgatccttttcccttaataaaaaaactcatccacttgaactcttgtctcatggtgtctttctctcatgcactgcttaaaaaaaaattaaacagtgaccacagacctcagatcaccatttttacctaggtctcagggccctactcaattttggcatttgacgtcaagttaaagaaggcaaaagggacacatccaattatgtctgcatattcctaaatctcctctaaaaagacagctaaggaacaaaacatgttcaaaaaatccatgcactatgaaagaaggtacaaaaggaaagaaatacatgaatcaaattctgagaaatgtgaagctgatggacaagaggcaactgacttaacacagcaaaaaccaccagtcagagcttaaaaagggagaagtcagtgaaatgaagacagatggggctggaaaagtgactgggcagatgagagtgctcactggtgctgctctctagaggacaggtgtttagttcccaacatgactcaggttccagagaatcagatacctctgctcacatgggcaagtgtgtgtgtttgtgcacacggacaaataaataataagtaaatatttaaaacctgtgaattcattcataccaaatacattcaagaaaagctaagaaatagatgtattattattttcaaaggcccaagtgagacatagaaaattaactatccttttcctaacacctccaaatgcaaaatttctgacaagtaaaattgtttcagaaaattttactagtttatcctaacttatttgttaggatacaaatacaaatcaaaatacaatctaaagtatgtaaggctaattataatctttattaatccttgcttagtaagaatattcatgttccatggaaggaaaaaagatcaatgtgtttaattacggcaactactgcaggtcccattaggtgatgtatcaattacatatcttattattttctaaaatctaaaaattaatctgaattctcaaatatgtctagccttgaggagtttctacaagacaccatgggactatataatgagccttttctagccccaaatccttcccttgccattctccatctcaacaagaaggggtctgctctctgggaaacggaattctaatctttgtggggtcttataccccaggctcacacatggcaccatcttgaaaaacgagacaggagagcccagttcccttactaggcttcacagataggaacaacaggcatgtatttgaattagtgaactttgtccatgtgtacaaactagagttcagtgttcagtgttctcttctatcactcccaacctgtttgtttgcttgtttgttgtttctattgttgagatagtctctcactaagtccagagcttattgtttcagctaggctggttggccaattaacttcaggaatcctgtccgaccttgcctatctcatgcctcacccctgccagttgggattatagatgtacctcttgcaatacctcgctttttacatgggcactggagatccaaacttgggttctcattcttgtgtagcttgcctgtcccctcctaagccatccctccagctcctagttctttgttttcagatttgggttggggtgtggtttggagatgagaccttgtgtcacctcatatataatactcctcctgagtgctagggttagaggtatataacactactcctgagtaaagattcattctttgccctcttgtcactgttgctctgagcctctatagtcacagtacaccatgccagagtgacaggaaaagaaaacagggtcctcaagtctcaatatccccttcaaaaatccccagtcaacagcctgacttccccaccagcctgacctctcaaaattctatcacttccaataatactacaggatgggaaccaaggaagggactttcaggacatttaagattcaaaagtgtagcagaattcttagcagaatgacacaggtttgaagattttcccctgagttaataaaaaatcaaagatctatacatttgacacttagggcttcccagaaagactgtggaaactccatctgctcaccttccacagtatctcacccaagtgtacagaactcttaaattggattgaatgagagtcaagagtcattagacatctgagaacatgaaagaataagtaaaaccattgggaaaatgaactcttggtaagagcatacccaaaactgtatttaataatcacagaaagataaaagattatatccttgagatgagaccaggaatagttttacctttaaaaatcttcagaaaataaacaacatgatctgatcatgggtataaaatatttatattgaacacaaacattagaaactaaaattgggcaaaacaatggccagaaataaagcaaaaaaccaaatgcatgataaaatgataaaaatcaatgcacacaatagtaaagcttaagactataatggacttttttaaaatcctaaagtttcccagataaaacaaatgtgccaacaacatatacataatttgtgattataataatcataatacaaactgttgcatcattgagaagtaggagatatttaaccagtctccaaaattctatgagaaattaatctctactacatttgtaattatgtattaatttaagcaataatataacatatatgtatattattgcttaaataatatatataaatagatggtacatacttaaagaaagccacataacaaggagaaaaaaaaaacatgaaatgaaaaaaaaaaaaaaacaggagactggattcaagcaaacagaagttggcatttcaaagaaaatacaactcctatgtaacagtgttattctgagcacaggtttaccgagcacctgttctgagatggagaacaatagagtgtctaaccacactgaaaaggctacaagaacaagcaaacaaaaggggtagttatcacagccagcacaaagaaagtagctgaaggaaagaaatgtggtggtcctagtcacccaggtggctcagccatgcatcatacttacacatcactcataggaatatcaaatcaaaaatggctaacacgactgcactagagcaatagagaagtatggggtgaatggagaggctgatcgttaatatgaggcaataaaatgctcattttccagattaggggcaaaagatactacctaaatttaaaactcaagaatgagctatttatgcttgatacttagaaataaggaaggagacctgggaagaaactgtgggctttgactcagagatacagcagctgctggatcagagcagaggttttatttttagttgaccaaatcaatctttatagtatagctcaaattaggtcttctctttaagagcaacagtaagtgaccaaactccctcattgggcatttacattcttcccagattatttcccagcactttctctcttactttgtagaaaactgtggagcagtagcttctgggtttggtggaagcacagtttatttttctcctccggtgttcaaatattggtcattcacagatcttttattggggtcctggttcccttgatatcctccttatcgtttttgaccttttgagtttttatttccgtttgtgtttggctttgtctgagcacttctttagtttccaccactacaatatggctcacactcttgaacatcatggggtgttagcagctcaatggcatgactgggactcttcacaactgcaccatgtttacagtgcctccctcctatcacgtgtgggctgcacagcttcctaccacagaataaccttggatttcccaaacaggaagactgatgaagtaaaggagatttcttcttccaagctgctgttttatagggatgtttaacattgccttgctaaattgggtcacatgatgagccaggcccccctcctatacccccaaatctccatgaactaattttgactaggacagaatacagtgcttctctctgtctctgtctctgtctctgtctctgtctctgtctctgtctctgtctctgtctctgtctctgtctctctctttctctgtgtgtctgtatgtgtgtctgtgtgtctgtctgtctctgtctctctcttacacacacacatacacacacacacacacacacacacacacacacacacacacatggaaatgaaagcagatgaagtcgagtgaatgtgtactgtttccattagcatgaccatgtcaaggataccaatgcatcagactcatgggaatggcaaagccttccctgggtgtgactcagggggatggcaagagcctcccctaggaacacagatgttgatggacagttgactgccatgtaaaaacagtacatgcaaaaagtaccaaccacagttcctcatcctggatgaacattttcgagagactgccacactacagagatcccctgaaaagatcagtgaagctgctgcctcctccactgtatataataaatgagcttagtgtctagactgctggtgcatctccatacaagcctgtggcctgccagatcccagctttaccttccctatgtctgtctctcttaatctcccatcattcccagtccagattaggcccagcctgccagccatggcaaactggaattcattttttattttgttttagtttgcatttttgatttgtctgagccattctttttctggcctatagtaaggttcttaatagaatttgtacacaagagaaatgaaaacagttctctctgcaggcacaaatgctgcatatgactagcgggcaatcttttccctttttcttggttttttaatgtaaaatcagtttgacagggccttggataaattgatttatcatgacatttgagagtgaattccttagtttgtgacatgtaagtggcagaaaacacaaaagcaaactgtacacctcgaaacactaaaggtatgctttaagctaaaagcttcaagaggagagccatgtgtttcaagggtttgctatactcattctaataaagattccacaaactgaaattcaccaggccaaatgttcatttttgctttgtttttggtgtgttgaattaggctaagttggactaaaatccatagttactgagccagacagcattccaggcattgctttgaaggcattctgtagattaatggaagcccctcacctgttgagcttcaattaggcagattgcctctcatcatctcagtaggcctgatctgagaggcaggaagacattaagagcaaggctgagtttcaggcagatcatagaaattttccctgtgggtagcttccactcagaagaatatactcgagtttacctctcctaacaccatccatggactttcttaaccagctctcacagtgtgaaaggtaagtctttgtgatatctcttcctcagtctcatcttctttaatacaacctttcccttttcatccccccatcaagcttgtagctacctttcattgatccactcacctaactacctatctaccttaatacttattatccatctgcctagcatctaccatctatctatatctattatctccctatatactatctgtctatcagtcatgtagcatctcactcatcttacttctctggttgaatgctgatttatgtacttaaactgcttcaaacaggaccatcttcttgtttaatattattccttcttcaccttaatatttcttttcaattctttatttcttacttttcttcattcattttgtgttgaagttgggggtaccaagtgcccaatcacggtgtgtgtgtgtgtgtgtgtgtgtgtgtgtgtgtgtgtgacaggtcagaaggacaacttgaagggatcaggtctctccttccactgtgtgagctttgggatcagccttgggtcctcgggattgataacaagcaccattatctattgacccaccttgctgactttacactaatgtgtctataattcgttttctcttaaaattattctttagaatataaataaagaataaatggttctgtgctccagtatccacaaatcacaggacacaaattctctagacggaaagttctcacaagtctggctaatacagtagagaattgagaaatggttgtgttagggagaaactaggacagagtttgaaggtgaggctatgcattcacaagatgaaaaataattcatgttgacgttttgacaaaataaatatatttcaaacatccactggtcctgggtgttttgggtcctacatgaagttgttgacacagtgggagaagtaagcaagagtccaaggctgattcagttcagctcttgtctttcaacaggggtcaaataatagtgtttgtatttgtctgaaaactaaagtttaactgccttagaagtgacaagattccaggccattttctatgacatttcttcactctttattgcacatttgaaagagaacataataaacctcagaagttattgtttcctgtggatccatctcaggcagtaatttttggaccaaaatcaaagtagctcggggttttaggtaggatatctggaactgaaagcaacaagaatgccccctatctctctcctctgttttttcactttctttcactgaataccatttgttaacctcattttctacctttgttactagcatataagttgtaggccagagactctatatgaacttcagtgtattccagaagttagtataatgtctggcacacagtaaatgctgttgaacagtacatgcattgttcctgtgtctataatacaggcataatgatagtgcccaacctcctagcttataattatagggaatagacagttttttttttttttaggaatagacattttgtatgatattctttaaattcctagtcaacatgaactctagctttccatgtgggcatcaatatttgcttcattacagattgtatatgatatagagaaatatggaacagaaataaaatatcaatcagttctggttttctgaagactttactatactgttttcaatttattgaattcattatcagggtttttgtcttgggttgtgagctattgaaggactgtttgtttcaaacaagtcccatatcaaataagaattgatgtagagccttttgctggttatcatttagtcaaatcagacagctggtcaacaaatgggatgattgttgccttccatgatgctggagatggtgaaatattaaaaatagatatgacattttctagtaattaatatcaacaagtattttggatttgtagcctgagcactcttcattgtatttggcagtctgccctcttctttgttgggtggaactgaagagaaaatagatacattttctgtaatcaaacactgaatggagctttcacaacaaactcatttgagtattcaccttgacccctcagatcaaggagcaaaaatttgccaggccacatttttcaatactctgccatggaaatgaatgatccaaagttaaataaaaagtgatcgtgtataaagtccacagagtcaaccacaggaatctcagcgctagctgtatctgagtaacaggtttatctgatatggttgttgacatccccttgttttctgcagtgatcatgcattattcatgctctgataataaaaagaataaaaaggattttgtttcttagaggtaatagaaattttacaactgcctgcagagtcttatttcattaactagagagaatgggggggtggtaaaaagcaaagaggagtttgaaacatgaaagtaggtaaacatgggtcatgcaagaaatatatagtcaagagtccagtaaacaaactccttggcagcagagttaacttaaagcatttataagcaacttctcttagcccttctgatatttttctgtaaatggcaggatatcattgttttcagaggttgccaagctgttggcaggggacaaaacacaaagtgtatttttcactcgtaatattttactttaaaacaccattgatcttaagctacctccccaattgcaaattggtggcttttcgagtaatttataggaaaacactatgaagtttatctttgaaatgaaatgaaataatacctgcacttcctactttggggaaattttatgttaaatcacccggacaggcagagatgacaaaacattgagacatatttagagatttcatttctcttcctgataacgacaaggttgattttgtgctctcagaggggaaatcatatctgatttaccatcagctgcctccatgccaccagccacatttcacattctttaaacagccacagctcggtgatgccgactaccctttactgtggggttgatcaactgccaaatgcctgacgaatcacggaacactttcactctcagctacctgtttctttatcgtgataaagcaggatgtgcagcaagaggcaaactgtcataattttattggcgaacgaagtctgatttacaccaccttgcttctcggtgcaagaactaaaagcatccgtgaaaggggcagtctatagcaagcttccacttcccttcctcttgctcttctgattagccttttccaagcagaagaatagctcactcccttccaaggcaccatctgaggaatgtttaggtcagatatttaaggaagcccaagacagcataaggaaagtaaccctgactgcccttattcaaataacccacaaattcctattctgatcatgaatctcaagcagacctacagtgtgaactgaggggaagccatagcggaacaggctgtgtatgtaaatgtccagcagaaaggaattgaaatattcaaccattttacaaagctcacaggtggaacaagatgtcgaggtggaattactgtttagaggaaagcatgtgttttttcgggtttcatctccagctgaatctagaagttatgatatatgccttaaaaataaatttaaaaaataggtatacctcctcttcactcctccccactgctgtgcatgcccaagtcaacatttcatctcatctgagttttacgctgtggaaatttcaggaaacaaatgaggacggcaaatgatgacctactatgttagtcaagacatatcagataaaggttgtggctacccactggtgtttctttgttggatagatgaaggcaggacatagaaaagtgtttgcagaaccagaatggacacgcaggaaaattctgaacttgtcgcttaaaaggaaaatggaaaatcagaatggtagatgctcgtttggatccaagtgatagttaattgcctatttccctgaactgtttgaaagagctataccaaattttctttgccttgtcatttaaaacacttaattctctttgcacttcccaaccaacttggcacttctgccatctattgaagacctagctaatttcctagtcatctgttgatcaatttagtggtgttactagacaacctctgagtttcaaacattaaaatctgactatctctccttacctttgaagcaaggtaagcagagcgaagttaatctgttcagatggccatcacctgctctgcaaaagaaaaaaaaaggaagctgtaaaaaattgtgttggcatgtctagacaaagcaaatattcactgggaagattgctgcaaggtcaggggcctgccaatttaccgttggtaagcattagaaatggatactgtaaagaaaagttgaagcgttctcatcttaaaatatgcaaaggagccttcaatggacttgacagattggccattggattcttcttaagcccttgatatttggttcattgattttcaagtattctgacatttttctttcattactataccacagcctagtgcctttccctcctaccttgagtttttcaatttctgaaccccaattcttatagcttgtgttaccatgaatatgccacaaacatgattatctacaggaaaatgtttgtctattatttatagtctccctctactttccctcccccccctcatcctggggctggtagtttcttcatcttgctgcacagtgtcactgtgaatgacaggaaataaaggacggctgaacttactcacaaaaataaagaatcctttgtggaagatgaggtaggggacagcagcaagggtgaagataaaggttatggaaagaaatgaaagagaagaggtagctgtgttgagaaggaatcttggggaaagtactgaaatattgaaaagcagttaagaagtttggctgtgggctgtgtcttacctggcttgtgtttacaagaccttgttgaattccatattcaccaatgtttctgaagctggttttgtatctgagcagtttgagtggcttttgtttgtgttcatctctctatgactttcaaagacaagatattttgatctctttcctctgtagaaaaaagaataaaactatcacagtatcacaacttctgtgtcatgtaagacccaagtcctcggctttctgctagtatgcttccttcccatgccaacctcaggcatctgaaactcaacctgcctacacctaaactcaaaatttttcatcttgtctcccaattccctctcaaaaataacagtaccatccacctactcgtatatgtcatgaatattgaaggagagcccttgtatttctcattgtgtctcaggcagtcaccatgctctagctctttactaccctcaggatctctttactccactttctcttccttaagcaccataatccccaggaactattgctaaatcttctagactttaccccctttcaatcagagtaatctttaaatgtgacagactcattagagcaactcctaccatttcttgttttggctgacaaaggatttaggcttgttttccacccattttcactatcctctcttctttcttctcttgtttgttcatgattgatccctgtttcattcctccaaagagctaagtatccccctgtacatgctgttctaagtaaaagcccagccccaactcaaccccagtttatcttacctatcgtttctcccacccactcttctgttctagactttcagttggtaagtcattctcttcagataagtgtacatccctaacactcctgtcccacccctcgcccctcccaggctgttatttctcctcattagcatctctgcttgtatagtcaacatttttttcctacagaatttattgcatttataattagataaccttttctctaattatttaatgtctgctttcatggcagactctcagttatatgatttataatgttaatgccagtattatactggtgaattgctaattatttagtgttgtatagaccctcatttctgagatggctatttctgtcatagaatcttttaaggctaagacattaaaacttaaaagttctctatgaacagtttacctgaacaaggggttgctcatggactccagactgatagttgggaaaccagcataggactgtttcagaccccctgaaggaggaggtcagtttgaagatctgggcaatctatggggccaccggtagtggatcagtatttactcctagtacacaaatggacttttggagccctctccatatggagggatactctctcagcctagacacaagggggagggtctaagccctgctccaaatgatatgacacactttgaagatcccccatgaaaggcctcaccctccctgcggagcagaaagaggttgggatagggcgtcgctgggggacaaggtgggagggagagggaactgagattgacatgtaaaacaagcttgtttctaatttaaataaaaaataaataagtaaataaataataaaagtatcatacttatatttactatttctatttctctgcttactctaggagaaagactctaagacatctaatgaaactagaaactaagattaagatgtgtatgagactaaaataaaaattctggagccatcaaaggaatagtactttccttcaaagagcatgtcagtcacttacaaggacaagatttcacatctccaagctcggcacttgcacctgtagtgaggaatataccctatccatttcaattcagactatcatcctcattgccgagcaggctcacaaatggagttcattagtgccacgtgggatggcagggttctggttccatcatcatatttgctaataaatgagctgataagtaaaattccctaaaatctctcttcatctagaatatattgtaaaatatcaaagttgaggtgatgatgtacttcacagtatttcagatgtaataaagcttaaatctctcactgcaaaatggaaagtatgtgcagtgagctatctttttaacacaaaatatttggggggctaataacccatggcacactgctcatcaacatggaccaagaaaaaagacatctttaaagtcaacgtgactctattatcaccagtacattctgtctttgcctccaagagaatccagacctgcagatatcctcacagatacctcctgtgtcttttactggaaaactactttcctcctttgatagacattatgggcattgtctaatcttttctttgatacaaatttaatgtatgttcaataaatgtttatggcatatgttgcttcagactgttgaaaactgaaatagaaggtgaatcgtcacagctttaaaactatatagcatgtttggtatgaataacttccatgcacccatatacacaaaactagcagacaactaattttaaaagtatgtgcttctgatctgggtggtggtggcacacgcctttaagcccagcactctggaggcaaaggcaggctgatcattgtgagttcaaggccagcctggtctacagagctagttccaggacatactccaaagctacagagaaacactgtctggataaacaaaagcaaaaacattggggaaaaaaatacatgcttctgatacagatcttcaggtggatattaagtgaatttcctaacaaaattaaagtcaaaacttcattaaagatgacaaattacctatacttacacctatagataacttaaaaggttgggcggaggggagtaaaaggtaacaaatggctggtgtttgggggcagtaagagaaaatattggaaaaatagggacacgttaagaaatatttcaccttaaatgcccatcccctataatgagaatgatgactatcttaaatgccatcctagagccttcaaccaatagctgatggaagtagaagcagagctccacagccaagcactgaactaaactcctggaatccagtttcagagagggaggagtgaccaacaaagaccacgctgggaaaacccgcagaaacacctgacctgagcaactgggaactcatggacccctgactgacagctggggaaccaaacataggaccaaaccaggcctcctgatcgtgggtgttgttagtcaggagcactgtgcagtctacggggcctctggcagtggaaccaggatgtgtccccagtgcacgagaggacttccgtagcccatttcccatggagggatactctcttagcctagatacacaggggagggcttaggttctgccccaaatgacttgacagattttagtgatccctcctggaaagcctcaccctccttggggagtggatgggggatgaaagggagagggaactgggattgatatgtaaaataagattgtttctgacttaaattgacttacatttgagagagagagagagagagagagagagagagagagagagagaagagagagagagagagagagagattgagagagagagaatgagagagagaggagagggagggagagagataaagagacagcgagagagggcaagagagaaatatttcacataccaaaatgagaacatgtgagcaagatcagcagggatgaagcatggctagagatttagacatatggttgattcaattggtagagtgactgcctggcatgcataaggccttggctttgggtttcatcccagcatgatataaactgcgcatggtggcacacatctgcaatcccagcactagggaggtagatgcaggaagaacagaagttcaaggatatcctcagctacagaatgagtctgaagacagcctgggttacatgagagtctgtctcaaaaaaaaaataatagtggggaatgctatacttttaagcagtgtcataaaaggtaccacaaagattcgtcgattaaggaatagacttgccaatgcaagaaaaaatttgtgatgtctaaaatgatcaaaacattgattgacttatatacactgagaataaatatcacaaaaatagatagaaaagaatactaaaaaataagaatcagtttccatgacaaatgtactgtgatcttaggggagatagatcataaagattaaaattacttcaatataaccatatttaaaattggaaataattgcaatttaatactacacaaaaagtggaggaggtagaaggctcaatgattaagagtgcttactgctcttatagagaacccaggtttgcttccctcagagaggtcacaactcctgtaactcctgccgcatgggctccaacaggctcttctggcctccataggcccctgcatgaatgaggtgagcctaaatacacttaggcacacatctacacacattgaataaataaacaaataaataaatgtttctaaaaactgaaggaacctgtccactgccaaaatgtttgaggtgagatgtctccagtaatccatgcactccaaatcctctgtaaggttcaggagtcatttctattttatttctaccagaagtgagaacacttcctatgatgctagtaatcccttcctctgttgacttgatatttacccttctgtagcttagacgtagctgacatctaaaaggtccatgttttcttttctgaaaacacattggacaaaaatctgttcagaaccctttcatgtgatgattgttcaaaaactctgagagtcattgcatcattgtattgtagattttaaataatctactatttacagcatacaaaactcattaacataattaataaatgcctgtgttattaatgataatttctaaggcatcacaaatatctgccaacagatttactgatgctatttcagtttacagttagatttatggcttcctcttgttttaaaaaaatacagacaactttctttccctgagagctaagaatatgaaaactctattctaaatcaaaatgtcctgagtttaatgaaaaccaggaacagaaagtctaagggcctgtggtcgggctcctaacttgaaagaataaattaaaaagcatcaaattcaattttcccaaagattgtgattttctatttgtatgtgctacaaatttggcaggctatacagatttggaaaaattattattatttttccaatacttccaaaaatgtatttgcttctaaaccttagggtgcattcaggtaaaagaaaaaaatctatttacgtatccattatctctgggtagaggctgagtttgatgaacgctccatacaactaacaaatgtttgcctgcccagatggcttttgctctagcgttatgcctcagaaaataaattattattattatttatgctcatcataaaccatgtctgcataacaagtttctcacaggagttgaaactagtttttgctgattctacaacacatctcatttgtaaatgtcagaaaactgtacctttgttgttctgagtgttagatgcatggaagcaaaagtgagtgttcagtgtgtccatgcgtagagacactcatgaatcaacactctgaaatatgaaaagccatccagtgtcagctgtgcttataaaataaaactattagaaactttaaaactaccaagtactgtatgtacctgctgcaagaccaagatttcttgatgtggaaggaagagtctatccccaaagataagatttcaaaataagaaacaactttgaactcttatagtagacaatataatggcttgtttaggaaaagcagttgctaaattatagtagaagaaataaagagagttctgttttatcccccactctgaatccaacccaaagctagttatttatcccacctgtaaagtgaaataaaactgcacactacaatactgtcccagaaggataggtggggattaatctcctggaagtgtctggagtttcacaaatgttgtggtgatatacaaattgtggtaccttcattttgcttttataacacattcatgggcctaacacactggagggtaccttaactgcccaggcagttcatcaacacacactcagcacccctcttcagcatctcctgaggattagctgaaaaccaagctaaaattactgtttagtgactgcacattaaatcacacaaggttgagatatccaaggtctcaatttacttttgtaatacaaaattaaccttgtaggtgcaaaattacagtattattttataattatagctgtggtccctatatttatgagatattacaaaacacctgaccttcccaatacaggctagctaattattttgtatccaactagaacaagttcattaaacttgaatctcagtgaaactgtggctaacgcttcatcttaacaggttccattgtcattgttcctggagtattaattaaatttagtattcaagcatgaatttaaaatctaaaggacctagccaagtacaccagtgactatttgttgtttatggcatcagatatacaatgtaaaaggactataaataacttgatatttatctgcgtgttgtcatttttatctcctttactagaacaaaagctacttcagggaggcaaaattcagggcttatttgtaatatatgtgtttctaaatatagctccaaagaaaaacctttgtaaatgggaaacaaaatatttgttgacttgaacaatagtaggttgaaatgaaagatgcagattttccagtcagttgtattagtgagtaaaggctgtcagacatcagtcatattcttataatatgcatttcaaccaattataagcctaagacctaaagttctgtacaatgaaactattacttgccttttagcttcacagtcacttctgaaggagtataccatagtgttcaagcatgtgatgttgtacaatcaaaaatccaatctcattagaatgcatagaggtgaggtgtagaaatccttcttaattacagaaggttgaggataatatagaaatcatcctttcttactcttgaatttcaaatatgcataatgataagaaacacttcaatgttcacatgtaaaaaattaactaaattaaaactgattgttgaaatttattttgtaagtataaagctaagaaaactattcttgacctttgtaatgccctttttgtgatttttttcaacctgaaacttcatataatctacttctttttttactatataaaaatgcaagaaccatttgcttgccagtctttctgtgagtagaactcatagcaagtctgtgttattaatatgaaagttttaatttaagaattttaatatacatcacagaaatccttttgataaaataggaaaattcaaggctcacttattaagacatggctatgaaattaacttcacttattctgaaagaatttccatcttaaccatatatattccatattctttcataaggttgatgcaggaccaatttgatattactcaagtgtgcttcaatgcaagtttaatttccactaagaatagtagaatggtatgtttcatttctgctaagaatggaaaaatatgagacagtggtagaaatgcaaatgaaatataaaagttgaactcgaagagcttaaaagtaaacttacagaaactgtactcagactcacgacatgattaagaattattaacaataacaagtcaacacatacatactatagaacacagactattcatggattgtgcaagtccttcagatcaaaagccctaatagctaatgctggagactgtttcatggtcatcagtgcccacacataggcttagtgggtcacagtcgattaagaccagcttcatttcatgttctctgtaaagacaatgatataggcataatatctacattgaaatagtggatgggtaaggacaagaagatgaccaaagatcaggttgtaagagttgtcccatgtcacatcaccattgatcctctgataactcatatattgaacccttgtattgaggagctttatatcatgatgacaaaataaacaaagaagaaaagaataattttggttcactgtctgagtttccagttcagtttcacttagcactgttgctttgggcctgtaggaggctcactgtatgtaggaacatgtgatataggaggtttgttccctcagggcagatagttagcccaatagaggcgaaggtcccaaagtcttaatactcagttccagaacactccaccagtagtctaacttctactgacttttaggctctgactcttaaagttctcagtccctatcagtagcaccattagaagaataaacctacaatacactggcttgttgtgcatttattcaaaccatggtgcccccctttgtttaacattattcagtttacctcagagtaataaaagcatattaaatatcaacaggaaaatcagtaactataagaactctttacttgaaagatcaaatggtaggacaactgattttctagtctctcttcctgcctcaagacaaaaacacatcttcctatcattttattcacagtaaataccaaagtgatcttgagttattattgtgatcagataatttaaacaaacaataaaaaaaacaggcaacagacttgttgtctttgtgaaagttcaactgcttgggaagaattggttgtgcttttctctctgccttccaattctgatgctcagtataaatttattgacttcactttgcgacaacttggtcctggatgaagcacctttcaagagtggaaaacaacaacaaaatcaaagactgaaaccagtgctaaatataaaaaccaaggaaagtcaaaagtgagaaaagggtaccaagcagacaagatccaaccattattagaaccatctgaaacacagaatttcttctagaaagaacttaaagtgaaaactcttttttttcaattatcaaatcattccatttctctgatagtgtttgtgctatatctgtttattttcattagttaagatttcattgccatgataacatacctgacaagaagccctctaatggaggaaaggcttattttgactctcagatagtaaatagcccatcatgccagaaaaggcatggcagcgagatcatgacataggtagccacaccatttccacagctgagaggcaaaaagagagaagaagtgaagttggctggaaagcttcaaggccctccagacccagtgacccactttctccaacaaggctccacctcctgctgtttccacagccttcacaaaccaccagcatctgggagtcaaatgtccaaaaacatgagctcctgggggacatctcacattcaaaccacaacactactgaaacaatatgtcaaaggaccttaagtgttattgtctaattgactccagtaataaatggaggcaagctcagggcatggatcccccacactttacttatgttttgctttagagtccttcaaagacttgataagcctactcttgcaggagcccacctcacaggtacgttttagctcttagggaaagctgcctatgtactttttcaacatttgtttatattattttatgtgtatgagtgtttgcctgcatgtatgtacacataccacttatgtgccttgtgcctttagaggccagaagagatcttgtgatgcccatagaactggattacagatggttgtaagacatcatgcaagtgttcagaaccaaaccagggttctctaccagagtaccaatggctctcaaccacagagtcaactctccagctctgagatttttgtttataaataatgcaaagttggtatctattattcatccttaataaatttaataaatgctgggctgagggaagtagacaaaggagattgttaatgacttaaatatcttaagtcagatgtaactatacctttagtatctttaagcccttgggaagcagaggcaggtgaatctctgaggtgctattttgtttatgatctaataaagcttacctggagatcacagtacaaagctagccacagtcatagaggccaggcagtgttggcacacacctttaattccagcactcaggagacagaggcagatggaactctatgagttcaaggccactctgggctacatgagagtgtatcagtctaaaagagtaacagagttcatacctttaataccagcacttgggatgacatgcccttaatcctagaactagggaggtgaagacatttcctggattgtcagatcgcgtcatccttgtaggtctctggagatctccctagttccagatctcttctcagacctatagtggctccctctgatatggtatctctcatcctgctctctctcctctattcttcccccaactcaatatttctgctcctccatttcctctcctctactcctcttctcttgctcttgtggcagctccctctcccctaccctcatgctaccgattagctcaggagttcatgccacttcccattcctggggaccatttatcccttagagtccttcatgtttcctagttctttggtgaagaggagtatagactggtaatcctttgctctatgtctaaaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacactccagaacctttatcatgaaggggtgttgaattttgtcaaaggttttctcagcatctagtgagatgatcatgtggtttttctttctcagtttatttatatgatggattccagtgatggatattcatatgttgaaccatccttgcatccctgggatgaagcctacttgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtcatatctttgtgtggcttgggtatcaaagtgattgtagcctcgtagaaagagtttggcaatatcccatctgcttctattgtgaggaacagtttgaggagtgctggaattagttgttgtttgaatttctggtagaattctgcaatgaagccatttggccctgggcttttttggttgggaggcttttgatgactgcttctatttcattaagggttatagattgatttaaactgtttatctgttcttgatttaattttggtaagtgatatttatccagaaagatttcttttacaaatgtgtccatttcctttagattttccaattttgtggagtacaggttttcaaagtatgacttgaagattctctggatttcctcagtgtccgttgttatatcccccttttcatttctgattttgttaattagcatgctctctctgtcttttagttagttttgctagaggtttgtctaacttgtttatcttctcaaagaaccaactctttgtttcattgcttctttgtactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagctttaatgcatggtggtctgataagatacagggggttatttcaatacttttgtacctgtggaggtttgctttgctgccaactatgtggtcaatttttgagaaggttccatgtggcgctgagaagaaggtatattcttttgtgtttggatggaatgttctatagatatctgttaaatacagttgggtcataacttctgtcagatcctttgtttcttcctgtctagtggtgtaagcggggtgttgaagtctcctactctaagtgtgtgtggttttatgtgtggtttgagcttcagttatgtttcttttacaaatgggggtgccttcatatttgggacaaagatgttcaggattgagacttcataaagatagacttttcctgtgatgagtatgaaatgcccttcttcatctcttctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagttttcttctatgattttgttgaatatgttttctgtacctttgagcagtgtttctttaccttctccaacacatattattcttaggtttggtctttgcaggtgtcccatatttcctggatattttgtgttagggatttgttggacttgaggttttctttggttgatgaatgtatatcctctagcgagtcttcattcaatagctgacattctctcttccatctcttgaattctgttggttatactcacatctgtagttcctgatcatttagccagcttttctatttctagcattccctcagattgtgctttctttattgtctctatttcagtttttaagtcttgaactgtttccttgagagatttgttgatatcttgtattttttgttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggattttcttgtttcctctttaaaggtctctatcatcttgctgagataatttttgaggtccatctcatcttcatgctctgtgttgggcttttcagatcttgctggagtggagtccctagattctggtggtgtcatattggtctttctgttgttgagtgaactcttattctgtcttcttcccatatcttcttttagtgggtgcaggtggggtctctctatctcctcttgtgacccagtagtgtgtgggagccaggaattcaatgtccacaactgtggatggtcttgcctctcctggtagtctcctcactcgttgtggatcggttgggggaaagaagtgggagaggggggtgtttccagattcagggagctcctccttgtctgtgcgtgtctaccccaagcaggtgggctcaggcccggggtggtcagggtgagtgatggtttgggtaggggttgggtaagggcagaggctcactcacctcattcctgggtcagtcgttggactaaaatgattttttttgctttgtttttttaaagacagggtttctccatgtagccttagttgtcccggaacttactgtgtagaccacactggccacagactcacagcgatccacctgtctctgcctcctaggtgtaaaggtgtgtgagctaccacttcccattttttttttaaagaaaagaactgaaatatgttaacatttaactatcttagaatctagctatacaagaagtccatcccaggactgtaactgttgttagataattataagtagtaatacttttcaaatccttctaaaattatctaataagttcttggcatatgtaatgtctaaaagtaattccatgtaccaaagaaccaatgttattagcataaagaatgaaaggtacaagaggaagggcaatcctgggaaatggttttcaccatagccccaccacacactgctccttcactcaccctgggcatctttaatggagtgtgtatatgtatctatatacaaggaattctgggccaacctattaggaatgcagcctgataaggacaagacaacaagtgggggttcatacaccatgtgtataaataagtaaaagttagaaccccagcaaaaacgatttaacacaatgtattgtatccatttacatggggaaaaatactttcatcacaagttggcaggcttggttctaatttgaaatatgttcatccaaagttttctgtgtaatatctgaggtaccacaagtcaggccctgtctctaatgatattccccttctttcaaccatagctttaacttatactacaagctgtttggaggatttgtctgcatgacacacacacacacacacacacacacacacacacacacacacacacacacaaaagtcatctggagatctttgggacttactgtgtgggccctggcatcctggcatatctggcacaaaagggagatcccaaggagatgcttgctcatgatacataaaacaggctagtagtggctacagactatgggatttcttatactagatatctagatgaggaagtgtacattagaggaaaagtacccttaacaactacaggcttcccatctcatagggggatgataacgacgggagcgtaaatatgtgactactaaaaattgtgaggatgacagacttctactgaggaagtgtcatgattaatcttatttgtcaacttgacagtatctagagccatctaggagacaaatttctgggaatgtctgtgaaggaaggtctgtgggttaattgatgtgggaagaaccatttggtgtgggtactattcaataaaaaaagggaaagggagctgaacatagcattctctctccctgcttcctgactgtcgatacaatgtgaccaacaatctccgggtcctgttgccatacactccctcttcaaactgtaagccaaaacaagctctttcctcctcatgttgcctttgttcagtattttgtcgcagcactggaaaggtaatgaacaaaataagtaaatactatattcctcaacagtaacctgcttctttcttcttgcatggtgtccatagatatctcaaataatttaagatttattgcaagcagctggccagtgctggctcacacctttaatcccagcacttgggagggcagaggcagaggcagaggcagaggcagagaggcagaggcagaggcagaggcagaggcaggcagatctccgtgagtttgaagccagctttgtctatagagatagttctaggatagctagggctgttacacagagaaactctgtctcgaaaaacaaacaaacaaaaacaaagataaagatttattgcaaacaactgataggagaatacttttatctttcctcctaaagtacaattttacttgtattaaaacttcaattagaaccaggcagtggaggcatatgcctataatcctagcacttgggaggatgtggcagtcagatctctttgagttgagtctagctacaaagcaaatttcaggacagccagagctgttacacaaaaaaatcctatctaaaacaaccaaaacaaacaaaaacttcaattagaattgttctgatggcataatgaaagagtacaaatgagtcaatagagatgggcattactcactgtgtatttaaaattcctaaggcaaccttactcagcatatttaaagaacataggaatcaggaagcttaaattctagtttcatgtttcatatactaaattttactgttttacataaagactctttgagtaaaatcacaactctagcactcaattttttattttcaaaccaacaaaattagactgaatcagaattttgaaaagggtcttttgtctatagacattacttgaaagccggtgacaatgaaggaggcaatggaagtaatttgattagtctccatagttaaacaagttaaactcacattgagtcaagcttggtgacatttatttgagtaggcatatatcatacagtgctctctaaagttatttttaaaagaaaatttccaattagtgattctcaggccacaagttagaaatgtgggccttaagatcattggcttcctcttcctgtgtaaaaaattcaccctaattgtgattactataggtcaggaattccaaaagggttacgattgggaattctagtacagttcaagtttcaatgtcagccatgatggagccatgtaaagccttgcctggaactgccaatgtgttcaaccacatgaccagctactggcaggttccccttacaggaaccttcctaaggatgcctgagagtctcctttcatatagcacttagttttctgcttcttgagaaatcaagatgacagccacaatggtttcaatgaccaattctcagaagtcatttactcacagatccactgtattctactgtccccatggttctgtttaggaagagacagtgcaagggctcagaacccagaggtgaggacctctggaaaccattgtgaatgttgactactacacacagcctccatggacccgtcttgttctaatattgtataattgtaggaaatttacaattactactaatagcattgaaatacatcccattgaaaatgtacctaatcttacagatatgtaaaacacattgccttcacaaacaggatattgactcttcaaggcatccatctcctgatccttggaatccaggattacattacctgataagggaaaagagactttgtagatatgaataatataagacattgaaataaaaagaaaattctggattctctgggttggcccaatatgctagagctaaatttaacaatatttctggctgtggtcaaagtgtctcttttattaaaggaggggagtaataaagacagcaagaggatttgaccctctgtgccactagttgtgaagacggatgaatgggccaaaggaatgtcagtgtgttctagaaattgggagagagaagaattctcccctaaagcttcagaaaagaactcagatttcaaggtgctttgagtttagctagctcaacgctagactcatcctggacttctgacccacaaaactaagaatccataaaatgtgtgtctttggaatctaccagttctcccatggtgacttagttttttaatatttttattatattaaattttgaattatttcattatttaatggaactgtgcattatctaataggacttccaatccatgaatcatgggcattgtattttatttctttatattaatattcaagttttgccttgggatcaaactgacaaaaatcaaaatccctcaagccagaggatatattgtagtgaaattattttgaagaacatgtctcacctcttaaggagactacggtgactttcatttttaataactctttgcaagtggtaaaggtgttggatatttataaagtgtaaggataagctttgagggtgatgaagatggaaagtgttcatataatggtgaatttatataaaacttgattgtatttatttcaaatgatttgctatcagtgttgggcttaatttgcagtagaaaataataccatcttttttctgtataatacgtatgtaataattttgatcattactaatgctttttgttttgcctaatagctatatacaacactgagtagacttcaagaaagttaaagatttaatcactaacctcagagcctgcatatccatataagaatatgaaatgatatattaaagattaaattgcagttgaaatgagcaggaagagaattgaaaatatagcaagtgactactttccacacaagttattcagaaaagtaagttatgtaggtcttcaaatgaaaagaaatcatcacatgagatgagggaaaacaccatatggtagatgttatttaatctgggttttgaaaattacaggaaattagcatagggaatcctgactaactagattaaatgtatgaaaatgtttctattataataaagttcacccaataatttggttattgatttattatttatgaatttcttaaagacaaatgaatgtcttatacatgtgctctgggattaattagaatctatagcaacaagcatgaactcaatatttaatcatatatattgaagctgtatgccatgttttctaccacccaaataattaatattgcatattatgatatagaacagaaatagtttcttctaagaccatgctgtctttagcaaatttgcaatagcaatttatagcaatatgaaaacatgttaaattagcaaactttgggttcaaatgatttctcttacacaccagtagataaagcctgctgcctcctctcatgctgacatttttttgtcaacacgttctgctaattattcaggataacatttttcataattggcaaggccatgccccctgcatggtctttctcagtaaatgttgaaaattgataaatacaatttgtgtgatttatttttgttaaatgaccttattagtgcttctcctgcttgaactgtgtttgtgggtggatgtgggtatgaaaatgcagtcttgactttttcaagaaagaagttatgcaactttacacatcataaatttaacaaccaaaatgttatctgtaataagtgtttcgagaaagcgttatttaccactgactggtttgatggaagttgattagataatgttttttttcatgtgtgtgttgtcattgatattggccccattccagttggctgctaaggtgtctaaacactcaaaaacaaaaattacccgtaaagcttgtgacagcatcctctgggttcatggatacagatcactgcacatctggatgggttgttctgactgagtttataatgtcatatcccttgtaaacacaatacacctgtctctcagtttaacagacaggttttgaagctaaagcatttgtttttcctgagaaatgagtcacaacacattatttacaaatattaaacccaggagtcacaaaaacattttagtatttcatttattgtatctttagacagagtaaccatttgatagaagaaaaaatatctaccttatgttggcattttgggaaatctaaaagtgagataatgaaaacatcaaataattgatgaattcctttgacttttagagcataaaagcaaggatttgtaactattttcattctccacatcttgaaatttacttctgccttccatgttacaaaggatgaaacaacaaattttggtgtgcttccagtaagtacaaggaggttcacaccagacttacaacattacagagtatttctctgacattacactattctggaggagcttgcaacccactgcaaaggatagaatggctacacatgagaagataccacactccccaatgagtagatgtcagttatatgccaggtgcaaagaaggcaggtaaaaactgataggttccaggtttggaaacaagaatgaaggatgccctttgatttgaagttctgatctgctgccttccaaagagctactctgcccctcatttaaaaatcattgactctaaatgagccactttattaggtttccagattcatttcccaccacactaagggctgtatatcagattttcactccccatccccttgttcagatgctgagactcaaatatgagtattattgccaaggtgcacacaggctcaccctcttcattatgcttttgttaacatcagccaagacagttacagggaaagaaactcacaaggattttccagtgatcgaacactgttaacacatttggaggtgggggctgaataacctacagaataaaacccctggaggtcttaggctcataggtgtagtgactgcacttaagtcatttagcaaagcagtgtgaatgatgagcaactcataaagaagaaaacactctctgggattttcttggtgatgacaggacttcaccctcatgattcaacattaatgcatttaaaatgaaccatagatcttctcataattcgcttgtttccattctgtacacctttacaaagcacctgctctctgctgggttctctggtggatgctgggtattacaggcgtaaacaaattggtgtctgtacccaaggaatctacatgttgatgaagaagaaacagggaaacaaactatggggaagtatagctgtgactgattatacaagaccacagatcaaggaaagaaagagagccaagaacacacaataaagaacaaacgtggaatgaatgaaaccagtggtcatcgcattaggtgaactaagttggatactaagtgaactaagaattgagaacattatagtgaaaacagtgaacagaataaattcaagaggaaaggaagaaaatggaaaagtaagaggggcagacaaacttaagtgtgacaataagcatgtatagaaatgtcaccatgaatctattaatatttataactgtataaattaataattatcatgaagggcaaagagaaggcaggaaaagaggccaacacatgtcataagtccacagaggctcaagaaatagtattcccttcccacaaacaagaacctagtgaggaatagccaagataagagcagaggagatctagtgtgtacccaacatttgtatccctcagattcatgctgagctcctgctgcctggagtgatgatatcaggaaggaccttggaatgtagttcagtaccaagtatggcactgcatgaatgcatgttcttattaaagtgttccttaaacttctctatagtctcttgttgtagtgtgatgactaaaacgtcagccatcttcatcccagaagagaatacttccctaaaactcatgacatcatacctcaatctcagacttccagcttttataaacttctgtttataaaccatccagactgtttcacacactgaagacaggggattagaaacactctattttatgaatgcattaatgcccaccccattttcaattctatgagcccatcacttatactaaatctaataattgtttcaatattttgaagtctgtgactcattttgatgatgtcaatctctgaggaatataaaacaacaaattctgtgcctagaatcagcaactatgccctcttagtatctccaagacctaacattgctctaaaagtttttgtgtataagacaattaaggaaatattggctctgtgtctttgaatagaagaactgtaggaatttaaagttatttacttttgactaaattattgatcttgcaaagaaaattctgccaatctattatctctccgtggcctacaatattgagattttgttttagtcaacataaacaattcctgaaatgacaacatgactttaaaataattgtttctaattcactccattattcagatcagttctctagaaaattctttcatccccttcataaaagatagactggaacaccttaactagaagtggggaagtgattgtggtggagcacatatattcacaaatgtgatgtgtatgtgaagacacaaaagagactgagataccttggattgttccagaagagcaactatgtgtgtaaacattggagaggaaacagcaagtgagaaataaaagcacccttgctgtggtgttctgttgttcttccacctactaaacagcatttgcatcagtctgcctactctgggagtgttcaagcgccctgaaccaaacagcaaaacaaatgtgcctatatttgcaagtgtcacctcaccttaagaaaacccctccctggattctctgcactctgcttggctcctgaagccctctgattcccactgctgaagctcctgtttgctctcagaactgtttgatcactcaagggcacaacagaacagcatgtagctcttgcctttttggcaggggcttgaagttcagcagtaggtggtttctcaccagtttggctctagctttaggacaatgagtgacaagatgttagttcacacagcacgacttatgtaacttacaaaagaaaaaagatcaggctggaggtttattcagcaaatcagcaagatttccaaacaagaataaaagtcttttccctgtgtcccaagacaaagagggcttggccaaactactaaagggagacttatcgtgaaaatgagtgaatgtggacaatgcccttttgaggttaatgccactcaaaacagccagactgggtcccctgaagaagatgtcttttgtgaggagagaagttacaaacaaaatattatttaccaaggtgttgattcactgaaacagttctcatatgactataagcaatttaaatcttaaaacatctaccccagtacaccaaatgctacatagaataattgtgttgaaacccaataaaactcatataaatgtttacctcttgcttagaggaatttttagctccacagaaaaatcattgccagaaagccaaacatctcttaacatgagagcccatggttgttctttgaattgtgtttttgaggttctccttgtgctttaatgacaaagattgagggaagttgcatgattgttgctgaaaggttgagatggctcaagaagctatgacaatttattcacattggactcttcctctttcttgcttggagagaggaatcacaatgcagataaaatttccagaattggccaatgtttgtgctttttatttttttctgagtaggaggaagaagaagaaaagggaaagaagaggtggaggaagaagaggaggaggcagccacaacaggatttatgcaagactgcaacgctaatctcaatatttattcctaattatgtttgagtcagtttctttcatctttaaggagttctgccaggcaacttgttatgtttcccctttactcacctgctaccatcacctgcgagcacaactatgaacacatgagattcttctgcctctatctctataaatattaagagcatctatgattatatataaatatataaatattaagagcattatctttgataataaggaagaaatcaagtttataatctcatttcatagaaaaatggccagaagattgaaaatcaactgatctttattcaagaaaacttaaagctagtgtacacgctacatattgcaaagttctaggctttgaattggtttcccttggtttttgagatgggtattcattatatagccctgactcaactggtacttactatatagaccaagcttcaaacttaagacaacccttcagttctgcttcccaagatctgggatcaaaggaagttgccactatgcctagctaagtttctttatttttctataaatgaaaaattctggaaaggtcaactatagtcaccaaagcacagaagtggggctttaattgttgatgtagaccattatgcttacacctaaagaagtgggctacctccaacttgagcatctgagattctggattacgacatctgctttattcatctactccatggagcagttgtaaagttcagctcacaccgtgaacataaaggtgtgttcagaaaggttagatgttaggtacaaatgtaaagtgtgatgattttgtcagaatgatgcaaacgcagcttgcctcattcatctacccctactttcaatctttgtaaagaatgcttttcaaaacttaagtcatgatctgctctagatttgtcacttctctcctgcatccgtcttatgtcacattgctttatcctttcagatatatgaaggatgttccttaaccaactaacagtcactagtgataatttttggacacaaagaaactaaaatacaggtacatgataacagggccaacattgttgcccaaaagtctccattgcaagcccaagaaaattgtaggtaaagacagtgagtgtctgtccttagtctcctgtcttttgctttggccaataatgccttgtagggtgattagcacaggaatcatgaaatgggtatctgaatgcccacaagttcagggaggaccctagctatgagagttaacaataatgatcagatctggccacctgtattatttgtgtttgaaaagtgtccatgttgactgaacaaacactctcgggcaccacacatctgtgctctgcagagtcgctttcatcacactaagcctgttcttcgagagcaacgggcttcatgctgaactcagcatgaagacaacagggcaggacaccaattagtggaggcatttgcaccaacctgacaagaccactgtgcggggaagttcactgaagcctatacaagagtgaaagcatgtccttcggcagtaaataattaaactgaaaggaaaaagtgttatgctttatagacggagatttgatttatgttcaggaaaatttgaagccttcagaaatctgatcagttaccagacccacatgatcttgacaaagctgttaggaactgcactgttgcctggtactatacttcctttgtcatctaaactcagtttttgaccttcagcggggtggacatgaaaacacaggtcaggctgtgagtcagcagagcacggagtagatagaagttgccaggaccccaactctactgcttgaaaacaaacaccaggcatcatgatttgtcatccttgccagttagtacttcagttttgtagcttataagtttcacctaactataatgaataagtattctattttctagagagagttaaagagctaaaaataaaaagaaggtaactagccaagtactgaacgtagttttctgtagcaaataaattttgcatttaatcccagtatagatctaactcccacttggtctatttccattcaagttgatattctggaaaatacaaagaaaagatcacaaggcaaatctcctgtgtgataacattctcagaaactttaaacagctttaagagatttggcctcaaacccaaacattaacatgatcgctcaattttaatgaggtcaagcaagcttctgggcatctggctggtgctcaaggtcctgccctgagtggatagggccaccttgttcttaccaagaatgtaagaggtagtgacaggtgataatgtaatgcagaaagcttttgcccttggtcacttcatctttgaaccccagcagattcccagaggctatggcataggccctagccagatgtaagcagcttcctctttatctagggagctgaaaaagactttttgcaaaggaaagattgtttaaaaaatgtaagtgaacccctagtatgtgtgggtttaccagcctgaggaaggaagggagataaaacatctgtagaaattcttagcaaagagatgaaggtgatgctacaataaatatctacattacacagggtaaacacaaccatctgctcattgcttaactatttactgtgataacattctggctccttctaacctggtgaaatgcacagtacattaccgttatctacagcaccattatctattgtgtgtgcaagcacacactagaactctgtgttcctctccacctgtgaatcagcttttgctttgaaattcagccactaatcaatgtttaccagacactcaagcccctaagaaaaggatcacaagtttgaaagctactttcctgggtaatagtgagagcataaataggataacaggttcttcagtactccaggacaagtcctcttaactccctgcaatgttgaaaacactcgataactacacagccagggcaatggccattagcttcacatcagcaccaagtatgggaggcatggatactctgactgaagaatttgaactaatttaagtttaaatttccccatgaagctaataagatggttgttaaagtgcacagagcagagctggagaaatgactcagcatttaagagtacctcctgagtttgcagtgaatctgaattctgtacccggtacccacctctgctggctcacaactgcctttaccgccagttccgagggcgtctaacacatagggattctacagacaactacattgatgcacatacaaagctcgtgggctgaggctcagtcaaataggctacgagcatgtagccatttttcttctattggcaactttgtttgagtcctttaacttcatctgctgaagaaattaaaaaccagactagaaaatctcaccccttcaaaggggtccacaccaggctggtgaaacccacagaaactgctgacctgaacaaaggagagctgttggtccccagactgatatgtgggaaaacagaatgggactgatccagaccccctgaatgtgggtgtcagtgaggagacattgataatctatgggacctcttgtagtggatcagtacttatccctagcataggaatggactttaggagcccatcccacatggagggatactccctgagtctagacacaaaggggttggcccctatcccaaagaataagacagacactgaagaccccctatggaaggcctcaccctcccttgagagcatgggtatgggataggtagggtgttagttgtggggtcaggggaggatgagcgggaaagggaactgagattgacatgtaaaataattttctttctaattaaaaggaaaaaaaagaaaatctcaccccttacatgagattgtctttaacatacctggtaataaatggactacctgactatccatacaccatggtgtaaaaagtacatcacacaatatactatgcaaccttcatcatttctaaggcaaactagtctaccagcaaatacaatcagttatttaagttaatgaaagtctaaaacctaagaacccttaggtcaatggaagggtaatttaagaatcatctatttttcattgtaaggcagagtatctcaaaagaaataggctaatgacacactaaaaacatatggatcagaatcaaagagcctccttcccacttcaatattaaggatgggatggcttttcaaagggtgactacagagtccctgacacaacatagggcactatcaaacatgccatctggtttaacttactggtgtcatccactgtgttatttctagaattgtgggcttcatttcagttgcatttgtttgactgagtagcctacataaaggtcttgttgtagctcttccagactttcaactcccacatgcataaggattcccttaaaagtatatgttcaggataaaggctcataagagtttagtgatgtataatcagaaaactgtgccaatgtggtgggcaccacaccaaggtacaaaagatgcagtttttaacctaagcatcttatccaaaattcagtccatgaaggataaagaaatggtgatgctttgattatttagaatttgattggtagacaatttctgggggtgggctggtcttagaagcattattgaaccatatggaatattaaattcaacctttaaaacttagagaaaatgacaaaggcatgaagaaaaagcaatttggcatatgggcaagaatttatagtaataagtttgttatatattcattagtaagagacaatgagtttattaactgttgtagaaaataaattgctgcaatgggctatatttgctaagtgcagttttgacaagcagtaattttttttagcagagtggtcctttcagagctggttgttattttctaagttttggttgtgtgtaggtttgttagagagttgcttgtgtgtgtgtgtgttttagacatgatctctcactgaagctgggactcattatatctgctgaactggctagctagtaaacccttagaagctgtctgtctatggcaccttctcaagcagtattgttacaggtacccaccactgtgcctaactttttacatgcatgtaggggatccaaactcaagtcctcatgtttacacagcaaacactttaccactgagccatctctcaaggccctgggttattattttgaagcttttgccattcaccattccccaaaattattactataatacaacattacaggcacaagtttccaggtggtcttgatgtacatttcctgtcatctgtaagcactcgcctatgttctgaagaaccagagagtcttgtccacctctactctagtccacaagcaaaagagaaggtaagagatgtgatgatgtaagaagctcagaaagatcattctggggcttccaagatagctcagtcagtaaagcagtcaattagggcagagttcaatccctaccatgcacatgaaaagacctggcatggtggcaaacgcttataatccctgcccctgagatatggagtcaggtagatcgctggagttcactagcaagcctgtttagtctaatcatgatacactctgtctcaacaaaacaaggtgactagctcctgaagcatgatacttttagagaaagttgacttttgcctccatatgcacacacacatacaaaacaaacagagagggagagagagggggcaggggagagagcacttcaggtagtgtacaaaggtcatgcagatctgagagatggcaggtgacaaagaattaaatataggagatctagaaagagcaaagaaggtcaagacttcagaagccctactggcatgtttcctttccttgatctggctgcagaagtgaaatcaatgcgtgcgtgacacagggcttgtgacagacctctctcttgtggtattttctataagcctccttctaccagcatgacaaagaccacacagaggtctgagctgaaaattagctcatcagcctccagctgatatgactgccaacaccaggtttgcccaagacagctggatattgttttaatgactggtatcaccaagtgactccttggtcagtaccaaggagtcacaccactgaccagctgtgtgatcccaaacaggttaataagactctccaggactcagttacccaaactgtgactgaggactcaggaacactaatgcagcagcctctgagaatgagggacactaagatcagagtctacagaacagaggctgattttgttccaaacactcagcaaacataaatcactgttacgtatttgtagctttcccactgtgttaaaatagtgtaactatattttctataacaagcaaaattactaatgtttaacttaacagatagacatggtggctttagtggctattgaatctaattaaacaagttcctaatagccaactagtatttaagaggcatattaatggtcttattgtctttaacttaaatcttcatttcaaccttttaatatatacttataacttacacttccatccttttaaaataagcacataaagcttctcttaaagcaagtaccagcgtctgttgtttctacttcttccttgtttaatcttcgaaactgggcaaagacactggatccttttaatccttctggttcatgagatgctatgtcatttttttcacctaaccactaatgaagcaaactgggaccacctcctcttttatattgtggcagtctgacagatggcctcctaatggccaacacatactccctttgcttttagacacatagcttcttcctttatattatttttcactcctgttttgccttttcctaccgtaaataactttaatctcattgtttctgattctgtctacttgcaatctcaatattattttgttgttattttcatgttctttattccacccaatgtttgttaatggtgaaactggttcctcagaatgtttgaccaacatgacatgaaggtctgtttctttgtctcctattggtgaaatttattgcatgccacagagaagtaagagagtatcctgctaatgcaagatacatttaccaaccacacagcaaagagtcactgacctctgctcatgtgcttacagggaagggtgaaaaagtcacagaagcccctagaaaagtcagccatcaacatttgtcatcttgtcagctgtgaacaactagcatcatgctagacagccactcccagagcagcaatgcactgtcttatgaagcctctctcatcccttttccctgttgccccaactatagatgatccagaacattcagttggccagaggaatggaaggtttgatgacaagttcatgctcactcagggacccacagtgtcagatagaaggaaacctcaactttaaacacaagttggcaacatgagctactgatagttaaatttctaaatggaggtcgttttcattgacttgaacttaactacctagaagtgatcacagaagccactaagcttccctgtctttgcacctagacatgagaaagaccaatcttagtctgtatttaaaaagacagaaggagacaagagtgaaactattttgtgactttgttttgcagatcttcccaatcaaatgaaatcagctacttcattgaggagaaatggccatgtcagggggaaaaggtagttttcccaggagtaaagatgctattgccagacaaaatcagtgacagtccccaaaactaaggaaattaccctgagttggaaggtgacttgtcacctctggattattactgatcactgcttccttttccttccgtatagagacacatagaaaggcatcaattgcacccttctccatctttgcccaagatgctttgaagagatcaccttaaaatgcctcctcccgtcgtggtgactcttatgaagcattgttatagtcaaaagtgatgacgcagatttttaatcccagcactagggaggcagaggcagagggaacatgagtttgaggccagctttgactatgtaccagaaccttgacaaagaaagaaaggaagggagggaagatgggagggggaggaaatggaaagaaagcatgtatatttgttatgattattctttttaaatagtggttcatgtattaatgaatgaaaatcaaaagaaggaggtaatgtcattccaggaaaagatgtaaaaatttatgccctggaaagttttgaactaatatcaaaacttcataactgtatgtaaatctctacaaaatagactaagtagatacaaccacaacttttaacaaaattaaatatcctcatttattatcatatttatacacaagctttatgagtatctgtcctgctttattttaaatgaaccatcaccttgttgcattttgcttctgtgcctttgggaatcacaccccaaacacagtgtgatataaaaaggagaactgttccaggggcaatggtcctgactatgataaatagcactatgatattgcagatgggctttgccacagctttctgtctttaaaaacatgaaatgatactaatctagtgtaattcacaagttacttatgggactcagcaaggcagcgaacatgaaatgtatgaagatgaagtaatttaaaataacagtgtgttttatggcttcttcaagattttaatgaggaaattccacccagtaagtgaaagtgggaataaattgaagggtaaaagggaggggagaacaagagggagggagaattaaaaggagaagggaatggaaagttcagagacagagggaaggagggagagaaggaaggaggaatagagggaggggaggagggaaagaggggtcagtatagatggggtctgatatttaaacataacaacaaatagcaagttaaagaagaaagcgacaatgtaagtttaaatcccaaagccttcaggcaaaggaatcactaatttcacatgccacggggtcactcactgagtctccacttggagcaagtaacttctaaatttctcttcctttgatctgccaaaggagtggttgaaagtttactgtgaaataacttttattatcaaaatttatcttccagctcctttatgtttttctctactaaaatggtgacttttatttcctccattttaatcccacatcaatatgaagccagaatattcccatcctccccatctgtgttaggagttctgtcttgagcatttggggtgggagtgattttttcatctacaacttgataattcctaacttctgaaacagtaatttgcattttggaagtcccaacagggaaacaaaattgtttctacaactgttttcttaattttatcttccagattttgaaaacaatagggacatattgtagagtatattagaaagtataaagttttaaaaggcagggggaaaaatcccccaactgcacaaaatcaacaatagctaaaacattatgttactttttcatttttccattttttactttggaacggaagtcttgctatgtagcccaggttgttcttgaactcatggtcctcctgcttctctatcacgagaggtgggaatgcaggtgtactagcacacacagttcttcttgctgtttagcaaaagctagcttaccttttcagttaatatcacatcatgggcatttttcttcatccatagttatttgttcaatagtatttgtttgatagtatatttaatttgtcattttgatgtaatgttcaaattcagaatgctttttgttagttcctagagaacattggtttattgctatgtgtttgaatctacttatagtctgtttgcttcttaaacagcaggaacgtttttaaattgaagcaaatgttttcatagacccaatccagtttttctcatttacctgttaattatttgttaccttcatttttttgctttttgtttcattgcaaattgaggaaaaatgtgttgtttttcagaatgaaaaactgtgtttagagatacattgctgatagcacacatgctctttgttatttagagctttcacaacagaaaaggtcctaaagattatttttataagcataaaggaaactggctgttgagtataaatatgaaatttccccatggactgtcctagtgaatgcttggtccacaaccagtgctgtcattttttgagatgtcagaaatattaaaagatagtgtctagttcagaaagtaaacaatgagaggctgggggtgcttttgagggcagtacatgtgccctggttccttcttctccatcagtttcccatccacaggaggagggtaggctctgaaacagtctccttccataatcacactctatcttaccatggacccataattaacaaagccagaaacctgaaaattcggaaactgtgagacaaaattgtcttccttcttattttgcttctgttaggcattttgtcagtaacaaaaaaaacccaatttcaatacttgcaaatctgttttcactctatcatttctctacctaataatgtatatagtgatgccccaacaggggaattagtagtgtcaagacagtacaacactgtgtttccttcattaccaatcattgtctaggaaataatttggtaactgttaaaaggtgaccaactatactacttgctataggtagaaaatgtgggacatttgtcaccaaaaccaagacagtctcaaacaattttccccaggaaattccctttgtgcagtttactcaaccaaaatacttaaacgttacagcaagccaacagccaacatcaaaataaatggagagaaactcaaagtgattccaataaattcaggaacaagacaaggctgtcccatatctccatatctattcaatattgtacttgaagttctagctacagcaataagacaacaaaaggagatcaaagggatacaaattggaaaggaagaagtcaaactttcagtatttgcagatgatatgatagtttccataagtggcccaaaaaattctaccagagaactacagctgataaacaccttcattaatgtggcaggatacaagattaacaacaacaacaacaacaacaacaaaaaacagtgatcctcctgtatatagatgataaagaggttgagaaagaaatcagagaaacaccacccttcacaatagccacaaacaacataaaatatcttgggataactctaaccaaacaagtaaaacctgtatgacaagaactttaagtcttcaaagaaagaaattaaagaagacatcagaaaatgggaaaatctccaatgttcttggataggtaggatcaacatagtaaaaatggcaatcttaccaaaagcaatctacagattcaatgcaatcacaatcaaaatctcagcacaatttcacagacctcaaaagaaaaatactcaactttatatggaaaaacaaaagccctgatagccaaaacaatcctgtataacaaaggaacttccagaggcgtcaccatccctgacttcaagttctattatagagctatagtaatgaaaacagcttggtattgttataaaaacagacaggtgaaccaatggaatcaaatcaaagacccggatgttaatcctcatacatataaacacctgatttttaacaaagaagctaaaattttacaatggaaaaaagaaagcattttcaacaatttgtgctggtgtaactggatactggcatatgaaaggatgaaaatagatccatatctatcccaattaggtccaaatggatcaaagagctcaatataaatccagccacactgaacctcttagaagaaaaagtagagagtatgctttacacaatggcacaggaaaccactttgtgggacaaacaatgaaatcaacaattaataaatggagtcacctgaaactgagaagcttctgtaaagcaaagaatgcagtcaacaagataaaacagcagcctacagaatgggaaaagatattcaccaaccacacatttgacagagggctgatccccaagatatataaagaactcaagaagctagccaccaaaacaacaaataattcaattaaaaatggggtagaaacccacagaaatagctgtcctgaacaaggggttgctcatggaccccagaatgatagctaggaaaccagcataggactgttccagaacccctgaatgaggatgtcagtttggagttctggacaatctatgggacctctggtagtggatcagtatttatccctagtacacgaatggactttgggagcccactccacatagagggatactctctgagcctagacacatgggggaggggctaggccctgctccaaatgatatgactaatgttgtagatcccccatggaaggcctcaccttccctggggagcagaaagggtttgggatagggttcggtggggggcaggggaggagaggagggagaaggaactgggattgacatgtaaaagaagcttgcttctaatttaaaactggtctaattacaattataaaaattaaaaagttatacaaaaaaaaagaaaaaatggggtacagatctaaatagagaattctctacaaaggaatctcaaatggccaaaaggcacttaaggaattggtcaacatccttagtcatcggggaaatgaaagtcaaagcaattctgataaaccatcttacatctatcagattggctaaaatcaaaaccactgatgacagcttattctggaaaggatgtggagaaagggggacactcctccattgctggtgggagtgcaaatttgtacaacctctttggaaatcagtatggtggttctcagaaagttgggaatcaatctacctcaagacccagcaatgccactctttgtcatatacccaaaggatatataaggacatctgttcaactatgttcatagcagcattatctgtaatagccagaacctggaagcaacctagatgcccctcaaccaaagactagataaagaaaatttgatacatttacacaatggagtactactcagcagttaaaaaaaatttaaatcttgagatttgcaggtaaatggatggacctagaagaaaccatcctgagtgaagtaacccagacacagaaagactcactcataagtggatattagacataaagcaaaggataaccagcttacagtccacaaacccagagaagccaggaaacaaagaggaccctaagagagacatacatggatcccccagaaggggaaatagacaagatttcctgagtaatttgggggcatggggagaaggagggagagtggtaggagattggggaggaagaaagggaaggaataggagaaaatgagggatctggaaggttgaattgggaaaaaaacagagaaggagaacaagagataccttgatagagggagccattgtagggttaccaagaaacctggcactagggaaattcctaggaacacacaggatgaccccaattaagaatctaagcattagtggagatggaacctgaatcaaccttcccctataaccagtttgatgactaccttaattgtcataatagaaccttcatccagtagttgatggaagcagatgcagagatccatagctaagcactaggcggaatacctggagtctagtagtagagaggctggagtgataatatgagcaaaggaatcaagaccatgtacagaaacccacaggaacagctgaactgagcaagtgggagctcactgactccagactgacagctggggaacctgcataagaccgaactaggccccctgaataccggtgatagttggtggagaggggtttggacagtttatggggccactggtggtggaaccagtatttatccctagtgcatgaactggccttttggagttcattaccttaggagggataccttgctcagcctatatacagtggggagagccttagtcatgccccaaatgatgtgatagactttgatgattccctatgggttagggttagggttagggttagggttagggttagggttagggtttagggttagggttagggttagggttagtgttagggttagtcttagggttagggttagagttagagttagaattagggttagtcttagggttagggttagagttagagttagaattagggttagggttaggcctcaccttctctgaggagtagatatggggtggggtgggaagagcataggggaagtggggggaagaagggagggagaaggagcagggatcggtatgtaaataagattgttttaaaaacaaaaataaatatttaaaaaagccaactaagtaaataatctcctgtggaagagggtcatatctgtaaccctcaacagaatccactgaatgatcctggtaatcttgaataatgtacattgggcttcttcatcttatctatgatgcttcatgaaccctttttccaaggatctatttatgaactacagcacaccatggcagatgagctgcttcccatgtctctcttctctgcttctcttcaccccttacttcttggtcactattctccagttgctctggcttctttctgatcttcaaacatgtctatttaccattccttctacctctgtactagctgttctgtcaaatgctcatacatccttcttcattccattcatggcacagatcttacccatcagaaatgcctccctggacaaccattttcagaataacatctgatcctaccatttcacagaagtgtccatatctacagttttgctttttgtggtatcaaggttcagaggtcaaaaattctaaatattaggtaagaagttctataataaagccattcataagacttgaattttgtggcattgtatgctgtgataaaaagtcccatgctgtagatgctgtgtctttttcagagtgtgaatcattaatctgtccagggtatccaagctgagtacacaaccttaatgatggatctcttagaaggttgccagttcaactgttatgcagtcatgcttctgctccatggacccttattttacttaataaggacctatcctgatactttgttagtaattatattttattacatgttgttgttagtatcataccatacataaggaacttatacacacacacacacacacacacacacacacacacacacacacaccatgtacatattacctactatttcatcaccacccggaggtcttcgcatatatcctctgcaaataaggaagactgtgattctctttgtcacagttccaatcttagcatatgcttatgtatttgtttaccaccacatctgcttttaccccaataaactacaaggctcagaagcaaggaaaagttgtttaatcactgtttattaagagaatatatgacccaaatgggatagcagtgaacacttgagactgtagagcaaaatgcttctacttaattctgcatgacagaattctgtggtcttgagcaggctacctaggtgggcttctgtgggcataagtttctaggtaatatggatggtagcaattattattgaaggttgctctgggaacaaagaaagacactttagccaggtgaagtgttcactgagttgcaagtactcaatgagtttgcctgtgatgctactgttttactcattaatgaaataattcaaccattgcatcccaaagaggttgcaaacctggagtcatatgaatatgagaataattgagatctcaaaatgacaggtgctatctgctgctgtttaactgttcaaatgttgtattatgtttgagagggcatactctctcaaagggtagaatttccatcccataatcttgattctggttttaagcagaatgttaccgaatgcatctgagaggagtggtaactgagtgttttataaggtctttcaagtttcctgggaatgggtggtgctgggttttactgagaacattggaactgtgaacaacatttgaattgggaattgttcctttaatttctaaggcatttacaaaactggtttccctgactacgatcattttctgggccataaaacacactaaatttggtttactaggaggcatcagtgtaaacctttgtcatgggtttcagtaacagggctttcctacaaacatgccatctaaatttttctgaaattttagagagtggaacagatggtttagcgctctgagactggccataatggcctcacaaagctttttatatcatttgtgaatttttaatctttaaacaatgaatcatagaggtagggaggacacacactgaatgttgcttctaagagttattcagatcatcctacatgcccacatgcagttacatacagatacttattcaaaagcttatgatctattggcctcaagatttgggggtgagaaggaagaagcttgaagatccaaaactgaaatgatgaattctataatttactagaggttgcaatataaaatgaaactaccagccagaagtcaggcatctcccacaactgagtcttcctacatcaattgcatggctctctttgatatgagggcaaggctaaccccaccccgtctaaaaactgctttgtggtccacaggggggaaagggccttgtgacatccgaatggtccgggaacttactaagttaacaaacttcaaactgttttatgaaaaaaagactaataacatctattgaagagaggccactgtactgtttgaagattagtaaaggagtcatgatctttgttcaaggaagtaaaatattaagaaaagttttgttggtagagttctgaactgaatgtgtgctgtgaagatcttctgatcacagaagctgcttcccatccaaaaataaaataaaacactctgatatgcaaatgataagaatatcctttggcatcaaataatatctaaaagcaaactctgcaaaatgtcccagaatttgtttatttaagaacattctgttccaacttcaaggtggactctacaggcaaatatttatacagattatttttaaggacttttgtaagtttctattgtccagctttatttcattgatgtctatcaattagacttgttttataatgatagtgtacccttaccataagaaaatattattattgggtcagaaatgttataatagtaataacaataataaatagaatccaaaatcgtagagccattaagtctctacaaccaactgtgcatgaccaagtagcccctgttaccaatcagtttaacaggagtggcatacctaactgagcaaagagcaacagctcctgcctggccttacagagagaggccattgggaaactttcttcaactattcaaggaggacatcagagttttctattgattttgactacatcctaactaccacttttttcctgatttcttgtgtgttccactacttattctgacctcttacgtgtaaaatcacagactggtatcagctatcacttcccttcataagcagttcccttggctgagcccaaactattctgagggcatagttgtagctgttctctctttagccctgagttcttaaagttgaactctattattgggcaacagcaccatgtggccatggggctagtttcttgtggatgtgccttctttgtatcacacttcctaaacagcatcctctcgctgggattctgagacaagccttaggagactgggccagaaggtggatgattaataaagcttacataaaactactaataatccttcatgatcatggtgacattccgcattgccatctctgtgagagggaagccctaaatcaaaagaattcattgaaaactggcacagttctgtcatggcaaatgagacagaagatggcaatgttaaaacctagactagttggctcctttgagaagacagtagccccaggcagagcccattgtcagccatcatccaccttaaactcttaagaggaggctggcacacattcccctaatgcttgtggtggttaagaggccagactttgaaaacaaaaatgtctaaggcacactaaagggcagaagaatatcttatctttgacacttaaaatgctagaagcatttggagtaggccttggatttcacatagctcactttgaactttgcattaatttcccttacaaacttatatttaaaaaaaaaatctcaaactttctatgatagttaatcttcacgctcaacttaaggggatttacaatcaccatggaaacacttccttacttgtctctctgagagtacttccagaaaagtgtaactgaagagagatgagccaccccaattgtgagccccaggctgagtaaaaaggagaaagaggaggggggaccaggatatgttgatctgttcttcctgactgcaaaggcagcataagcagttgcctcatactgctgccaggtgcctgcccttccaggtggattgtctcccctcagactataagccaaacaaaagctttctatccttcagttgcttttgtcaggtattttagtcatagaaatgagaaaatgaattgatatattttatgatgatcaaatgtgttcaatttcttcaatgataacattgcgtcttcacaaacttggatttttaaaaccactcctcccgcaccatgtttttcttactcttctcagacaccacatactacattttaacagagacacgaaattaaagaacatgctcatcagagctgactgttgttgtgtcatagtccactagtgtaatcctttctgtcaacccattcatttcatttgggtatggtaacagaaggcaggactagtaggaacattggaatttaacaggtgcagagtacaagctgtagggacaatctatctgaaagcatgtggatattgacataaaaacattcatccttgctaaccaggagattaaattttctggaacactggtgataacaattgtacaaggagtaaaaaaaaaatgacgtctcagcttcataacagtacttgcaattttcatttgcaagccattcaccatgacctcaagtccctacaggttaatgtcactaataccatttaccatttctgcagagaatactacggaagtctgaaacacacctcattatttaaactctaaaatctagggatattttgaaacttacaatatacctctagtaataatgaggagagttctcactaataagctgtggcaagtttggacatctccaagacagattttccaaggacttctagtatagttatgacatgaaaccaaccatacattacaagtaaagtccaaggtccatcctatgtgaaacctaaataatatttatcatgctttcccccaaagagtcagaaaacattaagaactaagaggttctgccattaataaagtgcatgactttgggaaagtcacttaatgtctccaagcttcaatatcccactcagaggatttctctactcagggtcatggccatttacagcaaagttttattctagactccatgggaagccagaatataaaactttgtaactttaagcatttttctattataagcatagtttttgaaagaaaatagtcccaaatgttttcagactaattcttcttagcaactttgccacagtcatcaaatttattcaaattaagtagcaaatggagacatcctagagcagatatacgttaagttttaggttggtacctttatattttacatatcattgaattctcaaacaatacaattagcaatagtgcaaaatgtaagtggattgaatctaaatcgtgaagctgcagggatgaagtttttaatcactggatgttttgtaccataactaaatcacgatgtttatgataattttattacttcagccctctttgtagcagagttattatatttccctgtgatgtatggcatcacacttacaaaaccctttcagtaatcagagccccacaaaactggcttctaaggctcattaatgtgaaaaacgatcataaaagttaggtaagtgtagtcatttcattcttggattagaactcccaactatggaaggtatgttctgcttctctgatggtattcttgactagacattaactagtcaaaaaagatagagagattcacaaaggacatgtattcaagactgaactacccagcctagaggaactgtgtttcttattttagtctcttctcagtttgctactggaattccaaactccatgacttatttttgctgaccattttttcttttcctttctttttccttaagatcaggcctccccacacagcgcatgatagccttaaaattcttaattattcccctgaagaagcctccactctgctcatctaagcttcctctttcttctgtctcccaacagttttgaaaatgctcctgaaacagaagttgctgtatgatctctctttaagtactgtataacggtggtacacgtattatccattttacagaagagaaagcctttaattttaccaaaggaccatatatagtaaataatgaagtgagacgaaggagtcaggttattggaagatagcagaccactgtcacccaccaatagctattacctccagggagactgcctaggtgggaaaaatgccaaaggcagctgcagagggagtgagctgaggttaaagaaagtgtaagtgttcaagaatccatgtgccttgattttaattactgaaagaacaaaacaaatgaaagaagcaaggaaggaaggagagaccaaaataaaaaccccagaaattaatatttatcccagtgagactcagaacagtggtatagagaaagtggtccttgggttttcacttcatgttatcactgaaaaagttctagaaaaccattctgttagggatcaaaagggacttatccagaaattaccactgtagtcaggtgctagaccagtgagtacagtcccaaaacctggtcaaactttgagaaacactgaaattccatgtagaaccatagtcaggagtagaagtaacttttttaatacaatttttaatttaaattagaaacatcttgctttacatgtcaatcccaattccctctccatcccctcctcccctgcccccacaaccctgatctcatccactttctgttccccagggagggtgaggccttccatggggaaaacttcaaagtctgtcatatcatttggagactttccccagtatgtctaggctgtgagagtatccctctttgtggaatgggctcccaaagtacattcatattttatattagggacgaatactgatccactaccagaagccccatagattgcctaagcctcctaattgaaacccatcatcagttggggtcatccttgtacatcactggacatttccctaatgccatatttctctttaaacctataatggctccctctattatggtatctcttttcttgctctcctctattcttcctcctactcgatcttccagctccctcatgtccccctttcccctcttcttctccccttctctttctcccaatccctctcccctctcccatgctcccaatttgctcaggagatctcatccctttccccttatccaggggatttatgttcttggttgtcaacttgaaacagtagaaaaaagaaacctcagttgaggaactgccgccattgggttggcctataggcacatatgtagggcatattcttgatttctgcttatatagaaggcccagtcccctgtgggtggtacaattcctaggcagttgggcctgggctgtataagaaaggcagatgagcaagtcagaggaagtaagcaatgagcagcatcccttcactgtctctactttcgttcctgcctccaggtccctgcttgagctcctattctggtttgccctaatgatggactttcctctcccgcttgttttctgtagtggtatgttatcacaataacagaaagtttcctagtacagcagctcaggtgactttatccaaaatatattacattttatagtattaaccactccccctctctctttgagacagggtttatctgtgtagccctggccatcctggatctcactctgtagactggtttcaaattcaaagagatttgcctgcctctgcctcccaagtgcttcgattaaagtcatgtgccaccactacccagcttaagtcatatcttaatgcaagagaattgaaatggcttcttatattttcagattataacaaacaaaattagatgttccttacaagataaattgcataaactatgcttacacatggagatgaatgttgtaaaataataagttggtcaacaaggtttcactcacataggcagtattttaaaaagcaaataaagatgtgaaagtaagaagtgatactattagaaagagaaagggaactcctaagagagggttttaagtgtgggtaattgaggtttgaccatgatcaaaatagtttacacacgtctatgaagaggccatgattaaactctttctttatgcaaatttatacactaaccaaattcttgagcattaaaaggacacagatattcatgtgccaggtcttgtacaatgtccatttcaattattcttgactttcacacaaaactgtaatgttatactgtccaaggagacagatagcaatgaggagagaagagagggagcttatactgcatacagttgagacccactacctacctgcattcagcccatgagaattctatcagggcatttggcaaaacctccagtggtcttcagaaattctatttccctaaagacagatcatttgaataaacaattaaaattctttagttttcagccacatcaattttaaaagtcccagccagaaaggtgttctagactgttttttttttttcctctgttacttttctctgatttcctggctcctcttccctaattaaaatttcccaacactcccacattctcttctctctgggctccacatccaggaaagaaaataaaaacccttccatgcctgggagcatattttaatgtacataattaaaactaaaagtgaaaagaaaaagttcatataacaaagacttacagagtatcatgacttcgaaattcatcaacacagtcatgtgcacatgatcaatctgtgcctttaactcagtccaaagttcctctgcaagagttcattcacttgcatgaataaatcaaatatgtgctccaacagccaatttctatttccttatgtataagagcagtctacaacaagtgtaaagccaactgtgtttgaaacaccaagtgtgtcttttacttaatatggggaaaaatgtgtatggaaaggggttcttgcagattgactcaaacttagtggctaaaacagttacaaaaataaatatgtcagcacaactacagcagaaagaggtaagaatttctctgcagctgtgacaccaaggctatggtacaaagttccaaattggaaagaaggcaaaatgcttattgttgtagtttcatccatttgcctgcaaatttcaagatgtcactattttttatttttattttttaatcactgagtagtattccattgtgtatatgtaccacattttcattatccattcttcagttttagagacatttggttacttctaggttctggctattacaagtaatgctgctacaaacatagttgaacaaatgtccttgtggtatgagtgtatatcctttggatatatgcctaagagtggcattgctgggtcttgaggtagatcgattcccaattttctgagaaacagccctgagtgaggtaacccagacacagaaagacaagcatggtatgtactcactcataagtggatattagacataaagcaaagatcactagcctgcagtctacaaccccagagaaactaggaaacaatgaggcccctaagagagatatacatcccccccaacagaagaggaaacagataagatctcctggaaccttcatccagtaactgatggaagcagaagcagaagcagagatacacagctaagtactgggccaaactcctagagcaacggtgagagaccatattggggaaacccacagaaacagctgacctgagcaagtgggagctcactgaatccaggctgacagtcagggaacctgaataagaccgaactaggtcccctgaatgtgggtgacagttggggagcttgggccatctatggggccactggcagtagaataagtatttatccctagtgcatgaattggctttttggagcccattcctatggagagataccttgctcagcctagatggggggcgggagtccttggccctgccccaagtgaaatgatagactttgatgatcctccatgggaggcctcacagtccctgaggagtgcatgggggtgggatggggagacggtggggaagtggaagggcaggagggaaaaaattttaaaaatgcttattgtttactcaagctatttacttgtacatgcaagccagagagagcactgaagacagggaggtttctggagtgggcatggtggttcttttcctcttctcccccactaagggcaaatgtgtatacacacacatgcacattcacatgggcaggcacacatgacatctccacatcacacatatcagataataaacatacccaccactagcaggtccacatattaacatagtcaaaaactctctggactgtaacaaaggaatggactgagactcgaatacaagtacctgtgtgtggtagaaacataacatctccatcgctttggattcacaagtcttaatcaaaaatgcatcatgatatgttctctcatttactaccaaccctacctgcccttttttagccttccaaaacacccaggccctactaggttatttgacttcaaggcttggaactaaaatttttcaacccagattaataaccccaagagctgatggtgctatcagaaagaggtagagattgcaaataacatttaaaagcactgcttacttctctatctggaagtaactctcagggattactaagtatatgaagtggttttgaactcagagtgacttgactatagaactcaccacagttttttcagccaattaagatcgtctcttttcggtggtacaactagaaaagaaggcatgagacaagagatttgttcagttatgatcgagattacttagaattcacctccgagttaccagggagtacaattccccacttgggcaaagagggacccctcacctagaaggcacatgtactctccctccctccaatcctatattcctgcctttccatgcagaataaaattctatcatttgtagatgatgtcctcttttagtactgaagatgagcaaaatagatttttattttttagggatttaaagcctggtgatagaattatagtctttataccttttgacaatgaccctgatggttcataaacgccaatcgtgaatgaaaactaattacagctctttcaggctaaacagcagccactgaataccactaattatgcaatgaagctcacagtcatactaaaaacattggcaataaatgaattcacagggaagacaaaaaaagaaaaaaggagaagaaaaaatgcagtatatcagccattgtgaagaaaatggcaaatgctaaaatctttccttattacaccatggatattttaaatgctttaattactgtacaatgattgcttccagctcgacacaaaggcagttctcaaggctgacaaatcccccccaaatccccaaatgcatctttcatacatactgatgattgtgagcttaatattggtggagatttgcctaggttcagatggcattcagtcagcgtccacattcaagtcatcagattctaatgtataagaccagaattctccaaatacttgggaccaggacttgtttggatttggtggaagtaactgtgaattaactctgttaacttggccaagattttcttgcagacttccagttaaatcagatgctgtggaaaatcctgaggattcagtgggacccaaacgtcaagtttatcctttatgtgctctgatgccaagagacttagtgctaagaggttatttatcatttaaatataaaactttggtaatcccatgagcatcttcccaactcttctaaggcagatgtgccccagggggaacatgatatgagaagcatgaacccgctatcctcgtgtcctaggttcagttcttctgtgccttgcaccatgtgagcatttcgtgccttccagactatttgaaaggttctacaggataatttctttttcaaaacattgtatgtgcttgtgttgtatgtgcatatgctaatgtgtaagggaagtgaagattgcgattatcagtggtgctcttgggtttggaggtcagtggtcatcacagtgtcttcctcttttgctaaagaccttattttatttttagaacagtcacttactaaaccttgatctcatagatcaggctaagatggctagccaataaacctcataggcccatcattctttacttccccaatactgaaatggacatgttcttcctttcccagtattttgatgtgagttgtggagatcaaattaaagccaacatgtttacaaaagacaactccaggttcaggaagataccctacctcaaaagaataatacagagtaaaggggacttactgatgcccttgtccagactctgcacacaaacatacacacacacacacacacacacacacacacacacacacacaccactctacttaaaacatagctcttcccctaaacctgttactgctgtgggcatgattatttttaatataacactatcatttctttgaatgctctatttctatctgcatatcttcttatctccccaaaaggtgaatttaaagataacaagagtcattaaatcaacagaaaaaatccaaagttcagctcaaatggaatgtttgctccctatcaattatttttcaatagcattttataagtaatggtatataataatcatgcaaatcatggagttaaattacagcatgtccattcaagtataagatgcagttggcttgcatccacccccctccattactctttcatctcttccctgccttttctgctttcttttcctttttctcttccacatggctggtaaagcctgccctccttagtttcctatgaattttaagttctcacatgtgtatcttgaatattatttgatgcccattggcagatctgcaccaccttaccactcaaagtgtccttgattcatcaccttcaaagaatcctgaaatttgcacacatgataaaaaaactcctatccacaggatggactgtaaaaagaaggaaaggggcaaaattacttcaaggtctgaggagtggctggtcagtgggaggaagagacaggcaccagaaccatcagggactggctcagaggggattttgaccctgggtttctgggacctggatgtgggtgaagtttgctaaaagtcaagggaattcaaggaaagtgacttcaaagtagatggagtctttcaaagcagtactgtacgtagagaaaagaaacaagctccagcttgtaccagaatcatttggaagaacattctggactcctgccttctgaggacaagagtcacagggatctgagcagcctccaaggcctcagggaaccttctacacagatcatcatgctagctatgcattcctgtacatgcctgcgaaccaaataactacaccctactcattctaaaccaatcataaccctgactcagcttctcctgagctaaattcaaaactaccctcccacctctcgtgcctctcaaatgccttgcaaaaggaagaaaagtttcatgatggaggtagaatgaaaagtcaatgggttcttaaccaactgctggcaagcagacttactgttccaaaatgtttccaaataaatcatcatacaggccatcccccatgcctgctgtgggttcctctatgcagctgatgtaagtgcaaagcactggagtccgaaggtcctcagctctgcaatacagcctcctgctaaagacccccagacttcagagagctgccactgtgcttctgagatctttgtgtgcctgactcctctcctgatgcacaatataacatccaactcagtgatggacatttccaattgagtcctctctccttctgatttcattatcctaaactagaggaattagccatcagatgagtgttgagagtggccacacctaactcttattacagaagtataaaggctaactagccttcagcctcctgcttctgtctctaatcttctccagagagtgatgtgactacagatgcctgtgtagtgcttctagcttttgggtgaattctgtttcaactcaggtcctcatgcttgcatggcaagcacttttacacatggagccatttccacaaccatgggtagtagtcctacacaccaaaaccaaatatgatccctatgttaattattctttgtgtttgtttgtttttcaagacatatttctatgtgtagccctggctgtcctggaactcactctgtagaccaggtggactttgaactcaccgagatccatctgcctctgcctccagagtgctgggattaaaggtgtgtgccgccaccaccacaagtttatgttaagcatttttagagaaccaagaatcattcttaataaggtttttcattattaattacacatttatgtgtaattaagatattatgtgtctgagatgtacttagtgtttatatacctcaaaattcactttgacagctaatccaccaccagacaaaggcatgatgaagtaaagcctttgtgatgtgagtaagtcatagggcagaaacattataaaagagtcaccaggcacatttctggctccttttgcgatgtgagattataggaagaaaatgaccatgaagaagctagccctcaccaaacacctaatcttccaccatcttgatcttgaaattaccaatatccaaaatggcaataaaataatttctgctatctgtcattccatctacgatattttcttataactgccactatgaactgagacaatgtacaaatctcaagttaaatggaaagcaatggggctggagagatagttcaaaggttaagagaacatacatctcttgctgagaatagtggtccagtttccatcacccaaatttgggaagctcacagccacctataaatccagctccagatgacccaataccctcctctgatctccacacacacacacacacacacacacacacacacacacacacaccacatacatgaaaatacttttcaagtagtaaaatatttcagtgtttaaagaatttcatgataacctgtaacaatatgtaatttttctactccttgtattcaaatcttgggttagtcattgatgttttccttactttctgtttaaacattcagtctgacccttcttcctcatagtttttctcccatgttcactatatatttaccctgtcataatgccgaaggaagcactggctttcaatgatgaatttccataattgctgttccttgggcttgacgctcttcctttcacagttcatgccacataggattaaacaatgagaagaagaaggaacttgaagttcctgagtgcattacaaaccagctccttaacctaatcatctcagttcattaaaatctgcaatcagtgtgcccgtttcatttctcaaatgcttcaatataaaacaccagcatttgctggaggagtctaatcactgcctaattagcataacttaacgactcccagctcctctttctcaattgactctcttgcttcctagaatgtcctcatgctgttctgacagtaaaagctgcagctcatctgcaagtgaagcctcacttggcccaagccatttgtaactttcaaatgacagaaaaattgtaaaggaaaattatgctgattttaatgtcccacatcaagatgatatagataggaccaggtgatatttgttgctttgcaaggcactgggacaccatccctgcatctactggcactcctaataatctccccggttcgttctatttttttctatttttatttatttctattttatttattttatttctattttttctaagtttcctctgcaaattggagcatccttactaatttttaacctacttttcaaatctgccctataactcttaacctaaaatttttctgtctttccctgaaattcctactagaacattcttttatcatagacctctttgactcttctgctaccccgagtcaccataatttgctgtgagaatgaaaagtgaggccatgaatactcatcactgcatgaatcatttttttcttcacctttaaatgttctgcatcaaggctgggagattgctcaggcttcaagactgctttgtgctgatcctgaagaagatgactttggttccaagcacttatacaaggttcaagtggctcataactgcctgtaactccaattccaggggggtcttatcccctcttctggcctcttctagtacctgtgcacaaatggtctatataaactcacacaggcatacacacatacacataaataaaaaataaatctaaaagatgctctacatccatagaggaattttgtttgtttgttttgttttttcaagacagggtttctctgtgtagccctagctatcttggaactcattctgtggaccaggctggcctcaaactcagagacatgcctgtctttgtctcctgagtgctgggattaaaggtatgtgccatctacaaaggaattttgagaactgtcttctctgtaagaatttctctgataatccaggcatagtggtgcattcatttaattctttaattagaggaagaggcaggaggatctctgtgagtttgaggccagcctggtctacacaatgagttccaggacaaccagaactacatagtgaaactctgtcctgaaagaagcaagcacaattccctaagcctcgcactggctttactaatgaaagtgttcggataaactatagtattcttataaaaggtgcaaagtagtctcacagctagaggaattatcacaaagcaaataagtccttgaatgcagcagtttggtccagatagacaactcgtaagtgtacaattaattcaaagcttccatatgcccttgtaggtacaatgaggttcatgctctgtgtacttcctgcagacagaatctgtcagcaggtacctctgctgtcttttgcacagcattgtttgtgagagtccattttttttttttacttgtagggtttgcttatgctcactcctgaaccatcagtgataaagagattgcaaatgcatgtcctctgtactgttgaggagcacaggagttcctccctgagtttggcatctgtaaatagggctgcaatgaatattcctgtccatgcctaagtgtataatttcaaaggagtacgatggtggaattgttgatccagagaagaaacacatgttcagattttgtagagtttgagaatgcttttctgaagtaattctactgatgcagctcttacagttttaaattagaggcctaaacatgcacatctctctaatactcagtaataccagtcttttcatcttacccatccaggtaagagtcataacctgattttgtgaatatttagcaaagcattttttaaaatacacaggatactttaaaggtaatggttacacatattcaaactgaatagattgtagttttattatacatatacatgtaacatacatacatacatacatacatacatacatacatacataacaacaatttaataaaaagaagtcaagaattgaaagagatcagggggagatggtacatgggagagtattgagggagaaaaaaagaaaggagaaatgatgcaattatattatataaaaaattaaaaataattaaaattgaaggttaccaacagttaagactttgctttaagatgaatgtattctatgaggaaaactaaagattttactatataatatcatgttctatagaagataaatgaatacatgaatgatagattatacatgatagaaagataagtagatagacacatatatacatatatagaagatagatataaatagatgataaataaatggatgatacatagaggtagttatagatataaagagatggaatatatatatatatatatataatagatatatagatagatgatagatagatagatgattgacaaatacatagactgtagatagacagacagacagacagacagacagacagaccgatagatagatactggtggaaacacagtcattatagtcattaaaagaacagataattttaacagtcaaaaatgtggcttgcaatacaaataatctgatttaactcttagaactcccactgacaaattgagtgatcttggtatataagtttgcctttgtttccccatgtgtaaaattgtaataacaacattattgtaccccatagtttcttggtgaaaaaataacctaatatacataaaacagtaattcagtaaacaatgcaataaacagtagacaaatatcagatgttcttgctattatacctaagcctgtgtgagatcatttacatatatccacaggttaccaagctattacctaaacttgtaagaatcaggtgtcgttaccctctttcttcttccttgtcccattacttgtctaagaaaaacatcctatgttaaaaaaaaatgaggacaagatagtaacatctaaagctgggtgttggtggtacacaactttaatcccagcactcgggaggcagaggcagttggatctctgtgagttcaatgccagcatggtctacagagcaagttccaggacaggctccaaagcattacagagaaactctgtattgaaaaaaacccaaaaaaaatgatagtaacatctaaaatatgcaaagaactctaaaactatgtagtaagaagtcaacccaatcaataaatgagcaattagataaatggacagttcttgtccaggtaactcatgaaaagcatcttcagcacctccagccatccaagaaattaaaatgacattgcaatttcatcttactttaatcagaatggcaatcattcggaaaacaaagaaaagcatgttagtgactatgtgaagagaagggaatggttacacactgcagctggcaacataaatcagcccagtcacgagggttcttagaaaaactgaaagcagatctatttacaacacagttgtacctctcccaagtatttaccttaaagattccaaatcaacctaccagaaagacatctatgtttactgcatagtaactaagttaaggaaacagtctagatccccaaacagaggaatggataaagaaaatgtgctatgtatgcacaatgaaatttttcagtcatgatgaaaaatcaacctgtttgtgggaaggtggatgtaataagattatcatattcagtgcattcaatcatatttagaagagcaaatatcacacattttatctcatttgtagttcctagatttcttataactacatgacatggaagtagagctgaagatgtccataggaaaggaaaggtgagagaaagtgcatagaaaggcaaggaagagaatatagtccaagtacattataaaatccaccatcgtatgcagtgagtatactccagcgtttactaacactaacaaaattgtgcttataggtaagcacaattgttccaatattccattagatttgttaggttcgtaacaatgttataaaaaacataaacacattagagtcaattttcccaaactcctgaacttcaaataaagaaaatgagatttggatacattaaaatgcctggtgtgagattatgtagataattagcaatgcatataaagtccagggaccccccagcaaggagttcagttatatgtgcaataatcttcttcgtccatagcatgaattagagggccccaaaagtcaaggtccctaggtcagagtcagaagaatgagtctcaaaactttttagaaagggaagagataatattcattaaaatgtaaataaatttaattaccaaactgcaatcttacatatctcaagatgtcagataaattatttattatttttgtgtacattaaagtgagttatggggctgaagagatgacttaatggttaagaaaacttgctgctcttacagaggacccaggtttggctcccaaaacccacatctatcaagtgactcacaactacctatactctagtgctaggggacccagtgtcctcttctggcctctgagggttccttaattcacacggtacacatgcagaggaacaggcacacacatacatagacataaattgaaaacttaaagtcacaaaagtaagtttataacatcttatccaattagtaagatgttgttttgatcacatagcttactacaaaaacactttcagaaatgcaagctccatattttctaaagaataaacacaattctgtaaaatactactacaatcttctatactttttttactatactttatatttactcttagtgggacctccagtgaaacctcttagtaggacttcaagtgtaacagactaaaagtaaagatcattgatttttattccttcaatgatgatagaagattcttgtattttgaattgcctttctagaatgcatctgttttatagaatgaaaataaattgacaaatatgaaagttaaatacagcaaaggaatctgcatagttagaattcttttggtatcagctagactgtgaaccaattaataagaacaggttttgttggacaactttgtctatattgaagtatgagccataattaagtacagcagcaccacccttagcaacacagatctttgtattgagatgtagaaatttcagggtttgttcccagtatgtatatacaagtaagatactctccatttttttctcctgagctctcactctcttgttcaatccacccaaccatgaaacttattgcaagcgagcagcctcttcccatcccagccagaagtaaggattgtggtttctcagaaacacgcatgagacaagagacagggtgcagtacaggagaagcatttgactagctgaacaataaagttgccacaccacttatctagtcttattttcctttagcatgttttcaactttttttaatttgaattagagacaggattggtttacatgacaatcccagttcccttctcccacctgccctaccaccaaccccccaactaaaatcctatctatcacatatcctttctgctcccctggatggtgatgccttccatagggtgtcatcagagtctattttatcctttgggatagggcctaggcccacccctgtgtgtcttggctcagggagtatttctctatgtggaatgggctcccaaaatccacaactgtgctaggggtaagtactgaacttccaacaggaggtcctgtagatttctgaggtttcctcactgaaacccatgttcctggggtctggatcagtcccattctggtatcccagctatcagtctgggcagcaagagttccccgatgttctggtcagctgtttctgtgggtttcaccagcctggtctggacccctgagctcttcactcacccttctctgaatctgggttccagttaagttcagtgattatttgtgagtgtctgcttttacttccaccagttgctggatgaaggctataggatggcatataagttagtcatcaatctcattatcaggggagggcatttaaggtagcctctcctctgttgcttcgattgttagctggtgtcatctttgtagagctccagacatttccctagtgcctgatttctctgtataccaaaaatgcctccctctattatgatatttccattcttgttatcatctattcttcccctgactcaacctttctgctccctcatgtcctctgcatccctcctcatctccacttctcattctcctagatccctccccccctcttcctgagcaaatttgctcccaatttgctcagcagatcttgaccctttccccttctttaggggaccatgtatgtctcccttagggtactccttgtttattagcttctttggcagtgtggattgtaggctgataatcctttactctatgtctaaaatctgcatatgagtgagtatatatcatgtttgtctttttgtgattgagttactttgctcagaatggttccttctagttcgatccattttcctgcaaatttcaagattccattgtttttttccgatgagtagtactccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgctggatcttgtggtagactgattcccattttcttgaggagtcgccatactaatttccaaagtgtctgtactagttggcactcccaccagcagtggagaagtgttcccctttcccacatgctggcataactggttgcagactgtagaagactgaagttagacccaagcctatcgccttgcacaaaacttaagtcaaaatggatcaaagacctcaacataaatccagctacactgaacctattagaagacaaagtgggaaatacccttgaattaattagtacaggagaccacttcctgaacattacaccagtagcacagacactgaggtcaacaattgataaatgggacctcctgaaactgagaagcttctgtaaggcaaaggacacagtcagcaagacaaaacagcagcccacagactgggaaatgatattcaccaaccccacatctgatagaaggatgatctccaaaatatacaaagaactcaagaagctagtctccaaaacaccaaacaatccaatgaaaaatgtacagaactaaatagacaattctcaatagaggaatctaaaatggctgaaagacacataagaaagtgttcaacatccttagccatcagggaaatgcaaatcaaaacaactctgagataccatcttactcctgtcagaattgccaaaatcaaaaacaccaatgacagttcctttaacatttttattacaccacttttcacacctctttaaaagctaatggaattatatatacctgagctcttactaactaaattctgagttgcttttacatattctgagaattgctgtatcatataactatccacttatgcacccattaattgattttattttgtgtgggggtgaacacatggacatgggggtgtgtatgttcagatgtcagaggacagtatcctgtgttgttctttgagaactgttcaccttattttctgagacagggtctcccactggtctggaaattgcccccaggctaggctggctggtcatcaagtacctatacatatgtgtgtacctgtgtgaaggccagaagttgacactgggcatcttcctcaattgctctccacattatttttttgagacaagagactttcttgttgaacctagagcccactgacttagcaaggcaactgtctagtgagccccagcaattctctggcctctgcttacccagtgctgggattataggcacatcctcctctcatctagccttttatgtgggttctgggcattcaaactcagatcttgagggtggcacagcaagcactttaccaaatgagtcatctcccaagcccctggttctccagttacaaatgcatggtctgtacctcgtgagaaatctttggaaatgcacataactgtacagcccaaaccacaatctatcatcccagcatgcctactcctgctgcttctcagtgtctaaccattatccacaaaggcagccaccattccaacattttcatcacaaattaattagccaagcacagaatttcatgagtggatcctgttactcagcatgctgccttatatatgaggcgcattcctgtgcatcgctgaaaagtattccactggagttttgtaattctgtttgctgatcatttattttttattatatttaatttttataatttcaagtccttttagcatagaagttcttttccattttattaaacatgcattcttttgtcatacaatatatactgattacggtttctcccccccccccccccccccctcccttcttccgcttcccccccccccccccgctccctctactcctcccagttcatccccacctcctctctcatctcgattcactccctttctgtttctcattagaaaagaacaggtttcaaagagatagtaacataaaacaaaaaaccatcatatccaaattggacaagacaagtcagcagaaagagccccaagggaaggcacaaaaatcattcacttttaggagtcccataaaagtactatactgcaggctatagtatatacacagggggcctagtatagacccatgtaggccctgctgcttcagtctctgagttcatatggtcttgctaagttgttttaaaaggccttgttcttctggtgtcctccattcctgtctgcctcctcttccatggacttccctgagctctgaggggaaggatttgatggagacatattgtttagaactgtgtgttccaaggtgtctctctgtgtgtagtgtctgagtaaggcactgacctgtgagtacaacagattatcattaggagtcattttattgttactcttttaaagaacaatagcacttggttttatactaggtctctggtctatctaggttctgggtcttcattgacaaagcattgtcaggtatgggttccatcacatggagtgggccttaagtcaaatcagacaccagttggtgtcccacaaggtttgtcctagcttattggtatttacatttctcttttggtatccttcaagagtacctttgccatagatgtagaacatggggaaggttctatgtaggtaccagcttgacctttctgtggttaatgagttgtgtgtatgctgtttttagcaatgggaccgaccttactgtcagtttgatcattttgatgacaacctgggttgcttgaggatttccatgggacccttttggccaataactcaattggatgaaattcagtccctgtactggaagtttcatttgatgaagagagacagccagtagggcctaatctcccttatttgtagacttcattaggatcaccttcatatattataggaagtttccattgcactaggtttccataccacccctcaaatacccttcagttctaactgcctttccctcattccctccctcaattctatttcctctaccccttcccacctgatcctcctgttcctatctccacctggccccagcccacccataaaatctattctattttccattcccagggagatccatgtgtcctacctagtcatttcctgcctctttgggtctgtggactgtagatggttatcatttatttaacagctaatatccagatatgagcaaatacatgccatatttatgtttctaggtttgggtaacctcactcaggaagatttgttttatacttctatccatttgcctgcaaatctcatgatgtcatttttagcagccgagtaatactctgttgtgtaaatgtactaattctctttatccattcttcagttggttgacatctaggttgtttccaggttctagctactatgaatagagaagcaatgagtgagtgaaaacagcactaagctagccctttcacattctcatgttagtcttttgaggacggcaaagatttaatttcttatgaatatatgtttgttaactttcctttatgaaaaagaaatctagacagtcccagaaaactttccaagggctgagaccattttgtactgttacctacaaatgtggtttgtctagatggcccatgtctttaccacttcggtgttaacatgttctttttttttttaatttaaactagataatagcttcttttaaaaacactgtatcacatttcctagaaagcatcaagaggcagctaagctgaagtaaattttaggtaaagtaggtaaattaagatagtgatgtaagcacacgccatggtttggtaagcagtaaaatggctgctcctgggtcacctagacatgaactactgaaataatgaaaagccacattataggttctctcctacatgcagtttcttaaagattgatttctcctgattctctatatctaccatgttgttgaattgatttcagaaactattccatgttgcagacactaagtttcatgactggaagcagtctgtgtaatcttatctccagtgcctggcatggtgcctgggggccaggaagcaatggataagcgcattatctttacatatgattatctgtcaggtcatgtccaccatttcttccctagacctttcttttgggggaaaaatggtgaatgttcatcgggttgctttgaagcataataaatacatgtcaagtattttacaggattttaaataaatagcacatgtcaccaagaatacttaatgacttttcctacatacaagcatcattgtaagacttgttttaacttctgtgtcttctctccctttttttacttacagaatctgatgcaatcttgtggcttcagttcttgccccggtctggaatatcctatgagttctatattccccaaggattactacacattcacatttaatcataaaactcaccatgtcttcaaatttggtatgtctgaaatcaaatgctcctatttcattcctactggaacttccacatacccaagcagtttgtgtaacatatttctgttttactttccttcactcttctgttccaaatccagtcttctcattctgatcactacttacctaaaggaagtgtcctcgggatagcattccaatgagatgctttggctcttactctctccctatgtttatttcatacatttgtcctaatctcactaaagcattttcccagaccttcagaatcttcccatgacttttcattgcttgttgtaaattcagaacagctaatctaatattgaaaataccctaccaagagtcctgctcaaggcgtgcaatctcatttctgtgacctttttatatttactcacttgtggaaagcttcagcagctattgccaacagatgacctatgactttggaactgcttacaccagcccttaggtaggagtgcatcatttttcatttgaagtccaaattctgtctcatctaagttcaagataaaagccacaaatcatccattaactgaccaacgtcatttttcacttacctgagcattgctgtgtttatatgcaaatcatcacacttctcagttcatacattgtatactagattttatgcaatttattaagtggtgagtttagccagtgcagtgaacctgtatgtttcagaattagacagaagttctggtttagctcaactatttacaaataattaatcttaaggaaaggcgttaaccccaggcaaattatctgcaaaagctgggataaaactaatcacatttattattttaaagattaattatgcataaaagttctctactacacagctgacaggtatttttcagcctttatatgtgcctgcaaattttgcatgctaatctcatttagcgctcatcagaatttttcaaaatagatttaatgccatttagcatctgaagaagcagaggctcaagtcaatctgcagtttttgagcgaccacagacctgtcactcatgtttacattcctagttgctccatgacatgtacatagagttgcctaatgaactaaagcactccaaattactgaatttgaagcaaatctagattaagaaagtatctacatgagcaagtcaatcttaattaatgttttatgttatattttgtgatgggaataaaagccacagatgcatactaaaagtgattgcaaatatggacatggtcttgaataagtgagaaaggaaatgaaaaaatggtatccttcttggacaaagaaaaatcaatatatcttaggtaaaataatcccaaactaccagaaggcagtaatgacacaaaagacctggagaaaagagcagatgacagatgatctatgggcttgcactatgatacagaaataggaggatgaaagcaaaaactaatgtaattttgctgtaagctcaaagggatcatgatcctgggccaaattttacctccaaagcactggtcagttctggatatcatcgtgtgtaatagatataaaacactggaggcagttccaaggaatgcaataaaagtgagtccaagaatagttggatgtgggctgaatctgtacattgcctctgtgtgcaaatggactgtaaaattcagtctcaaccatttatttccattaacacagcagcagagaacagatcggcttgaagaatcaaaccattttgcaaacgtccacatttgtgcacacagacttactacagttctgaaaaaatcagtgtatcgtttcttttcagagtttaaaagctaaagatatgagccattttccagttttgtctagatatgagacaagaagaccagtataagttttagttctaatgaaaaatttacctgctctgaggtgtatcaaaaattgatacaagaagatggaggtatgttcctaaagaagtagtgtggtaatgtagtattttcagagacagaattctctggccatttgcctgcatttgtctacctctgatatgcatatagctttgtggcccttggacaaattattcactagattccagcataggcaaacaggattaataaacacacttatcacccagggatggcaataatcactgaacaaactaatagaatgaacttgaggatatcgaggacaaaattagtatttatcctagatagtattttcaaaataggcttaaaatcaaatggtaaagatgttgactattagaggaatacatgtaaactttatatgtaaaatgtatactcattctgggttcactttggagttgcacggttacttgatatgtgatctatgagataacccctgacacagtttgactatgaaatgttcctccagagcctcaagtatacacaaagtggtccccaaccattggatcatgggaactgtgacttgatgaatgaaataatcctttgatggacttgccatggtgaaaaatgggaagtgagatatagtcagaggagggaagtgggtggggtccaccctgaaaagatgtaccttgttctagctccctccttttctatcctgcttcctagaaaactgcactctgtcataccttcatggcatgctattctgtagtaccatggcccagaagcaacagaagcatccatagactgaaagctctgagtttgtgagccaaaaattctctatcctcaactaagactatttccatctagtgtttttcacatgtatgggaagtctgactaatatgcttttgctttctataccttatgtgacaatatttctcttcttctgtcagacaatttttgataatcaagttaataggcaagaaaatatgtttattttactgttgttgtcacagacacacaccagaacccccagtgcttcacatatattcagttaatgttaatattatattaatttaatttaaaaagacattttcaagtaatcattcaaggtaattagtagtaacatagaggaaaggacaatccacacatctaacacaaagcagttctgtggttctgatttattggctggttttgttttgattttccagataatagcctccaattttcacttttgcacagatgtaattaagtacttgtatatagatcaaagcaaagggatttgtctcattaagaaaagaaacacattatgtaaagttattaaatgtaaattatacccagtgcattatatatcatgctatcagccatcaagtttcagttatttaaaaagtgggaccaatagattccacccaaatgcaaattcacctcattctccaatggacccagtttttttcctatggtattaagcataggaggtcattaattaccaatagcaaaaacagcattgaaagcattggttgagtgcaagcaatgtgtcagacaaacatggtacacttctcacagttacatgacatttttatattaactcgtgtatttaacctttgaaacaagtccgtaaagtaaaatgaatgtcattatttccattctaaacttgaagaatctccacagacaatgctgctcttagtactcaatctgaaacagccttctcattaaagtcaagaatgagagaagaatgtctcctttgttcattcttgtgtagcaatcttctgaaatctccagctaatgaaggatacatgctacaaaggggaaggcaaaaattattgtatttgcatagagtgtttattgttcaatatagaaaattcaataaaattatctttaaaaccaaatgaggaaaaaaaaaaaccaggcagtgtggctgttagatttgagtcaggcttccaaaaattaagccatcttagcaaacagccacttctgtgtaaagtgaagtgacaaaggcacatggcaattctccaaaaatcatcaggaagagccctctcctggccatctatcttgccatgtgtagagaatatcttcatggcccagtggggcttctgcacctagcaatcttatgaatacctgtgcagaagggctatgacatttcaagtcattggttacaatatatatctccacagtgaatagttaaaaaaaaaaaagctgaaaaatatctctgctcaggaagaggatgaccataggtaaaactcaagaaatcttttgaggatgagaagatgccccctacagtttttctagttttatttctgttgtgataaaaaaaaaaataccctgatggcaaggaactcaagcaagaaaggatttaatttggttcacagtttcaagttatagctcatcactatggagagagtcacagtagaagccagactctggtcccattgtatccacagtcaagagcggagatgaatggatccatacatgcttaatactctgctttctcatctcctatgcaaaccagggcccaaatcctggaaatggtacttcccattttcagtctgagtcttcccacatcaattaggacaacaaagacaactccctccccacagacacagacatgcccactcgacaaactgatctagacagtccttcacggagactcccttcccaggtgagtgtagatcttgttaagctgacaaaactaccatcacaagagtgcagaatggcacctcttctcccaactagagtggatgctgcccctgaatttgctaattcccccttcccatgtaaacatgggaaatttgcctccctttcctactttctcccatgtgaaattctacttaaatctatactttctgatttatatcctaattaattgatgtctccctttctacatcatttgctgttttttttttaaaattacactcagcctctaatttaccacatccccaggtatttactcttcctagatagcttcaactactccgtgcattttatacttttttgtgctaactgactactctgaaaacttgtcttcacttgaaactctttcccttaaatcaacgtgcttacatataacttcttaatttatatttttacttagatgttgtcctatttcatttctgttactatggttaaaaaaatctgacaaaaatcaatttataggaaaagtggtttacttcagcttaggttacaatccatcactgtgggaaattcaaggcagaaacttcagatgcacagtcagcagcagagggaatgagaacacacatgttcacttgtttgaatgtgttcagctcaatatctctactcttctacagttcaaggcctcctgtctaggaaacagtgctgcccacagtgggctggctcttcttcccacatccacagactgcccacaggccaacccacagtaaacactcctgactgagactcttctcaggagattttgagctgtgtcatgttgatagtaaaaagttaacaatctagggtatcccagagtagcttcagaggcaataaatctcaaacataggccttaatttgcaattccatgaaaataaactatacaaaatgtatggggtcaacaaaattagtacctagaaggatatctgaagcctaattaagacatttataaagcatagacaagtgaaaacttaataacttaaatatctaaatttaaaaaaagagatgagcattgaaaaactattaatctgtgtagataatctaaaacaattagaaaaatagggcttggcatgtagttcaagagtagagcagttttctatcatgcataaagcctttagtccgatacctagtaccataaaaaatattaggaaaaagaagaccatgaaattaaaaggaaggatatttaaaataagggtataattgattgataatttttgattctgaaagtaaagtagagaaggatcccaaagggggcaaaatctacagcctcctgactagagtaaccaaggatacaggtgtcagaaagaattggaaaaataaaatgaatctgaagaaatggcaggtccaagtcccaaggtagtcaagggccaacccaaggctatgtatgcaataaagcttaaagttgaaatcagggttttatttatttttctaagctcccctgtaacacatcttcagaaaatcacctccatcactgtgctggatggaggagagagaaaaccagtgagcactcagtgtttctcattctccatgtgtgttttacccatctctagataatgatgaaatcacacaacacaaagatactttgcttttggaaatcaatgctttcagggttagacttggaaactgaaagaaaagagaatcctgaatatcaacatcatcctatatcccttgaccatcatctgtgccacatcactgtgacagcagcaagtatgctgcagacagtcactcaggaatccacctgtgtcccctagcacagatccttcaagtccttgaatctgttatatcttcccataatcagtggtagacgtttacacatcaggagatgcccttctacactgatagtgatgttgctagacactcttgagctcattgaggtatgcaaactaccacactgcagtcaactctgccgctgattcattttgccaggagcaagaactgagactctcaagcatctaatgagattaagtcacatatggcagcacacacctgttatatgagcactttggagatagagacaggaggatctggagttccatgaaacactgataaatattgactagggcacatcacactctgctgcactagcccttgacttggatttggtcatgtgactaacactaagtggaatgctcacaaatgtgcatgctgctaatccctggggttcttgtttgcatccctgtagtcctggatagaaaatacatgaagatgttagttctcaaagggaagaggctataaaaacaaactataactcacactcagcctgactccaagttcaactgagcctagccaaagatcagttgcttgtcagctgacctcataagcaaagactacatactatgtttagctcactgaagggtatgtatatgttcatgtgttggagattgggagggtgagtgtcatgtgtaggtggccacagatacatgcacatgtttgtacatgtgaatatgtaagccaaaggacaaacttggttgttgggcattgttcctcgggagtcactgtcaacttccttggttttgtttgtttgttttttgtttgtatgttcatttgtttggttggttttggaaacaggatctccttactgagacattcccatgactgttaatttcatagaattactctagcagcattttatgaccatattacctatcaggtgtgcgtcctatgacatccataaccatgccattattatgacagccacaataaacttcacattaaagaagtcatcactaagtgatagaacacttgcctagcacactcaaagttcctgggttcatttccagtagaagggagagaggggtgagggagggagggagagagggagaggggagggagggaaaagaaaaaaggaagagaagagagagaatggaaggagtgagggacaaaggaagagaagaaagaaaggagggaagaagtcatgtttcataatcagagaatactaacaagaatggagctgaacatacataatgtagatattagaggaaaaacatagggcttaacaacactgattttgttacaaataaatgaagtccttttcagtatatagtattgttatatctgctttggagatcataaatcaggcacagcaattaaccaggaagtggcaaaaatgggatttctgctgagatttggttctaaataccgtgtgccaccagtaagtaagggtggtctcaaatattctaatgagcagatgcacaaagttgtctctacagtttatgggatgtcagatatcattcagaaattagagggctttagcaagagcctgtgggtcacttcaagatactatgccactcacttaggtagccctacttcccctttggaaacatctaaaagtaggttgaaagaatcctaataatattttctgatgaaagttctagagcctggatacagtggaagatcttcactaagaagagctcaaaacactcaccctcaagacatgaactaataacagtctttgccaaatggcaactagagtttttccatggacattgccttgtgaaaattgtctatatttaaaacacatgatctgcagctgattcaggcatgggtgataacctgatcattggatgcttggccttatgtaaaacttattgtccccaagtcaatagagcattgtagagttgtttcacttaggtattttacagagaatacaaattgcatgggttacctattctctagttcaaacatttggaagtgataacatcccttgtagagattctcctgttttccatccatgtaacatccttactcatcagagagttggagggtttctaagtttggccccatctgggtattgaaaggaagaatattgaaagcattctgggcaagagtatcgcagttttgactgccaaatgaagctttcagtatgcaaaatgatacccttttcccttcctgttccattatgggacaatccatgcacagagaaataaacttagtatccatccttgaggccaaaaagataaagcttaatctaagtgacaccaattttaagctgctctcaagatagcagttcaaagttgtgttttaaaagcagggtgactgaagatttcaggttgggaaataaatcattgagaagtacttaggcaagaacatagtggtggaggtgttggttagggttgagccattccacaagacatatgtgtgggataactttcagctgaatgatttgaaattctcaaatcagaagtttcatctgttacaaattatgtacaaaccatttatagatcctacagcttcttattgaattatgctaattttcaacaaattattatataactgtatcagtagatgcaattaacatgatgtagtatagaaacaactcaaacatgccatcatctcaccccgcctgaatatctaacaaaactggaattcaggaaagagtttcagagaaattaaaatatacatgagaagaactctaccaccagagttctagagttcattggttcaagttcaaatcaccagcacccattcaaatggcagatagatatcaagatctgcttgtaatcccagcactcctaaaacagaaacagggggtttctgaaccaagatggttagccagagtagcagaaacagcaaactctgggttcaacaagaaggaagacaactgatatgtgacctctacatgcatactttcatgcttgacatgtacccacacccagcaggacacacatacaaacaagcacaaacaccatacatacaactctacccctcaaaaattactctctaccctcctctcagatcccatttattcttgtgtttaaatatatgtaaataattctgagttttatagtctttgtaatgagtattgatacttacaatttttagactccaatttgagatgtcttatgtttttacaaatataaattttaaaagttggtggtgtattctccttgggtttgtaatgctggaggaattaatgcaagaagtatgttctcttcttcaaaagactggacatttctatttcaagaatagcagatgcacaaaacaactaaagaacaaaatacagttgctctgtttgatcacatggagcaaaggaatggttttggccagtctagcatgatgaaggccgtgacaacatgcttcagcccatattccccttgtttgaatattagtgctaatgacaaggaatcaatctggaaagaacattttacttttactacaaacctttaccatcttcctaccactttccatgggaatgacatcattgggggaaattatatgtaataatcatttctttattgtagacagaagtttctgtcctgctcaggtcctgcagttgtttagtcccaaataaacacacagaggcttatcttaataataaactgtttggtcaatggctcagacttcttattggctagctctctctcttaattattaacccatttctattaatatatgtatctccacgtagtcttgacttgctggtgttgtctcttgcttcctcagtagctacatggtgtctccttgactctgcctactacctttctttatccttgtttggatttcccacatgggtaaatcctgcctgtccactggctgaaacagttttattcatcaaccagtaagagaaacatatatttacacccatcactttaagccttcacagtatatgtaaagtcaaccttgaaagccagtgctttgcccttcaagttattggaaaatatacaggcttttcaggtcacgtgatcaatgtgactttataaggcatctgaaataaaagccagtccaggatggcttctgcttgacactggaatctgctcctgtgcagaaaactaagcagtctgtgaaaagtctttcttccctgcttctcgctttctcactagcttgtccctcccccgaggtcctggatttactctgcagcttgctgatacatttccaccccaattgatataggagtccctcttcagaatgcactaaaagactcctctgatccaaaactcagacaggaagaattaaataatcaaagggagagataaccacatgctaatttttcacctcaaattaggatgtctgagaagcatgttgatccttctagaaccttcttttgcctacacagtgatgtaaagctgtactataatttggacttgaaatgactcctgaaaagtccctgtggaaaggctttatctccagtccagtgatatgggaatgggtgaacctctaagatattcagcctattgggacatggtgagttgttgaagaactggctctctaaagagataatgagacttccacctccatcccttcctacctttgactccctgagcaccaaagtggcagttctctcattctttcatactctctgccatgtgttgccacaggccctaagtattagcaaatacctgaagcctcttctctttgtaggttgctcattaatttcatttgttacatcaagctttgtacacaaaggcaggactcttcccattctactgctgctttcttttgggagagcaagccatgacctcatgactacactatctaacagtagccaaaatcagacactttgctcttgggattgctatgtttccaggtgcagagttctccatatttgcagaacaacatacatcatgatcttctatgacaccatccagtgtctgtctaaagctgtttttttgacgtttagatttctagtcttaaaacacacctaaaattaaatttttgaaaagtttgaaattctctgaaaatttcccatataacaaaagcagagttcacaaaaaacagttgactttggagtagatccctattttaagatttcattctattcaaaaacatcaaactgaaaaaagaattatgactgagggctgaaatttaaattaccctatactttcaaaaacaacttctggtgtgaggtgggagataagatatacacttatcaagagattccatttttacattggtctatgctattgggagctaaagggcttcttttaaatttggaacaagtaagataaaatagttgttattcttatttttgaagtccttgaagggcagatcaaatgaagcttatccatggtaataatgattgatgagtttcatctaataatttttaaatagatgcaaacagcagtgaagctccagttcggggaagggcatttggaagaggcacaaatagtgtcaattagcagcatttcagagcagggatcttaactctagcattgtataaaggaagggggttaatgttttaattttcaacttctgcgtgttcatctcagctgtatcaattagaaatcgtggatactctaaaatttagttagtttataagaaattcaaatctcactgcataaaatgggtacttgcttaattccttcttttcactcttgattttaaattctatgaggttagagacctcgtctctggttcctttttgttgtaaacgtgttcagcataatgcttggctctcgctaaatgaagactggctatgactgaaagaatgaagccatttagcattcagtggattgatgtgaaaatctccagtggtgcaggtgttgttcttgttgtacaggggcaatggtgggaagacaggaaaaatacccttcctttgtggagtttatattctttctgatgaggaaaaaatttcaaaacaaataataaaatgatacaaaaacaaaatcttagttggagaggaggatggagtattagttgttggggtgacagaaagggtggagtattagttgttggggtgacagggaggatggagtgttacttgctggggtgaaagggaggatagattattaattgttggggtgacagggaggatgaaatattagttgatggagtgacattgaggatggagtattagttgttgggatgaaaagaagtatttttgttggaattttcagaaaaggtgactttggtaagaagataactttcaaggggagatctggagaaaggggcctgctccccaaagtacagtcatagaagaaatcctctacacagcaagtgcagaaaatgccaagactctgaagaggagggaacttgaagaacatagtatagtggccaatgtgacaaactgcaaacaatcagaaggaaggaaggaaggaaggaaggaaggagggagggagggagggaggaaggaaggaaggaaggaaggaaagaaggaaggaaggaagggaagatgacatcagagagggagataggagggaggggtcatccaagacctgttacttaaaacagagactcttactttcattctgagatgcagaaaggttctgagagaaacatgacatcacgtgacttatttctgaacagggtcactctgtgctgttaatacactaggtgagcaagggcagaatcaaaatatagatggctcatatgtgacaagcacagacctggtactgaatcaccttagtgactaaaggggagctattaagagtctcagaggaaatggttgtaccctgccaacagacataaatggaggacctgggttgacacctccttcatggagcccagagtcaggcagcagaatgaagtgagcaacagttaatgaaaagaagagaaatcccttcctctgaggacttactcaagctaactccagaagctaccctatttaacattcctgccctgtgccaccagctgtcacacacttaatggcaaggcattaaatggttgtaaggaagctgggaattcagattttaccgagatggctgtattgaaatttcacagcacggtcatcaaagagcagctatttacaccaacatcttccaacaaaatacacagtgctctttatacaaaccctggatctgttttcttgaggaaaagctaaaagcttcataaaatgtgacaaaactcatgactttgattaaatttctcctcaaaacacaataattagacatcaactgagactctgtcccagagaagtaactgattccacttttacttctgggataaaacaaataaacaaacacaaaaccctgacagtgggatagaatgtgtttccagtggcctccacttggcaaacaagcagctgagcagtcagtaacctacccttcctttcctcccactcacatgttggaagtattccattcctgggactgcccttgccttgttgctgctctgagaagcgttgcaggattcatccccagcagttacctgagcatctgttttgtcctattgtcagtggtaattaccagggagaagtcaaatacacattgatttcttcggcgcttactttcgagtacttgtggagtttaagagaggaagacgagaagccaaagaagagttgcccatcttcctaaactgcctctatcagtgatctccagtgagggaaaatggacaacaaactggaatctattcccccactacagtatgtgaattgttgtctcttatgtagtactaagcaaagggaagatgggagaccaacggcttgttctggagtttttgtgggcttatactggaaatttgtacattgtaaataaaatagaagccaagactatcaaggttttctcatttttaaagtatcttctaacaccttttaagttttgttattatttttgtccccacagtgacttcagtttttccagttgctccattgtttggggcaactacttttgagacaatgctcatgacagttggctcgctggaacaaatgagagctattcctggttgggggagaaggttttgctggttctgttttgttaccctctcttcttctagacaaggaatagaggtcagagttaatactagagtcagaaacagcactaccctctatagagttcttaaatgaatgagcctctgtcataggagaggctctgtgtcttcattgcctcaaactactctgttacttacaggccaaagtagtagtacaggtacagcatggagctgtcatgattctgggcaaatgcaaagtttacttgcagtccagattctaaacagaaagaaattcttccagtcacaagatcttttgaatctattccatctgttaaaagccatgagaagagttaagttgcatcagcccagaattctcaccaaggcagaaaacataaacacacaactcagcttagaggctcatgctccatacccctatattatgggatgaccttgtgtactaggcagaatttaaatgagtatgaaaataaatattgtattttagaacaaaagtttaaaacataatgtcagaagaccgcttatctctaggacaaaacaatgaaggacataaagcaataatccagattgattagacatgttccctaacacttctcaacctatcccctagaaacagaagagactggtaacagaaactgccttgtatattgtatgttcttttctaccataagatgtatgctgcatatgtatactttcttaaagattttcccatcatattcagcaggaaattaagccacaaatgaattctaaatgtggttatctgtatctctactgataaattaagattccctccacagtatacaaaaagccatctttagaaagatggctgccttagtggttcctattcttggaagtgtacacctctagaaaggcctttgacatgctgctatgaattcaattatttttttctccctgtggttgtttgaaagaaggtggcacccaaagggagtggcactattaggagttgtagccttgttggagtaggtgtgctcttgttggaggacttgagtcactgtggaggtgggatttgaggtctcatatatgctcaagcctcacccagtgaaagttcactttctgttgtctgcatgatacagaactctcagatccttctccagtaccatatctgcctgcatgcagctatggttcccaccatgatgataatgtactgaacctctgaactataagctaccaccatgaaatgttttcctttaaaatagttgccatggtcatagggtctcttcacggcaatagaaacccaaactaagacattccccttgatatgggctgtccttgttgcatggcttatcaagccaatggcatgaagaagtgtgacttgagaaatttccttctagaatgcctggatcttcttctcttatcctgttgctgccctgacaagtaaggaagtctggcctccctggggttgcatcacgaggaaagagactttatgggataggcccaatgatctctattgaggcctcagatgtgttgcagagactacattcaaacagtgcattttcagccaactcaccaacttacaggagccctatcacagacactatgcagtcgtatagaaatacagcctatgcaagaaacctaccttaaagcagccttgatccacatacccctttcttacttgtagtatgttcaacatataaatacatgattcagaaaagactccatgtactctgaaggaaggagccaccctagaaggaccatagcttctccttagtagaggacagttggttgtatcccatacctgttccccctcatctgaagagagcatctggcaaagagctgggttgcttggaagcaggtgctttggggccaggccttgcctctaattaattttctgcttctaggtccaccaagattggaacaaaccataaaataatctcccccagcatgggtgaagccgctgcagcttgcatgccttccccaccatgatggactgtgtcctcgaaactgtcactcaaaataaatcctttctcccctgagttgtttctgtcagtgtttgcccacagtgataaagaaagtcactaatgcacatacaaatccagtttgcaaagcctaagccagttatataaaagggaacgtttgagggctagagaggtggggtcggcagctcttagagaggtcctgccttgagttccctgcacctatattgagtgacccacaacttcctgtaactccaggtccaagaaatccaccccctcttctggcctttgtgaacacctccacacatgtggaattcacacacacgtacacactttacaaaaacaaatcattaacaaactgaactcaggaacaagcagtgagcaaacagctttctttttccacatggttcattcacccaacctttctctacggctctgtagagcactgggttcaaattctgtggattctagatcatactcagacattttaatttttaattccatgctctgagttcattcatgacttcactcctattttaagtcctcggtctatgtgttctagaatccatgctaaaatttcaccccagccgttgttgtggacaactgccctgtgcatcaaaggcagcttagcagcgtgtcctgttttattgagttgatcccagtatgactttccccagtttgagcaaccaaatatacatatgttatcaaaatttctcttgggatacaaaatgctccccacttaagatttattgctctagaaacagcattcttaataggggtgatattgccctcgaaaggacaaagggctggtaggaatgcaaacatttctcagctgtcccagtgatgtgttgcccctcaaaaggccaaagcatatagcatacaatgaatccatagcacataatgaagagcaaagaggagaaagcagttaggggtaaaggtcagacaggtcttgtggagaacagaaatgataaatgcaggacaaacgttgcttttagggcaacggtgggatgcaaggcttgcttcttcttctgtctcccttctttactcagcagtaaggcaagaaatggaaggcaaagtctgttttccactcttgttatatagtcccgtttactggttaaagtcctcctgctatgactactgtctgaaggcatgtctcactgaaatggtaacctgggtggcacttcacaggtcctcactctatactactctgaagctgataatataacctctaagtactcttcataggttaaccaaaccacaactctcttctacaagcccatggtctctaaagatttttcttaaatgtggttatttaaagatggctttgatgtgactactcatttccaatccaggaactaagaagtagtccaagagatgatttcactctacccagctgtctacacaatatctgtgccctgaaacttcacaagggagcctgagtttaaaggtgattgatcaatcagtctggtagaaaaattttaaaaagaaccagagtcaaactacagtgtggttactaagatctcctgttagccaggtttatatgagaccagaaagacttgacagtcttgcagtttggtcatagaagccagtgcaaagttgccggtagagaaggaaaagaatttgaagagacattttttaacctggggctggagagacagctcagcagccaagagtgtgtagtattcttgcagaagactaaagttcagttcctagcacccacagtaggtgactcacaactgcctctaactccagctccaggacctctgcaagcaccagtagacatgtgcacatacccaccacacccatgcatacacacatacacgtaatgaaaaataaagaaatgaaaatttacaaaaaaaaagaaagccaggcacagtagtgcatgcatttaatcccagaattttctcaggagtcacaggcaggtagatctctgtgagtttgaaactggccttatttacatagcacagtgtttcttaaccttcctaatgctgaattctttaatacagatcctccttttgtggtgacccccaaccattaaagtgttagttgctactgttatgaattttccaaatagtcataggcaacttttgtgaaagagtcctttggccagcttgccaaagggctcatggcccataagttgaaaaccactgatatagagagtttcatacctatcaggactatgttgtaagaccctgtctcaaatgatgataataataactgaaagaaaaaaaggagctatgtataccacaggaaagataccttgagtaaacctgaggaattatttggagtccaaattttgccatatcaagtacatggaagagtaaactcattagaaaggcttttccctgagaagagagaacctgttgggtattctgcataaacacagcttcctaggaacttccctaggactcactttacaaggttcagctgcttgggctctcagaagctgccacagctgtggtttatggaggctcagctactactcaagcctgtcatagacttcagcattgaaagtataaagccagttttatggatgtatatggaatgtaacagaagcttctaccaggatttgaaacccaagcaagagaggccaggcagtatgtggcagggttagaattataatggctactctctaacactgtgatgtacaaagctgtgagaataaagacaaagtcacaggggagactccattgtattgaagatttttggaaacctaggctgtctaccaagaagctctttgggcagtcaacagaaatggcccaagagagaggccatatggactgcaaatggcaacaatgcaggagcaaggctgcccaggcacactaaagctcacatcatgacaacaaatgcatgaacacaaaacatggagctacaggatttatgtgccctttgctgtttccagtcttctgttgactcaatccttccttttaatctcatattcttcccttttggaataggaatgcctaatctgaagtatcttacttctggggttatgtaacttgttttctcagttttacagatgatcacagttaaaactgaaccttgactttaataatactagagctggtgtaactattaagcactcttggagatgattaaatgtatttctatcttgagatggatatgagtcttttggtggccagaggtggtctattatggttaaaggatgaagtgtctcactaaagaacttgaattaaaagctctggtccctacctagtggtgctatatttggacattagagaagtctctagaagataaaatcttgatggaggatgcagaacactgggtggcttcttgtgggcatcttgttcctaatcccttcttatccctctgattcttagctgccatgaggagaacggatcttaccatgtgttcctgccaccacggtgtcctgcctcacataaccccagaaacacagagacatgtggccatcaccaaaacttcagaaactgtgaactaaaacagtgtcctcttatttagtttgttttgtgagtattttggttgcaacaatgaataattacatggaataggaaaacaaagttgacagttaagccatattttattaagcattgttagaatctatctacaacctctctgaacaaccctttgacttaatttgagaacaaaattaaaattttctgaaaagcaaaaaaaaaaggacaatagtcatcaaatgcctatttttatagccaatttgtcagtcttgggtccatatggaaagaagagaattttagccaatgttttccagttgggaagaaaactgggagttattatgagtctgctacctcactaatacactttcattcattcgtgaacatttaataagcacctgcgagcacaggtgctcacagctctagacaacaagaaaggcaaagcctgaaaccatggagaatagtctaacaagaagcatcaccaacaaataattaatttcacattgtaaaaagtgttactgaaacactcaattaagagtggctggggtgagtaagtgtgggtttgtattgagtggtcatagaggggatcttcatggaggaatcatctcaggcagacttgagaagacctcgggaggaaagagtgcaatgaaaggttgaacaaatctgacaaccaaggtatagagatgggctggctgggttctggagagaatgaagtctttgtgcttgttcttggaatgtggagaatgctgtgagtctggagagacagaaaagcaaaggagaagatgttccccagtagttcttgggaatagcataaagttctgtttccagtgtgatagtcactccagtcatagagggctccactgctcccatgtgctcactgccattgttcaaatgcatgaaaatttcgaaaatgacgtagacattcattgaacaaattactagctatctagccactctccattatgaggatggtgacatctgttgataacaaaagcccttatgtctgaaaatatcagacaccagagcctgcttgactccctttggttgtgttgctattctatcttgttataaggagacataaaaatttgcaaaggaaaaatttatgtagggattccttacatgtcctttctgaaaggaatgaattctgtttatagtgggcagagttgagtgtacttgatggtgcaagcagagaaaccagattccagccccaggcaagtggctcttgcagtgtggaaggctcagaagcacggggtctgatctctcctgagatgctgcatatttacatttcaaatcactctaagtggaacaagatttgtaccttatcaccttcccaagcatagatttttttcctaatcgaggttataaatacagttactcctaatgatgtaaattgaaagcaggctgtttttactggctgctgccaaaatcatcatgaagctacctttaacttactatcagaggcttatttaccataattgactttctcactgttttatcttgtctttgaccctggacgcccaagcatgatgctcctgaatttaaaggagaaagtgattaatgtggggagagcagagacagccacattggggaccccagtggggacaaagaagaagcctgataaaatactaaacagaccaccatctcctcccatgttctctttttttctgtgtctttcagggagccctttaatgagaagtcactgattttaaagccaaatatatttatgccagggtcagagggaaatatttacatctaaaaatgctgaaacatgaaacactagccacaggaaaggttactcagatgaaaaaagaatagaagtttgtatcaacataatttacataacttttttttccttcccccaaaacaaattcttgccttgagagactaatccaggtagcccttttgctccagtctcttaatgagacaaatccaaaattgaaagcttctggggctctgtgtaaaatcctctaactatgaggaaaaaataacaaagtaaatcagttctgagaagatagatgactggagaagagtggctgtgagaagttaaagaacaagcttggacttcaaattccttctgtgtaggacattctgaattagaaatggaatatccggtttctaatttctttctcatcaagagataatgagtactacaattcactttggttttcaaagatcatttatatcttcctcccacttcttacctattatctttccattctattgccccttgggtctgtttggaagcatattagtttactagaaatggtgctcactccttctgttgagtagtaaaattacccaaggcatggatagagagttagtggaagcactgaatatattaatagaaaaatggtctcagtggtgtgaggagaaaagatccaggaagaaggaagaacaagacagaagcatctctggcccttgggtgactggattagagggaaacatgtctgtcagaatcaccctttattcaaagcagtcagcattatcccattttagagatgagttggtggtaatttatcttccatctgcacttacaaatttggatttctactaggagccttagaataacttgggaaaggtcttgggtttaaaacatggctctgccgtgtagtagcaaatcatgtgaacccattgtttcaggttcttcacgtgtaacatgaaactgtggcatacccatagttggaaggcaggagccttggcccttcgaaactgcacagaactttccaggggctgtgcctcatctgagcggtaaatgtctgcccaattttgagccaaacaatagcaatccacagacttgctgcatgcccttatctgtaaggagttcacaacgaactaggaatttgaccaagagaagctcgtaaggaatcttcacaatttattaacattctcccatcagtgtctttatataataactaagacttgtaaaatcacaaaaccaacttcaaggcaaaggatactttctcagaattactcaggcttgggtctaggaagatggctcagtgtttaagagcacatcaggatgttcaagaagacctgaatttggttcccagagtccatggcaggcatcacacaactttgtatgatgccatctccagggggatgatgtactgccatttttgggcaatacactcacatacacaaagccattagacactcacatatacacaaactaattaaacataaaaaactttttaaagacacatgtacatatttatacccctgtaatacataaataacgtgtgtgtgtgtgtgtgtgtgttcctgtgtgtgtgtgtgtgtgtgtgtggggtgtgtgtgtgtgtggttgtgtgtgtgtgtgtgtgtgtgtgttactatgaaataaccattataaggaaacactaagtacagaacaaaggaatttcatgttcaaatcacaatttttattagcatattcactaacatcccttgggtagggaacatgctccctttgattttttcttacaaaataaaccaatttgggtgctaagacaacctcatatctgggtgtatactaaccacagtgagaaacaaggaatcttcagatttatgatagttctaccctgtttgacatatagttaactagttcactatgcattctgaaccatctcttttagatactatgctagtacttattgtcaaataaaacaaatttccagttttaagtgaaatgtctgtactgtgtttaatatggaaggttaatgaagaaaaaattcatttctaaactatttttatgcatgtgtcaaaatatctcacacattttactgtgtagcatatacataggtctgaggaatccctatagccagtgttttgaatggaaaaacaaatactgaccagatcattgtgagtcactggagctgagacagggagattgttcctaagaaactagactagaaatagaaacttcattgacatgaaactcaatgttccagaactaagactgaaacacagactagtctccaacagggaagacttggattaaagacactgagtctttctcccaggcaccaaaagaactggtgggttcagtcaatgccacggtggagaaagccaatcgtctcagtctattgatctgaagctaagttaagtcagtcaaagcaatcaatcctgttagtccacatgctaagtgagaacggggcagagtcaatcactcagggaatcacattggggaaaaaaaggcttttgtctgtaatggatatttggcatgcaagtgtctctggcctgatctaccctacaacatgcattaattcaccacttaaactaggaagagaaggtaaaattaaagccacttacttctgagggaactcactggtttggtcttccgtctctatgacatatatgcacgctcacatacagacatgtccacacattaatcatctgtgtcagcttgaggaaaaattcatcattagaatggaaaattcagcttgacatgtttttatttatatcttccatcagggaccttcattctccttggggaagttatggtctagtttcagaacttggtaaaactgacagatacacacactagcatgtatatatttaacattctcaaatggggaaaaaatgttgctataacagttacacatgctttgtagattctctgagccattaaagtagagctgagagcctctgctttgtatacttatggtggagttagttataaaggtcctgaagtaatcaagataggaccacacaggcaagggcataaaacaaaatggtacagtttggtagaggtgagtgttggatcatcctgaaacatacactgggatgggaagtaagaggacactaagcaggagccatggagtggaagaccacacagatcacactgcaaagttatgcaagatgcagctgggccagcattacttatcatgagtctatgtgctgatatcgagaaaatctgtgcatgttgacaaatctctgaatgatattaagcatttagaatgaagtcagaattaaatcatatgaaggtcaacttagtaccaagcacttagagttattgccttatctgacataaaacagaccaaagtcctatgctgagaaacaacgtacatgagaaattaaaaaccaagcctgtagactgcagtgcagacgcaaactcaaacacacctggggatggtgattataaagtttataataaaagtcaacatttgggctggggaaatggctcacagggtaaagcacttgttgtgctgaatgatccccatcattcagataaaagctaggtatgagttgtgtggtggtgcctgcactcaggaggcagaggcaagtgcagctctgagttcaaggccaccctgatctacagagcaggttccagaacagccagggctacacagaaactctgtcttaagaaaacaaacaaaaagctaggtttaacagattgtacatggaaccccaaggctgggagccagagacaaaaggattcctgagggttgctgtttagacactgcaggcagttggtgaaagacctgtcccccaaaataaggtagagagcaattgaagatgttacgctctacactccatactacactcatacacatgagtctacacacacatacctatatatatatacagagagagagagagagttgatatttcacataagagagggaaatcaactattcaataagaattattattaaatagtttaatttgtactattaaataatttccatgtgatatatagatatattctatattatatataataacttatactattaagtaatagtataaatgaggccattcaataataatgcaacaaaatcaattagtatgaagaaaatattaatttagattgcagccccacaactggagctagaaaatttcatactatatttataaactacagatagttttggtgtacatatgtgagaagaagaaaagtgagatgtttttataactttatagtgtaaaagacctccctgagaaagacagaaaatggaaatgtctacaagataacagttacctttgaggtcataaaatttgagcatgttgttacaatggaaagaccatacaaacaaagtatacaacaaggctttgaaaggacaaagcccccaggcaagccaggggctgtttgcagttccggttctgtggccctgctcagggatatctaatgccagggtatctgctgaccggatctgaaattggcagcaggatccaacacatccagacactgccaaggccctggtaacattcctgcctccatccactggcccaggtaggccaagggctgtttctagttccaattcttcagtcctgctcagggacatctgacgccagggatctgctcactagatccgaactcggcggcaagatgcaacacacccagacactgctaaggcccctgtaacagtcccagctccatccacaagaagaggacagacatcagaatattggaactgtttgcatctaccagaagggaagcttggtcccagacccaccaggagagaaagagactcctgctacacgcaccagaagaaaggatgagaagaggacaatgtaaaagcacattcaacaacagaaaacccaatatgacaacaaaggagactaggaaccatacaccagcaagacctgaacatcacaatgcagatgtttttataattttatggtagaaaagcagaaagaatgaccgtaaaaacatcttcatgaaaatgatagaggacctcaaagaggacatgagaaaatcccttaaagaaatggaagaaaaatcaaaccaaaaagtacaagatatcaacaaatctctgaaggaaacagttcaagacctaaaaactgaaatatagacaataaagaaagcacaatctgagggaatgatcaggtaaagctgggtaaatgatcaggaactacagaggtaagcataaccaacagaataaaagagatggaagagagaatctcaggagatgaagacacactagaagaaatagaatcatcaacaaaagaaaatcttaagtccaacaaatccctaacacaaaatatccaggaaatatgggataccaagaaatgcccaaacctaagaataatagatatagaagaaggtgaagaaatccaactcaaaggcacagaaaacatattcaacaaaatcatagaagaaaaccttcccaacctaaagaaaaacatgccaatgaaaatacaagaagcctacagaacaccaaatagactgaaccaaaaaaagatctccttgccacataataatcaaaacatgaaacacacagaataaagagaaaatattaagagcagcaaaggaaaaagtcaagtgacttataaaggcaaatctatcagaattacacctgacttttccatggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggaaaactgcaaccgaaggaagttaactacaaccataaaaagataggcaatggataatcccattttaccaacagccaaaaggaaaaaggaatagaatcccacacataatttcaccagcaccaccaaatccaaaacaagaatgaacaatcaatggtcattaatattcctcaacattgatagtcttaacttgcctattaaaagacacagattagcaaaatggataagaagacagaatccatctttctgatgaatacaaaaacgcacctcaacttcaaagacagatggtacctaagaattaaaggttgggaaaagatttaccaatcaaatggacccaagaaacaagcagggttagcaatcctaatatccaacaaattgtactttaaactaaagtaaatcaaaagagatgaaggaggtcactttctactcatcacaggagaaatccatcaggatgaagtctcaattctgaacatttatgccccaaatacaaaggcaaccatgtttgtaaaagaaacattgctaaaactcaaatcacacacaaaagtgcacacacttgtagtgggagacttcataaccccactctcacctctagacaggaacaacagacagaaaattcacaaagaaacaaaggaactaatagaagttatggagcaactgggattaataggtatctatagaacatttcatccaaatacaaaacaatataccttcttctcagtgccacactgaaccttctctaaaatagaccacatacttggcaacaggagaataatcacactatagaattaacagcattactgaaagctatagaacacacagaagccagtacaccccagaggagcagacaccagtaaataatcaaattgagggctgaaatcaataaaatggaacctaggagaacaatacaaagaatcaatataatgaagagttggtttttcaagaaaatcaacaagatagacaaacccttatccaaacttaccaaacaacaaagagtgaacacaaaaatcaataaaatcaggaatgaaaagggagacataacaacagacacagaggaaatccagagaatcatcaggtcatactttgaaaacctatattcctcaaaattcgaaaatctaaaaataaaactaaaataaaaaaataaaaaaattcgaaaatataaaggaaatggacaattttctagacagaattcacttatcaaaattaaatcaagaacagataagcaacttaaatagacctatcactcctaatgaaatagagcagtcatcagaagtctcccatccaaaaaaagcccagggccagatggcttcagtgcagaattctaccagacattcaaggaacagctaataccaattctcctcaaaatattccacacaatagaagcagaagggttattgtcaaactctttttacaaggcttcaataaccttgatacccaagccatatgaagacacaagtgagaaagagaactacagaccaataaccctcatgaacattgatgcaaaaattctcaataaaatactgccaaattgaatccaagaacacatcagagaaatcatccaccatgatgaagtagacttcatcccagggatgcaaagatggttcaacatatgaaaatccatcagtgtaatccatataaacagactgaggaaaaaaacacatgtcatctcactagatgctgaaaaagcctttgacaaaatccaacagcccttcatgataaaggtctttgagaaatcaaggataacaagaacatacctcaacataataaaagcaatatacagcaagccaacagccaacatcaaatgaaatggagagaaactcaatgcaattcctctaaaattggggagaagacaaggctgtccactctccacatacctctttaatattatcgttgaaggtctagctagagcaataagagaacaaaaggagatcaagggaatacaaatcagaaaggaagaagtcagactttcactatttgcagatgatgtgatagtctacataagtgacctgaaaagccctaccaaggaacacctacaactgataaacaccttcagcaaagtggcaggatacaaaattaactcaaagaaatctgtagtcctactatgtaccgatgacacattggtggagaataaaatcagagaaacatcactatttataattgccataaacaacataaaataccttggggcaagactaaccaaaaaagtgaaagacctgtactgtaagaattttgagtctctaaagaaagaagatacctgaaaatggaaagatctcccatgctcttggataggtaggatccacatagcaaaaatggcaatcttgccaaaagcaatctacagattcaatgcaatccccatcaaaataccaacacaattcttcacagaccttgaaaggacaattctcaactttatacggagaaacaaaggacccaggatagccaaaacaaccctgtacaataaaggaacttctggaggcaacaccatccctgacatcaagctctattacagagctatagtcctgaaaacagcttggtattggcacaaaaatagactggtagaccaatggaatagagttgaaaaccctgataataatccacacacctacaaacacctgatttttgacaaacaatctaaatttatacaatggaataaagaaaacaccttcaacaaatggtgctggcataactagatgctggcatgcagaagactgcagatagatccaagtctatcactatgcacaaaatttaagacaaaatggatcaaagacctcaacataaatccagacattctgcccctattagaagacaaagtgggaaataccctccaattaattggtacaggagaccaattcctgaacattacaacactagcacagacactgagatcaacaattgataagtcagacctcctgaaactgagaagcctctataaggcaaaggacacagtcagcaatacaaaatggcagcccacagactgggaaaagatattcaccaaccccacatctgacagagggctaatctctaaaatatacaaaaactaaagaagaactaaatagacaattctcaatagaggaaactaaaatggctgaaaaacacataagaaagtgttcaacatccttagccatcagggaaatgcaaatcaaaacaactctgagataccatcttactcctgtcaaaatggcccacatcaaaaacaccaatgacagtgtatgctggagaggatgtagagaaaggagaacacttctccactgctggtgggagtgccaacttgtacagacactttggaaattagtatggtgactcctcaggaaaatgggaatcagtctaccacaagatccagcaattccactcttagacatatacccaaaagaagcacaatcatacaacaaggacatctgttcaatgatgttcatagcagcactatttgtaacagccagaaactggaagcagcctagatgcccctcaaccgaagaatggatagagaaaatgtggtacatttacaaaatggagtactcagcagaaaaaaaaatggaatcttaaaatttgcaggaaaatgggtggaactagaagaaactattctgagcgaggtaacccaatcacaaaaagagaaacatgatatgtactcactcatatgtggattttagacttagagtaaagaattaccagcctacaatccacactgccagagaagctaataaacaaggagtacccttcgagaaacatatgtggtcccctggagaaatggaaagggtcaagatttccttagcaaattgggagcatgggaagatgggggagggagataggagaatgagaaggaaagaggaggagggatgcagaggacatgagggagcagaaaagttgagttaggggaagaatagaagataacaagaatggagataccataatagagggagactaaaatgtttacagagaaatcaggcactagggaaatatctagagatctataaacatgacaccaactaacaatctaagcaacagaggagaggctaccttaaatgccctcccctgataatgagattgatgactgacttatatgtatagccctcatccagcagctggtggaagtagaagcagacacccataactaatcactgaactgaactggaatccagttgcagagaaggacgagtgaagagcaaaggggttcagaccaggctggtgaaacccaccgaaacagctgacctgaacatcgtggagctcttggtccccagactgatagctgggaaaccagcatgggactgattcagaccccaagaacatgggtttcagtgaggaaacctcggaaatctatgggacctcctgtagtagttcagtacttatccctagcataggtgtgggctctgggagaccattcataggtgtgggctctgggagaccattccacatagaggaatactccctgagccaagacacatggggatgggcctaggccctatcccaaaggatacaatagactctcctgacaccctatggaaggcctcaccgtccagggggagcagaaaggatatgtgatatgtagggttttagttgaggggggtggtagggggggagggtagggagagggaactgggattgtcatgtaaaacaatcttgtttctaattcaaattttaaaaatctccaaaaaaaataaaagaaggacaaagccatccacagtactttcaatgaaggcataatatttgtactagataaaaatctattttggcacacccattgattaaggaaactcaaacaaccagataggagaggggaaaaggcatatgatcaagagagtcccaaagttaaaacgattgtaaacttatgaaactaagccatcttcctggttgtcagaggactacaaagcttttcagtagagtattaggcatttctaattgtagtacgaatacctcactcaagacccacagactttgaatggatgcagtgaggcattgtgaatcacaggcttgatgctgttttgtagatctctgtgattgctcatcacacatacctgaaacttcatgaccatagagcagcaactagttatttattgtttttattactcagatggcctacagttcacaaagacacatataaactacaagcagggaagcaagatacagacttcttgtacacattccaaatgagcacaaaggagcctcaggtcttgtccttttttcttctgttgtaataaaacaccctgacaaaagtgatttaggggagaaagggcttcttctgactcccagttccaggtcacaatctgtcaccatgagaagtcacagtaacaggatcatcagacacctggtcacatggcatcagaagacagcaaggaccgcatacatgctggagctcagcttacactctccactttgtaccatcaaaggatcacttgccttgggaatagccccactcacttgggactacctccactcgttcaagataatatcacttactttgggaatagccccactcacttgggactacctccactcgttcaagataatcctccataggcatacccccagacacttctctcacgagatcctagatgctgtcaaggtaacagttaacattaactaccaaagaaggccatctgaggtggaaatcatagtgtccttagggagcatgggttcttttgagcagatgtccaccataactagcttgtgaggtctgtcagtagaaattctccagtacacaccagctgaatgtcaacctcagttttaagaatctatggcaaattgatgcttgtcaaagtgcagaaatgtgtgcatacattggtgttcatttataattgttttggaaatctaaagaaagaaaaaaactgaagtcaatctcacttatcaccataaaggaaggttaagtaaatgatggcatattcatgccatggattattagtcagtgtttaaaaaatgaacagagtgaacctaaagagaaaaatatagaaaattgtagactataaagtttggtttttttggtggttttttttttctttttgcaagttgcaaatcacagaaccacttgtgtatttaatttagtatttaatatagtatgcatattgtggtatcttattccatatgttaacctgactgtatcatggaatgtgcagacaaagataaagatggtttctgggtgttatgctgagggagtttctgaagagatgaactttgagattacagatggagagaagaggattgtcccttctctcatgatagctcaggcatgtatacctgagatcaaccctgagaacccagcaagatagcatgctgcaaatgtgagttcttggggctcactggctatccagcttaatctgcgtgatgagttcaaggccagtgagagaccctggcttaaaaaccaagggtcacagacagatgacaaagtgctcaggatattttgaagctaccctctgtcctctacgccaccccacatgtatgcatgtacacacgggtgcactacatggcatctgcatatatccccaacacacatacacatgcacatgcccgcacacccgcacacagagagacagagacagaaatagacagagacagcaggtctctttgttcagtatggatgaggctaacaagattgctatagattgaataggaaaaaactgtaaaagatccaccctctctctgcccaactgcttaaactgagccatccctgtcctcctcccaccctaagtgctcatggttctcaggcaggcatctgctcattggctctctagctcctacgccgatgcacgacagcactggccttctcaagtcctcagattgcagacttctctgcctccaaaatcacacaagacaaccccataaaaccattttgtagatgtcttcatttccacagctctatctctgcagagaacctacacatgtgtacttggatgtgtaagcaagcatacaattcagtgtatgagaatattctgattcatacaaaagcgggtacctagatgtatggccaaggggcagttgcttcctctagggaaagctgtcagaggcaaaggcagaaggagggagagtggcttagtggcttgctttttctgttctctgaacagtttgactcagctacaatgagaatgcatcttacaactgtaagtattatactcatatatgtaagaccatcaaaatactacacacattcacctttagaactcaagtcagtgtcacctctgagcatatcatctgaaagacccaagtgtgaggaatcagccttatctcaggaacagcattttatgtggaatttgaattgacttttaaaattacctaatttttcagtttgaaacatttgacctctgggtttcagccagcgtccttgcactctctttagtcgaaatttgtgctttgctttaagtaggactcttagaagcacatggggaatgcaggttagctcacttgttaaacatagaatggcctgagccaaaagccatgagcataatcctctctatatttttcaagccagctcatcatttgcaatccacattcccttacatagttacggtgttttctttcacatcctgcaacactgattctgaaaggtgaagggtgaggcgaggcattaaggtgcaagatgactgagcctatctctataaagggtattttatttgccataaaaagctgccataaacatgaactgtggtacttagcatatgataaagaatttaaagataacttagaaatgtaacaaaaacctttgtactgccaaatatttccccatagttaacagaacaacagctcagaggaaaacttttggtagcttaattaagagaattccatctagatgggtgcatgccttgagaaggctgcatctgcaaataggtacactctctgccttgggaggtgttaccacagaaagaacaccaactctccagcacaaatctatctgatctaattcccactaagtttctgatcacatttcccagtagtctcaatatatatattgagacatggtttctttgtataactttgtaaaccaggcttacctcaaactcacatagatctgcctgcctctgcctcccgagtgctgagattaaaggtgtttggccccagcacccagcttaaatagatataattttcaacattatgcactcaccaaattaacacctttagaatattttcacccaggagtaaaagcaaatggaagctccatctccattcattcctattcttacatagggtgtctggagaacggaatggtgctttgcaaaagtggtgtgtatttttctgagataactgggcatgctttcgtttacctgcctgacatatgctcttcctggcctcctagaagacaatgaaccattgtttttcaggtgacaagaatatactcactgaatttgggggaacctaataaagcaataaaagtctcacttgatggcagtcaaaactctgtcactctggtgggagttggagtcaattggtattttacctctagttccaattattaatttgacttttgggtggacattcagtgtgagattacagttcagacaaagagtttcataggttaattagagtccttcatatcctttagaggagactttcccaccaccattagctgtaggcagagtcctgtacttccctttcccatgttgacaaagatcccagaaaatgcaaataactggacatatttttaggatttatgtatttattatgaacacagtgttctacctgcatgacagaagagggaagcagatctcattacagatgattgtgagccaccatgtggttgctgggaattgaactcagaacttctgaaagagcagtcattgctctttacctctgagctatctctccaggcctcatgacctttcatttttttaagatctattctaattctgtagcctaagctggcctcaaacttgtagccatcctcctgcctcagcctcccaaaactaagattacaggtgtgagccaccatagcaggctgacattttaaattttttaaatatttactgggtatttctacataaatactattgacagcacagcataaatttttaattcattttctgttctatcttaatctttggctgaccttgtctggtatagcttaaccacatccaaactcttcagaacaaaatgtactgttactgaatgttacaaagaggccctttgtttcccctgcaatctgaaacaccacgttccagagatcaagactgcagagcaaagtgaatattcacacattctcagttgtttcaggctatttcctccaaaaggtcaagactttaaatactcccaggcaaaaatgagatggctatctgggtggccaaacagggaaagatgggtgtacagaaagcaacccatgtactgcctacctaattattccaaagagaaatttaaaaatggtaagttcacaccactatactgtttaatcaaggattggtaccgtttcatatccagggccagtctgaatcgccagaggcctgtattgtgtcaggtgtccaggcaacaaacctggctggtgtcttgaaaagtcaagggaaatgacgacatactgtttaacccacattcttgacacagatgggaaaatctggcagagctgaggttatccgtcagccctggggagagcaggtcccccattttgctttcacctggtctctccaacatattgctctgatgcggcatcaaagccagaaaagcacatctgaaaatgaaaggtctatcacattccacacttcttttgaaacatcaaaaagccacacaaagaagcaatcggactagaaaacctgacgaggagcggcatagtgtgggtgagaatgtagcagtagctggaggtgaaccaacgggtggtccatgaaaaggcaagagaaaaccagaaatgcgtgctgatgagatgaaaccgcccacagctgtgtcatgctaatcaaaagttaatttcagctctcagacactggtcatggttcctcacagttgaacggcccagagctcactcactgtgcagcatcacctgccaaggctggatctatttacaagctcccagaatccagagagaagcgcagggaaagacgctatgcctggaagatgctcacaggttaagaatatgtgtggtcctgttggacagtgaccgcagaatccttgcaaactccagctttggacttcgagtaaaccctaaaactattcagatcttccctcaggtcctctacaaaggcagcacactccttcaactactgagccatctatctattcagctcctgtaaaacttttttttttttaattgagtcagagctggaaaggtagctcagcaggtaagagtatctgctgggcagtcatgaagacctgagttcatatcttaacactcatttcaaaagctgcacatggccatctacacctgtaactctagttctgtgtaagtgctgtgaggagggtggagacaggaagtgggtggagacaggaggacaaggggagactggaggccagtagagacaggaagtaactggagacaggtgagtagagacaggagggggtgaagacaggagggggctggagacaggaggggctatagacaggaagggggtggagacaggaggggtggaaacaggagggggctggagacaggagggttggagacagaaaggggtggagacaagagggggtggagacagggggctggtagagacaggaggtgggtagagacaggaggggggtggagacaggagggaggtggagataggaaggggcggagaaaagtggggtggagacaggaggggagtggagacaggagggggctggagacaggaagtgactagagacaggagatgagtggagacaggaggtgggtggagacaggagggggtggagacaagagtggtggagatagaaggggctggagacaggaggtgggtggagacaggaagcactctgggacagggaggctgcctgtcaagctccaggttcagtgaaagacactgaatgaaaggaatgagacagagttatagagcaggacacccaatatcctcctcgggctcacacacacacattcacacacatacatacacacaccatgtatattccacattcacaagcatgtgtacatcacattcacacaaacatgcacacgtgtacatacatacatacacatgtacgcatatcatccttatacaacttcacactcacattcatggacacacacgtgctcatgtgcacatacgccatatacatacacacatattcacacgcacacatatcatgcgtagtccacattcacacaccatgtgcacaccacattcacataaacatatacatacatgtgtacaggcatatacacaatatacacatatcatccgtgtataacttcacatacacatacatggacatacatgtgctcatgtgcacatacaccatatacatacacacatattcacatacacataacataccagaagtactccacatttatgcaccatgtgtgcaccacattcacagaaacatatgcacacacatacacatacatatacacacatccatgcatatcatccatatacaacttcacacacatgcatccacacacatgtgctcatgtgcacatacacaaaacacacacacacacacacaccacattcattcacacacacagaaagagagagagaataaagtcatgacacttagttttcaactgttatttcctaaaaccataaatccaaactgctgtgtacatagaaggtgcctggaggaatcttgtacagtgggttttaagaaatacaagctgaaaacaaaaatccaatcattttccacaagtgtctattattggccctcttgtaccctggcctcattaaaagccataggggccatttcagccacaatgtaatagggccacaaagaccatgggatttggaggatctagtaaaacctagctatgaccctcagctttgccacaaatgaattcattgtaagcaagacacttacaggccattatctcctgctggctacagtgaaagctgccttgccctgtccgacttaccttacagaggatcacaagcagatgaggaaaactttgcacattttacaggaagatattattagacacggcaatgcctacctatatccaacaatgaagccgttcagtatactggctgattccatgaaaaatttatttataatgcaaagtgacgaaactttgtgatatgattttatttcaactaatatattctatgatttgtatcactgtatcacagtgtccttaaaattgcatgacctgtgcttcacattatcagtggttccctgtgacaacttctgttgctcactgtgctcttgttcctggacttctggccttccattgtgtttggagtctcattcttacagaggtatttgtctcagctgtctggtgggtctctgctgcctgagcacctacctctatctgctgcagcctgcccaacatcatgggggcggacagacatggcgaggcttggtgcctgagggacatggtggcacattctcttcagtagagccacctggtctttgtagctacaggaaacactgctctgcagactcatcacacacaatgatgtccagtggcacaccattcagatgaacttattctcacaagcaactggttcagaggctgtgatgcggagtgcatgctggtcctaccatgcccctgccagctgatctctcctttctccatgtgggggaactattgaagagctctacttacccaaagcctttcccttagggagtatccaggtgattcaatctgcttcctttttttcaaaaagacttcatttctctaagaaaaatttactcctggctttgatttggtaagggagatggtaagttcagtccagccagaaaacgaacaaccaaaaacaacaatctaagagttattactatgcaatcagtttagtcagtcataattcacttgctggttataaacacatggtttttattgtgcttttggcatggtattaggaatggaacttgggccttctgcatgctaggtaagcactctaccactgagctaaatcttcagccatgagagcaaatgattttgatcagaaattcaaatacagcaaaatgtatccaaagataagtagagaatcctccctaccccttccagccctactccttgaagattacacagtcaacagttttccttgtgcccagaagttgaccatgcaccagtatgcccatggacattcttatttcaacttagcaatatgacttgaaaatccttaacaacacatgtaggtatgctaaattattttctatagctatataataacttacatgattacatcgtaacccatataattggtctcctgttgagtgacacacagattattcatcacatggattatttttcttctactatctgaaataatgtaacagtgaactattttattcataccactatgtgtagatgtgcaaataaaaccgaggacaaatcaccaaaattaggacttgcaagatatgcatatttcaatttgcatagtattagccaatgataccaacttcctgcatatcagcatgtgtgaatgcctgtgtcttcacacccttatccattctgtcaatttgtacattttctatcatcagtctggtcagtgagaaaccggtctgcaattgggatttgcatttcttgaattatgaatgagatcaagtattcttgtatgcataaaatagagattttcccctctgaactgatttttcaaagcctttgctcattttgctaggccacttgtatatttttgtcagtctagaacaatctttaatatatacctgaccatacaatgcacacatagtatacatgtgtaaaacttggttcaatctcttttaaatatacttggagacagacatttgcattcatggatcatctttttgtctttgcctttaattgctgtatttttttcctggaggaggtttaaggtttaaagcagatttacatggctcttttgttgttaatacctattcaggtggtttcttgcttgaaaaaagatcaagatcttttttcttgatccccctccaaaaaaaaaaaaaaacttcccatgatatcttatgaaaattttacagtttttcattttatttttaaagctttagtatatccaaaatgcattttagtgtgaggagagagatagagatccaatttttttcctaaatggctgaaaacgttgactcagtgccatcttctaaacaatccatctttctttactgatttaaaataccacttttatcatatactagattccctgaagtatttggacctacttaagattctgttctgttccattgatctgtctgcctatgcagatattttagaagcaaatacatttatggagctgtaatttagcatatgtgggtttatttccaggcttcagttatttgtattctacagaatgtttgtttgtcattgtgtaccttgggcttgacttcttcaagggcaaggattatggatcctatgccttctgtaactccctgaaatgctagtctctgccaagtttgatattttggaaactgaaattgagccatgtctttctacaaagccagggatagtctgagtggtttcagcagattggacctctctcaaggtattcagcccccagatacaatactaccacaattaactcttttcatcaaagatactctcctaataagatatgaatatgatgcattcttctaaaaatgcattcattattatttctgcttggcataagttttggtggaaatgtgagctggcttttagagagctgggcaatctggcaccaagacacattccatctcttttagtatcacaacacagcctccaaaatcgtgcctattagtctcacttttcagaggagaaaaggctcaggcaagtaagttaggatggcaggttggaaagaggcagagcctgtattcaaatagaagtttacctggtctcaaataccctcctcctcttgctctcctatgctgggggtagagacaaagatcctcaagccagaacaggaaatcatttccccttccggtgccagccctgcagtgactgccccgacagctagatgaagaataatttctccccacaccagttgctcagtgggaagaagggccatgataaatgttccatttctgccacagaagtcagggcaacagtagctgttgtcttcttaatagtgaagcagatccaaaaagatcttaccagcttcacagctgtgttcagtagttgtccaaaatatcaataagtaaaattcatctctcaagccctaaaaagccagaatttaaaaataaattttgaaaaatatagtaagtaaaagagggtagtatgtattattcccaaagttcactacaactgctggcttggcatgtcgcatgttcaacactacttcgcacaactgtgtcctggctctgctagtttgaagaaggctgtctcaaactagttttcttgtacacagaagaaagaaaaggaatactaggctggaccacttgtggtatgtattaaacccttcttgcttacatccctaaattagaactagaggtcaaattatgtaacaaagacttgagtcaaattctgcacacatctgtcaattccaagaatccaacccccagtgtataggatgatcagtaactccaggagcagcctctggcttttctaaaggagcaagtaaaggtaggcattcagcttctcgttctcttcctctccctcagaaatctacagatctaattaagtattcggagctactccccagtgtcatgtcactcgggaaccatcagcctcactcctgcttctgacagcccagacaaaaagccatgctctctgtcagaaaaaaaaaatgtcaccagtgggacagtaggcagaggtttgtccaggcatagatcaagttcttccttgtccctctggaacagcacaaaaatcttttatttttatgtctagcttgccacgagaccaagaaccacagccataaccccttccagcctttagagcagtggttctcaacctctgggttgtgacccctttggggacgaatgaccctttcacaggggctttctaagaccataagaaaacacatatatttacattaagtttcataatactataaaaatcatggttatgaagtagcaatgaaaataattttgtggttgacagtcaccccaacatgagaaactgtattaaaggttctcagcattaagaaggttgagaaccactgcactagaggaggagccaaaagaaatcccactctggggaagtgacccaggacacagctatgatgaccacatggttctaaactagagctgtcaagtcaacaaatgatgtgttcactcatacactttaccagagtctctgagaagatcagtctttggacattttgctatgtctcctagaagccatttgactactaaaagggcattgtaggaattaagaacatagttctaatcctggcccagacactcagttcctgtgtgacttctccatgccttagatgtttcatgtgtgaactggaagaaattgtcacatgccagctgttcagaatgcctagaactgaagctggtatagaattcctactgttattgcattaaattgtctcagcacctagctcccaactgtccctctttcaacagtgttccagtagcacggttcttgcatctatttggaccatcacctataattccaactctgaatctaatcttcaaatcattccaaacccagctgacctttttcacatctggctattgttatcagattttcctgtgtaacaatcttagagataatacagccaacacacatgtgtagcctaaagaaatccaagcccattgcttgaagagttcttatgattttaatctggttaccttggtacgaaactacttaaatgtctctccttgctggcttaatgaataaagaaaatgaaaagtaatttctactccttttggttttgtttcttcataggaaatcaccttgctgtaggaatcatcccttcgtatcttgccccagctgtttaattcatttggcataacattttttttgtctttactatgagctggtagacagaatttcaaaaggaacctgatgagggacgatttcaaatatcttctttcacttttcctttctcctagcaaatgaagttgcagagtccttgtgccatttaatgtggcagttgggtgcatggaacaactcttttaagatcacatacctatggctcttttccacagccctgcttcagtttgtctgccacttgtcatgcagcctcactgggaactgtgccatgttccactatcattttctgctttatataaaaagaagaagaagtgagagatcaggattgttagattctataaacacttgaatgcctgggaaatgcagagccatgagccaggctgctggtgacaaggagcagagtggggagaaaggaaattacatcctaaactccaacgcatactattcttacatgatgtctaaagagacaggaactcaagttgagcatttgaatgttaaaacaaaatagacaaagcaatgctcgcccagcaaaatagctgtcagatatgtgttctcctgaatggaaagggaaagaaaaaaaaggagaaacagagataaaaggcaacatgggggaagaaggagacagattgtctagggagggtatagttaagactcctagagttttgcatgaaatgtaattttgttccataaagggatttaaaatgagggagagaggaaagagtcgggctcaacttcacaagctgtgattccctgacataatatttcctcatctgattccaacagttccaggtagccaattcagtgctgtgcaattctgaaaatcacccattaggccgaaatctaatctcaggagcatccaaactcccaggtccaaagctgggaacattgttgccatttttatttttcctttacctgctccacagttccaagacaaattaacagaatgagattttattgtgtgggctgcattgttcttttctcctgtggtacgagtaacctttccccacctgcatggagacgcagaggtctgttccatatgctttttgttatttttctgcttgttggcaaaatgaattgctgcagagaaatcagggctgtagagacttgagagcaggtgactgagtctggcttcctctgtgctgttctgtcactttgtgctaccaaagccccacactagtgcaggtcacagactttacactgtgaccacaagcccttggacaggaagaaaactgattgtgagacatatgggattttaggggaacctcaaaagccaactgatgttctctgaacccacggagaaaacccctagttggagtcatcagatttaacaattctctgaggaagattcagaagcaaaatcagggcaaaattgtatttcttaaaatttcttttgcctctttcatgcacgctaacacaggaaggtaaattgcatcgtctgtttaaggtgtctgcaacattattgattatatcatagccaacaaacaactcgtgcatttttaaaacctgtgggttttcagtctccctaactgagctctaaacacaaaggagaaattaagcaaaattattattaaattgaaggacaatgaattttaaaaaataagctggcctgggtatatagctcagtatattctcaatgccaccagaagggaaggcgagggaagagttcatacagaggctcaaataaccaagaggcggtggacagcatcaattcttcatgagtttcatgctatcaccaagcacctcttcagaaccagtggctgctctatgtggcttatgaatcttttcattccctcaggacttgctctcttgtgaggtagaattacttaagtagatcgggcaaggtggctcagtgggtaattctgatgacaaacatttggttcccagagcccaggtgttggaagtagaacaagaactgagtcctcctgcaagctgtcctctgacttccatacatacactatggcccatatgtgcccacacaataaataaacgtaataatttttaaaagaaattcttaaaagtaaacttatttatgaaactatatcctgtatctacaaatgaccaagataagacatgtttcataccagctgcagtaagggaggggtatgaagacaggtgtgagtgagtcatgacattttcacatgactgctttcagagcagtggggctctattcatgaaatgggctttgttacttttgtaagtccgtttacaaaatccatctgcattagttactttagaatcactgcagaaaatacctggcagggacaacttaagggaggagagatctactttggctcatagcatcaggggatttccctgcattgaggcaaggaaggtggaaagtgtgtggtgggagtatgtggtggagggccttcatatcacagaacatcaggtagcaggaaccaagggctttcaagaacctttcaaagaccagctcagaatgatgtatttctgccagctagtccccacctccagatgatccacggctttccaaaatagagacagtacaatagtgaaggaacagcctccccaacatgagcctgtgggaaggaacatttcgcatttctatcttcgtgccattttcaaactaagaatttacttgaaccattaatagaggttttctatttttggtagattaagagatttttttcttaatcttcattttcttgttcttgttaagtactgtcaggtttcagtcttcagatgatttttgtaaataatgaaataaactgcaatctaataatcaactcattgaagaacaacttttcaaaaagacaatacagcttaaaataaattgtcaccttccacacagctccatggggcaacagatggctctcttttcagataataaaacagaagtccgaatttaataatggaaaaccaattaagaaaggtgaaatgtaaagaaataaaagtgggtggggatgaggttgagtttaaagaaatcttcatacagtgtgcatgctgggctgctgccatactggatgctatagccttctgttgggacctattattgctctctccgaaagacaggggtctgagcttctgagagaggcccacaggggacactgacaacatctaccttagatagtttcactcaaagggtaagaatgataagatgtactcatctgtcagagccaagtggcagggaacttgaagaccagaagattggtcttttctctctcatgcccatgattgatccaaggaaattacatggatggagactagtaaagtgaagtaggtggtacactttagaggtggctcacagaagccaccctgccaccgtagatcatggtacccttccaacctctcttcatgcctgtgaagttcgctttccttacctctcaagcatgacaggatggatgcatgaaagtgatcttatgcaaagaaaatactcttgaggagagacaccgaaagcaccccatgtgggctcctgaagctactgaataaacaagcttgtgtcattcctagcaagtgacaaaacgccgtatcctggtgagagtaaaattaatccaaccatcagtgtatcgtttgcttaccacccgggagcacaagcaagaataatattaagttaacattaaaatttatgagcaaattactctaaaacacagcaaagtaggcgttatctgtgaatatagaaatttaagatatcctttgagacacagaatttaatttttgataaactctggtttcatttttcatatctttggtttggttttgaaagcatattaatttctcattatcttgtatattttcttaatcaaatttattttagtagaaatactagttatgaatctatgattttgtctattcatatcatttgatcagctatgagttaacttaaagtatttgaaagataaatttactacccaagaagtaataccttgttttcctaaatccttaatattttcacagtgtgatctcccatagctatggtgtcaccttcctgactttcacaggcttatatgaggcattttctgtcttagtgggctggggagttcaaaatgcagccatccttgcatttcatgtacgtcaccttctctcaacaccataaacaatatgcaaagatcaataataatttcatatctgctactagcttggtgccatgttatagcaaagagttgatttgtatggatcctaattttcttctgtttcttcagaaaattggccagtaatttttacagtcttttgtccttagatgaaatttcactcagagttcttgatgaatagataggattgaggatatcaaaacacattttactccagtccatttcaataatgtcatacttgaccagggacagttaatttgttaaggatcatatttaactttcaaaaatataactgatactttaataagtagcatttgttattaactactaacagttagttattgactaatgtaaacatagtcagaggaaagccaggtggggctgtgaatgcttataatggcactgctggggaagaagagatggaccagccattctaacccatttgttgagttctagattagtggaaaaccaagttttaaaaaacaaaacaaggtacacagcatcaaaagaataactgaggttgtcttctatcatatacatgcatgcacacaaatgtgcactcacacccatatatacaagtacacctacacacacacatacacacacacacacacacacacacacacacaaaggaaatagtcagaaggttcaaatctacctgttgtactatacaatagccatctccagaacatgagctgtggctctcagagtttctgactcagcactatgtaaagccattagagtttgtgtgtggtgggggcaagttacactgcaaaaccaaaccgtttcccctgtgggttgtaaacataagatttgcatcagcttcagagcatgtgaccatcacaaacctgccagaatttccatatgcattcatgctcagaatcatcactgaagcatggaaagaagagctgataaaccaagtattgaaggcccttgaagaagtcagacccttgattgtccctgcctagccccacatgcttcattagccaaggcaagatgcatggcattgatgaggtttgtatgcaaagaagagtaccattattccatgtgttgaatgctagaaggcactggtggtaccatggctcccactcacatagcccttgaggaatgaagtaagaaggcagaggtttgaaaagctcactcaaaaaatacccaaatacttttcaaagaaattaattctattcttttgtatctcaggctatcatcagtgaggggacaaagtcacagctctccactgccaccctcagcatcttgaggggttcctttaatcatttagggatcttgatctaaacaaactgagattcattgctctggtgcagaaaagaatttcaagactaatcagctgagttggggttttattaaaaataaaaaggaaactgcttgcaaaaagagtaaagaaacatgacagcataagcatgggcttcttaagagagagcccagtgtagtaatcaacaccatgaccagaaagcaagctggggaggaaagggcttatttggcttatacttccatattgccgttctcatcaaaggaagtcaggggcaggaactcaaacagcaaaaacctggaggcaagagctgatgcagaggggtgcttcttcctctggcttgctcaatacaagcttgctcaggacccccagcccagggatagcatcacccacaatgggctgagccctcccccatcaatcaccaattaagaaaatgccttagagccagatcttatgcagacatcccctgtgcatccatcctttcatataacattagcttgtgtcaggttgacataagactgagccagcacaattgctaaggcagacttttaagagcagagggctcacagaaaagaaaagatcaaagcatacccaaaatctggacttctcaggggataacagcaattaagtatcttagcatccatcatttgggtgtctagggttacaaatttcattgtttccctctttttgatatgtgagattataaagtgccccagagataccttggaaggattataatctggtaaggtaaaacccaggaaccactggtgttgcacaagggatttagtgcatgccttctgctgtggttgaggattctggtgaggttccttgttgggggtctttagctgggaagggagaaaggccttaagtagttggtaattgtgcctaaatgcttgcttctcagctgctggaaggcttagctagacttctaggtaagtgttcctttgtcttcccacattgccataaattttcctgtctttctattctgcctcaggaccaaaagaaagaggtatgcatcaacagaggtctacctctcttcttcgcatcactcacgtttcacgtgtaaatgcaagtatccaatggagaacacccttccttcctctagcattttcacattatgaattgcagcatctaccagtaaaattaaggagatgttagcttagatttaagatcgttagactgaaatacatggtggctctcatttacttgggttctgggtagattctgattcttcatggcctatagaaatcatcacacaatcttcatagtaactatgtgaagcatggatactgagacccaaggactgaatgaggaaagggaagaagagtaaagaattgattagtgaaagaagatggattccggctactccctaggcctgctccctgagctgcagcccctcagagatgactgtgtctcccacatacgctgatcttggcaagtcggccaaggatgttttcaccaggggctacagctttggcataataaaacttgatttgaaaacaaagtctgagaatggataggaatttaccagctcaggctccaccaatacagagaccaccaaagtgaacggcagcctggaaaccaagttcagatggaccgaatatgggctgacatttacagtgaagtgaaacacagacaacacccctagataccgagattaccgtggaagaccagctcccctgtgtactgaagctgacctttgactcatccttctcgtctaacattgggggaaaatgctacaatcaagacagggtacaagagggagcatatcaacctgggctgtgatgtggactttgacattgctgggccctcaatccggggtgctctgatgcttagccatgaaggctgctggctagctaccagatgaattttgagacctcgaagtctcaagtgacccagagcaactttgcagttgggtacaagatgggtgagttccagcttcatactaatgtgaacgatgggacagagtttggtgcctccatttaccaggagctgaacaacaagttggagactgctgtcaatcttgcctggacagcaggaaacagtgacattcgctttggaatagcagccaagtaccaggtcgaccctgttgcctgcttttcggccaaagtcaacaactctagcctgatcggtttagggtccactcagaccctaaagccaggtatcaaactgacgctgtcagctctgctggatggcaagaatggcaatgcgggtggccacaagcttggtctaggactggaatttcaaccataaatgaatattgtaccaacgttaattttaaactatttcacagtataactaccttcagaatttagtgtaccttttaatgttacatgttggagatgcaaaaattgataaataccacattagatgtccaggctaaggatgactcggctttaaggtgtttaccattttagaggtgcagcagaaatcccattcctaaaagggtccttttagctgtagatgtgggttggggaagtgccactccagagacgtcaggctgcaagcagaagctgggaatgtgtgggccctttgtaaatctgtgtcaagtccacagatgaaattgtgacttcctgagcattaaatcttggtgtcccaataataactgctgagaagcatgtacacacctgtgtgaaagggactttttaagacagaccaccatgtcctgttcccatcctagcccatcagtttcctgttttacaccaaaagtactattagctatctcttttgtgccattttagggtggagaggttgggcatgatggagccagtcattcaggacttaatttttccttgtggtatggttttcttttccttctatacttcttgccttccttcctttctctctttcttctttcaattctctctctctctttctctctctctcactctctttctctctcccttccttttttttctttgccattacaccagagtatgaaacagcttccaggatctccagctttaagctgggcaggtgtgttataggcctcaccactctatttttttagcagtttaatgggtacattatagagtctttcatttcgtgtagaattagctactcctcttcaaatgctgtaattaatatcacttaaaataaaacttgcaataaaatattgaaacctcaaaagaagggggaggaggaggaggaatccaactccgacctgcaaagcattcctcctgaggagcataccacaatgaacaacactgatgaaatatcttaccaagcgatgtcatttattgtgcctctgagtaccagttcatagctgtgatcccaacaaaagagttctaaacagtgttctggcacagccttctccccatctccccccccccaaaaaggtggcttttagttgtgccacattcctgccacacaacaaataggatttataaggaccatttccggggccgctttacaaactttgcatggctttagactaattacagatttaaaatattagcacaaatgaataagactggaagattttgagtcttacacagggaatattaatagtactcagagctgctacttcataactttggagtgacattcttggaggtcaaggaaatgccaccacctggagttgtgcactacacaatatgtgtgaccatatgctggggccctgaatttcttatgggcagtctgccttcacctgcactcctatcttgagatgcttcatcttgacaggtttctgttttggtcttcattcttcaaatacccttcaaataattaataccttaaattcttccttggcagttagtagaggattttgccatactggacatgcttagtattgtgaaaccaaccttaaaggaggatgctccatccatgtctctgtttgcaaagagtctcatggcctgcatctacatatgcaaataataataactgatcagagggcctaaaaaatagctgagtttattggagtgtaaaacaatgactaattgatataactacttaaaattttcttagcaatacattctgcatcttggagcataggattcacgtgtttactgatatttcaagaatgaaacaaagaaacaccacttcaatcagcagctgcaacagcttcctccccgcatctccagtaaactgctgagtctttcctcccctcccacagggccctaggggacccctctccactagtgccattgtctcttggttttattttaatcatattttcagtcccccaacccattccaatgtcagcaaagactgttgatcttcacaagtccttgctgtgaatcccgctgagccacttgggcagataactgctctctttgaaggcctgccccaatggtctctgtgctggctgtctcactgaagaaataaagcagcatgccttagggaagattcttcagtgtccttcctagccatgtttgtgcacgttagtcatcctagccactcagtggacctatgaggcttgcagctctgtgagagctgtggtagacactaagaatattccacaatccttttcattcttctgaaccaagccctcaaaagaaatgacttgtggacaaatatggattcctttttcttccccaaagataaactattatgtatgaaaggacagctaaacatgaaattgcaaggtttccactgtcaaataaggacaggcggtagagaaggaagaccacacttctctacctcaggacacaagggtgagggaacaaatcaggaatgcaacacctcagacccttccagtcagtcttccctaagcaactaatgctaatataaaccgggtgatttgggaatagtctttctggctgcagagagtgcagcatttactattgtaagatgtctgctattggcaggagctatcagagggttttccttcattttcaactgtataataattatgtgtttgaggtatagaatgaatgtaacactttcatagaaaaaatgcacattatgaaatgatcaaatcgggataataaacatatctgtcacttcaaatgtttctcgtctttgtgataagatcattttaaatactattcttagactatttgaagtatataatgtattgtggattccagattcatgcctggggtccttgttacaatgaggctgactccttggtccaggaaggcatacttttgctttgcgggatggtgggggcctgctgtttgtttcttcatttttcttgagatagggcctcattgtatagtccaaactggctagaattcccgtttcttcctatgacgcccatctgaggaaatgaagaggtattcatccaccaggacagcttgtggatgatttagcttaataatgtatagctaaagagcttctagtctaatggtgttaattctgcaccttagagaccacagctcaagggacaaacatgcaggacacttattacttgtgacaaatggtggcatcttcaaacagcatttccaaaacctctcatctgcattgcctgcctcgaaaaataaggaagggttaagaagcccatcccatgcccagtgacttcattcgatcaagaggaaattccaccccctcgagacagggatggaagccggcactggaaaccagtattccacaggctcagctgtctcagtggctctgtgcgtgggttctgggtttggtttttacattaccagcctcagtgaggtggaacagaggattacaaaaggataagctaaatggcaattgctagtgcattgttgtggtcaccagcaccttttccaacagtatttttcatttcttcaaagctatatggagcagctaatctatttatgtgctttcttaagagaaaaaaatggataatacctaaggggcaagtgtagtacaagttaagaataacattttcttttatccccaagactccagaatgctcacagatcttactattatcataaagataaatgacagggggatttagtccagtgagaaatcacccagctattggccatatacagcaatttaaaataaaacacaccaatctctagcctccagccccttgcagtctttagcactgacataaaagtccaatatgaaagtgggtgttggttcatgattcaaagagatgcttattttaatggtgatcgtgaccaaagacttaggaaaagggggaattctaatctggggcataaaacaatagatttatgctcagatgttttgttcctttggagaatgtttcaataaccttatagaaattcatccaagtgagctctctgctctgcccatgagtaggtgtcatcagaaaaggttaaagaaagaagagagtgagggaaggagggagggagggagggagctctctgatgtttaatccattctcaagtgttcagtcctaaacatgtacattagaagaacattagaaggacacaaaatagactcagtagggtgtgtgtgtgtgtgtgtgtgtgtgtgtctgtgtctgtgtctgtgtgtgtctgtgtatgtctgtgtgtgtgtgcgtgtgtgtgtgtctttgtgtatgtctgtgtgtctatgtgcctgagtaaaaagaatgaaaaagaagaggttataaattggaggggataacaggaacacggagagagctggaggggagatcttcctgcctctgcctcactagcattggattagaggcatgtgccaccacatggtgacatccagatatttttgatgtgactccaatgatcctcagaatgcttgttcaaaccaagtctgtgtcaacacatgtggaaagagtacctgtgtaaagcagaggcaaactgaaataaatattgctttgcaaccatgattttccagtggtgtactggattgagatggtgatcccctgtttttcagcttctgaagtgtgccctgtgctccagcaactaaaggagctgtttcttgccattttggaatgcaaacctcacagagcgtgtgtcagaccgaccttttcctgccttctgttcttgatcctgttgcatacttatgtgttcttccaaaagaaaagaaaggttaaagactgaaatcactcagcccagataaagtaaaaagagaaataaaattaatttgtcctttaagtaactaattgcaaccgccttaagatttcagaatcataactttacatattagtatcccatgagctaggccatttctaggtgcagaggacaaaaggcaagcaagataaagtctccagctccatggaacttactctgtaaggaagacagtaatgaaacaaaacaagcatgagactataatacagtcttatatgctaataaatgttataaggaagaataagcctgtacaggggatggagggaaaagtcaagagcacagccatagtaggtctatctgagagaaggttcacagaacgcatactcacatgaaggaggacaataaacctcacagatatgaagaggccgagctccccaagcagtgagaacaaaatgcatacagggagctcaagcttgatgtttatgaagaacatgaataatctatgtgacagaaccaatgacaagagaaatagacactgagactctatagacaggaagaggtaagagcatgtgaggccggtgggcggggtgggagggcatagtaagacgctatgttgtcattctagttcagccattggaggataaacaagagtaacaagtcatttcattcacatcttaaactgcagagctcttgacatgggaagaggcaagatcaaaagcagagtgacgggctagaagtctgagggaggtcttgaaccagtcgagtaacaataattaaggtgaagttgatcagttctgtccatgtttatgaactggaaatgatgaggttctgatataatgtcaagaggtttgtgaattggagggccccaaggggtcacacccagctttcagtgggaatcctgtgatcaatagtactgtttgcagaaatggtaggaagaaaaatctagggaagaggaaccaagaactttgtgttcaccctgccaaattcagaagtgttctttacgtttctcatagagatgttggggggggggtgttcaatgtatatgcctggagccgataaaagagaagagatagaattgtctagaattatccagaaacacacaagaggtaaaaacccagagtgcctaacaaaatcacctgtagaaagagtgaaaaaaaagaaagaaaaccatgaaactttaccttacagtaaccccaactctctaagtcagaattaagagtgcccatcagagaagaaggggaaggccaaccagtgcttgggaagaaaaagaagcacgacagagttacatttgccaagtgaaaaatgagcttccgggaggtggaaggagtggccagctatttgttcctaacataccctgcaagatcaatactaatgttctctagatgtggcaagatgttagccattagaaagcttgacaaagatttctgtagcagagagacttaagtacagtggggccaggaatgcagatgagacacccctctcccaagagggacagaaggtaaccaaaaatagcaagtaaattctgttccaggggagcttttaacatactttcaaattctcccagcagtagtaattccatggaggaaataacgatgcttgagaaaggatgcctaactgcaggggtgaagtctttgaggagtagagaagtggtggcatctatcacaggtgagcagagctgggtgactaaagaaacaggactccccatccactgaaacaaagacaagaccaagggtctggattactgtggatggatttgccatgaactgttctttttggtttatctgtaattttagtgacatttgagacaagaccatctgcatggacagaaagggtattagatgctggaggaacaggacaaggttaggtctctaagagcagagctgcgagctgtccagggaactctgagtgctgtctggcagtgcagacagcttgcttggagatctgtgaacaaagtcggatgactctcattctccaattgcttcaccagtgttgaaaaggatctaatatttacaggaagaagatttttgcctatacggaatcttcagagaatgaaactaaatagagtggaagtgatattgtaaaagacaaatatatgtgaatagaaggataataaaaaacataattgtccttattcttatttcctatccttaaaaattagccctattaaatttagaggatgatggaggattccttcagtataagggggtcattctctgccattagaaaattgtacattcttaaccagttatttagaagtgctgtaacagagatgcaggctatcaccccactattattaacaagcaccattgactcttaccttgtagaattaagactccattccccaaattcttttccagctagctgtggccacagaacaaatcacatgtcaaatgagttggaaggaaaagtaaattaacacaatttctggaaatttctcttaaggatgtcgactccttaccttccctaggaggtaaaccccttaccagaagatgggttgaattctagccaccatcatgaaccatcctaagaaaggcagtttgaattcctagaaaggttatagaacctccacaatctaaaaagcaaaaatctgggctcacgagagtgaaccacaatggtgcccatcaaaccacctggagactgatgtcctttaacagtcttaactttgttctttatactaaagctattggcaaattttcagttcaagtacacaatccttatttacattgtctctaattctcagttcattgcagtagttacgggaactaagtccacaacttcttactctaattgtgatcgagtactgtctagtgttcccacaagaccaataaccaggattctgagtctactcatcacttacatttccaacatgatatctgatctgcagggctagcaacacaagtcaaggtataggcctggcctgtcaagacaaggattatcacagagcactttctctgaaccactggacattgacttcccaaataccaccaatgttcatagtctgctttgctgtggaatgttagtttaagatgtgttatatttgtttatgctgtggaatatttatttaacaatgcatagatgtgttgcattcttttatgttgcatttgtttaactctgtgaagctttctatgatactttgcctgtctaaaacacctgactggtctaataaagaactgaatggccaataatagctaggcaggagacagggataggtggagttgccaggcagagagaataaatagaagaatggaagaggaaagagcaagaaaatgaggagaagaagacaccagcggtcagccacacagtcagccagccactaagtaagaaggaaagaaagatatacagaatacggagaggtaaaaagcccagaggcaaaacatagttagagagaaacaggataataaagctaagttagaaaagctggctagaaacaagccaacctaaaaccaagcatccataagtaaaaataagtctctgtgtatttatttgggagctgcatggtgggcctccaaaagagttaaaaaaagaaaagaaaaagaaacaaccaacaacactcctctccaaggggaaaaaaaccagatttgaagatggaggtttctctggaaatatacttaccaaagggtgtgctttggggggaggcatttttcaataatgaaattgtgtctacacacagattcattcattaactagaagtccatccattttagattctaaaatgccaccacaatacaggacacaggcaacatgccagacaaaaacaattatatgcaacaagttatgtaatctatgacctttaggaaataaaatattgaacttatattgtttgataatttataagtaacttttatacttttacacattttattactattaaaccaaaatagaatgttctcccttatgttatcatttattaaaaatctctctggatttccaggcagtttaacaaaatgtacttcgtagggagctcaaaaaacttacataatattttagcagatttctctttaaaacaaaaccaaaaacagttgtgttttctagagtctataccaatagcattaagccaagagaaacttttggagaagccagtaatgtctctgcattttcatttgatctctctctggatttaataccctcatgaaccctgaatggaatatatgcatgtcacagcatggcagagggataatacattttcccctgcttcactgagcatgagttgtgtatcttgccatcttgagagtccactgtgcggcacatttatccccattagaaaagcatggttggataatatatggatgctgcagccattcatgacaaatacgtaaaaccataccttatgcatccagggatccgtgtatatacactgaagctattaactatgcatcaacaggattttgtaaaaaacaggttttcaactccaaagactaaaaggacaaatgtattgattacttttgcacatttattcagcttcaaaggtagcaatattaattccaagaaagaaaagaagagggcttgccacattggccatgtgacttaatgttgctcaccttaaataaaatgctacttactcgagggtatgcatctataagtacatcttgaataatttatgaatatatatagctccttctttttattttattgtgtgtgtgtgtgtgtgtgtgtgtgtgtgtgtgtgtgtgtgtgtgtgtgtgtgtgtgtatgtatgcacaggtgtttaaagagacaccagaagagaatgctggacctggagttacaggtagctgtgagctgtcatctgatgtgggtgcttaaccactgagccacctctccagcccctgttccttctacctttacttcagagacatatcacaatggaatagcacatttataaaagtaattcccaaataagcaaatgcatattcttcaaaccccaacatttactggttgtatattctttagcaaaattatttatccaaagcttcagttttctgtaaaatgaaagtaataatacttgtcttgtaggattttctacagaatactctagatcctggggtgggaggagcatataatatgtagcactcaggatatcattggcactcaacaaatattggcagttttcaccaaccttcatgaaaaccctgcccaccatgccaatgggacagagggagtatatataatacataggatttcattaaccatatactccagccacttaggtcagttctcaaggtgaaatctggtgttgtccctatatacaatgagaaaggattcacatgacacagagaagcaaacaaagacctgaaaagcctaacagaagtctttcctatagccagaattataaatgcccaaattcacatctgtgtctgtgcctattgtgtacatagaaaacaactatgcacaatgtcacaacaaaggaaataatggccagagtcaagaaacatcatggttagttctctctctctctctctctctctctctctctctctctctctctctctctctctctctcctttgtaaccagaaatttcagaattcaaatctttccaaactcaagtgtaaggtttttttagaaaaaaaaatagtgaaaaaaaatttgccattcttagagttgctgagctcattcctcaaattctttggctttagagttaagtgctccgacattgaaaaataacggtttactttttccataaaattaagaattcaaatacattactggtgttaaactctcatagatatgcttaatatacttgcttctccaattaaaacaacacggtcattaatatactgtattatgttatgaaatcataattgcagccaagcagaaaataattaccatctatcagccttcatggtttacaaaagcaaaattatttttcctttgttttagaagtttcacaagacaaatactagttttatagtggcaaccctcttacttaatattacccactgtcatgtgtatctgtaaactgtcctctgtccttctgggcccaacttacattgagatgatttaattttaaaatctaatcccagggcaaatccttctgattctattgtgaacacctggtatggaaaaacactgggcttctttcaaatgtatctccatgtgaaaacaagtgatttcacacatctcccagaccagagctaaaacactactgcttgcaattactttatatcaataaacctataataaacacacactgtagctggctttgttgggcaatgtgtcctcaaggccttaccctcaagctgcatatagatggctggacaacactatgaggaaagggcacaaaatgaatacaacacaatggtagagtgaaaagggaatgaaagaaagataagtatctcaatgaagcttagggacaaaacagctcaagaatagcgaaatggatatattggcatcattgcaaggatgctatatatactgggagaatttcatttaacagacacagggctatgtgccttggaaacagtatgtgatatctgagaataaacaaggcatccagcttgcttgagtcatatacggactgttgtttctgctacccagaatccacttaccccactgctaaaaccagcctcgttttcttcagagacatattcctgtggcccatagcgtctaagtatacctgttcttgtctcaagagacctcaaagtgtatacttaactgcagtgacagttgggagtggatagacagcccactctaacccaccaggatcttcagggcagctcaagaaggcaactgttactttctcctgttaatgaaccaggaagtttgggactcttgggtctactaataagcagtttatgagggcaaagggactaagataaagcaaattcttcaattttagatctgtcagaagacaaactcatcttcttattccctcatttccccccaaaataaatcttttctttcatgtccttggaattctacatggtgctactatctacctagttcttcagattagaaagtatagtgtcagccatatttccccatgctttgtaaattcagttagtctagatcatcccagcaatgactatcttcttcccactatctctacaccactgactctggtttcacctgtgggttttggagtctgaagatcaagaattgaagttctgtaggctgactagccaggattcccattccctacttaaacatttattaatcccaggaacttcaacaaattatgtaatatacctaaccatttttccatctgcaaaatgagggtggttgtttatacttcatcaatgttgggatctcatgagtagagagtttagcaaagtgcaggccacatgctaagcaacaaagaaatcctatgactcctaaagcaaacatctgcttacccatctccttcactctcaactgccccaccttttttcatttctcagagatttctaaaccatgtcagttagctgtgtaatttgcatggctatttgttcctggtttatttcttcaagatgaactatggaatgaattggtctttccaggtatcttttatttaaagagaagagttggtttcaaagtagagcaactgtaattgagtcgggcagtatgatggatgagtgaacgtgggtagagagtgtctcctgatgcattaatacggacagtatgtcttattgtatctttgtaaacaagttgagagccatcagcctctgggaaaagcccaccctctcacacatttgcagccagctgacctcttgagcctttttccaagtcagtcattccacacgaaatctgtggcctacttatatcttctaaaaattggcgttccacatctccttgttttatttttgttttacttttaaagtaaaacaaacttttcctgaggtaagtaatatttataataaaatagtctcgttttaaacatacagtttgataattctggtaaatgtgtgcactcacacaactatttccacaactgaactatgaactattcccatcatccccaaatgcctacttgcactcacttctaggcagtccctgcccataaatccactttctattgctttgtccattctgagatctaatgtaaatgaactcacctagtgtgcactcctgtgtctggctccattcccacattacatgattcatccacactgttgggtgtatcactaacttgtttcttttttattcctgaggagaattagattatacagtgtagggaatgaatattcttatgtcacacaaagaaacacacaaccagaataaagttatccacaaaaaggatccagtgtccagaaccccaaccaagctagcaaacaggcatgcccaaaatggtctctatcttttatccctaacataggtggtgactgtgtctcatcctattgatggaaccacagcctcacaatctgacactactggctaatcaggaccaagaggaaggggtgggacccctatcagtctaactacactagataggataaaatagcacttctcacacatagctatacaagaacgtgtttttccacttccatattgagggacatttgattgattttctactttggacttttatgaataaagttgctaggagaatgtccacacacatctttatgtgggtgcatgttttcatttctgttgggtacatgtctaaagatagatactgagcattcaggaaagggcatgtttaatcccataatacactagaccaaaccattttccaaaatggctgtgctagtctgcatttggagaagcaatgtacaagggcatcagaaactttagttcatgggcatcaggtactcaatatttaaggctctttaatatcagtcattcagttggatgttcagaggaataactcacgtcttaatctgtgttttcatcatgtttgtcatgtcttcggtatccttagacattctttctttcttttacagaatatctgttcaaatcattagcatgtttagtagatcacttacctttaaataaataacagtttgactcttcctggtcatttttacatgaatccctatgcactggccaatctctctgtctctgtctgatgcatatttttcaaatttacttttcatttatgtatatgtgtgtatgcctgcataagtttatgtataccacatgcatacaggagcccacagaggccagaagaaggcatcaaattccctggaacaagagtgacagacagctgtaagtcacataggtgctgggaactgagcctggggcctgtgtgagatacataaggacacttaactgttgacccttctctccatccgcctgatacattcactaaaagcatagctcatggggacctcttttctatgaaaccttgccatacctccccaatcactcctttctctatgatcacactactgctccccctttccttcaatagtggcaattattcaagggtgtcataacttatatgtctctatgtcagtattgtatacatctctatatctcctagtatatgatctccttgagaacataggaagttttctttttctttaaatttgcccatggattaacatagtactcaacacatgtaagagaagagacatataaagtggcatataaagactgaagctattggagagagagtgtaggatcaggatactgagatgaatatccctgtctttatccactcttttcacagatgttcgctgatctccttttgtgacgaggcacctcagataccatcatacagacacataaaaaagctaagtcaacggtgaaacccacagaaacagctgacctgaacatcggggagctcttggtccccagattgatagctgggataccagcatgggactgatccagacactatgaacgtgggtttcaacgaggagacctcagaaatctatggaacctcctatagtagttcagtacttatccctagcataggtgtggactttgggcgcccattccacatagaggagtactacctgagccaagacacatgggggtggccataggccctatcccaaagtatatgatagactctgatggtcccctatggaaggcctcacctccctggggagcagaaaggatatgtgataggtagggttttagttggggggtgggaggaggaggggagggagatagaactgggattgacatgtaaaacaatcttgtttctaattcaaataaaaatgcagagaaaaataatcttatagttcaccattaaaatattattaaaatgaaaaaaaaaaaaagctaagctgaatctctgtccctgtagaatccagactatggtaatggagacatatataccagctaaaagttgaaatacactatagtgagtccagcatcccaggagactggggaagactggagaaagttctctaactcaagcttagaaatcagtctttctgaagaacaggggtctgaaatcacactgaagcgggcattgcaggttggccaagtcaggagctgccgatatcagttcaggcaaagggcagaggtaggaaagaatcagggttatccagggaaccacaggagtggacagagctagagagaggattgcaaaggcaaatgctgctgacagctccattaaaatggccaatggatccaaagggaagagtttttatgaactttaaatttccctgtagaagagattttggtcacctccatcataaagccacctctagcccctgctttgagtagtcttagcaaggaggaatgacctacacttgatcccttatttctatcatgagaagaatgtcaaaacataggtgtgagtaataagctaatgcaagtcagattttgtactcactgaacgtgttactcttgacagcaccagttaacctgtgctctgcaacaacctcccagacagacagaacacattactcagcagcagcaaccgactgtgagcccactaggtgtgtgtcacttctgcactgtggcagtaaggtgctactttcccatgagccccctcttttttctgctttagtgctttgaagtctttgaagtcctggtgggtgagccattccctctgagcaggaacaatacttcccagaaggaagagacaaagttgtaagatacaggaagatcacacaatttacaggactcaggatgctcaaaacattttgaaattcactgagcccctccctgagatataaagcaacaattactaaaggtgaaggagtctcttcagtacttgggtggacttttggtgaaggatcagtatttatgtcatccaggctctcataagaaacccttcacccatgttccttcttgaagtaactttaatgaactcattggttcaccaagatagagttagaggaaatccttaagtttgtcaatggtgccctgtgtgcagtctgtgcacatctccctggagcaagtcacaagcccatgcaatgacttcactggaggaaaacctgggtccctcgatgacttcatgtagcagaatcccgtggtaacttccacatgcttcatttacctcattgtcatgagttgtgcattgcagtgtagtaagacactgaagattagaagccatttttacagtggtgatgctattctgttctattaaaatattttacccactggtaacacaatcattactcagtcgatataagctaaaaagattgtaatttttattggtcttcattacatgagacagcatgagcactagttcagcctcagacactgaaattaaacaaaacttgagtctcactcccacctctacacttaccaaccttgttttccctgccaaatgactcaatcccctgtgccttacttcacccactggtaagatgtagataaaaatttacctgtctcgggtcactgggaacattacttgtgtatatgttttgttgcagatgcatacagtaagtgcttaataaatggaagtgactaacaccatgatctttggcttggaatctgattgagaatttgttgttatatgatttttggggggggaactccacagcaataagcatcacctcccttgtatttaacaactcagaaaggaaattgatcatgtctgcctctctctgccccaggacatatgcaacgtggactgatcaccttggcaacctgaaaactttacttcatgcattcaccccaagaatgcttctctcaatgcatatccataacattgtcaggccagtaattactctgactgaaataatagtgtgttaacagatcaagcctccagggctcatcagtaattccttccctctttcctcggtgaagatttcagggtccaggggatttgagctgttattggcctcagaggttttccaatggttggttctcttactcataatgcctctggcatgctccattttcccagcaccacaagttgcaatcaacacatgctggcagttgacatcttttaatatttgttgctctctttctgcctagcacttgtggctccatcttgacatgaagctgttcctgttattgccattactagctaaatagcccttggactctagctgggaaacagtatcataaattgcttagagttatcctatttcctgcaaacaaaaacccaggcagcttcaggcccatttttactttattattcatacagccaggccatttattgcaggatatcgcctctccctgggttggagtaggcgaattattccatttcctatcataaatgtgcaactcctgattcagcagccccaacaggaggcatacttgggatgaaagtgttggaacatttgttgttgagagtagaaattcattatctatccctttctcttatttggcactaaacagagagtggggctgaagaggtgaattctcccatctaggtagccaatgggttgggtcattgttatggagagagagataaaagagctagcttggacagatgagtgtattctaacggtttgttggttctatttggtggagtcctgttaattacataacatgtgcctgtgtctgtgtcttttaaataacatttctaaccacctggagaattgtgaaaaagcagagggagatatataaagaatgggtatcattaccataaaggctggagaaaggtttgaagggagagaagaaatatgctcttgcatcagttatgggatttttaatagaaaggcaatctgcttaattatgggaggttttgcattgtaaattactgtacaagtaacatcatggctgagggaggtgagttcctcagggaagggatcggatgtttataaaagtagaaggaaggctgggagtttttctcactaaatgaaaagaaacttcttaatatttttatattttagtaaacaaacctattggacagagtgcttgcttattttggatgttagcaacacagcagcactgaatggaatggcacacacctgtaatcccaatactctatagccagatgctccagtgagctacacagagagttctaggctaacctggaatatattaaacctggtctcaataaaacaaaaacaaaaacgcactctcttattgcatctcacattctcctgtttattctctataaattccatttccgtgaaatgtgggaatgaaggacgtcttgtgttttcaagcttacctggtatcgtgtgcaccctggcagaacccacacctctcctgttggctgggattgtgcattgctgaggaagagaagcaccttgttccctggggagagaagctgcccaggtgagagtcggactccttcaccatatcccagcattctttgctaggagtactgtctcccgagtctacaaagagccagtagctgttcagagcatctcatcttgagaaagagaagatggacatctggaaacttatgaaaacatttaagtttgtgtttatttgaaagaaggaaatcaatttcaactgatccctccttttttgtttgagaattgttggattgtcctttgctaagaaagaaagcatcatgttagaactgtccctgcttggagaacagtctcaggtgacagaaataagcagcttagggcctggtccctttctgctgtggccaccttgagaggtgtagcgttattgaggatcaggcttctccaccagtgacagagaaactggatatcactgtggcaaagacagactcttgtcacagcatcaggaaggttgaaccactggcctagagtcttctgactctaggggtagaaactcaattatggtgttaagttctaggaagaaatggttatgccatttaaggctctgtcaacatcaacttagaaacagcaacagacaatattcaatatttcagtacaagggcatgagactcagattcaggctaggactggatcttatttaaaggatcatacatgaagatttccagaatgtctcttttagcccattctgcaatgactttgatgaagcctgctctgttaccagataaaaatcacttagcatacttcataatataaacactatcaatctctaacagaactgatgacttcattatctctgctcaccaaacacagtgtcttttcactgacaactcaaattatgtaaaataagtagaatggggtggaattctttgaagagagtggaaagttgtcaatgcaatataatgtcccctatgtgaccctgtcatggatgaatgacacacttttaaaatatgctgcactccctacatgatgaaggaatgatcaaatgaccttccctttaagatgtaactttccaaagacaggttcatcttcttatataagaccaagtggaaaccacagctaaaccataaaacaccactgatgaagcaaatgtaactcacgggcacaaaaagaaatgcactggacagtttgaatgtatccctgaaaaggttacttgttggaaatgtatctctgaaattcatatgtaatagagacgggacctttggaaagaagctaggatcagatgatgccacgagggagaaggcaccacgatagtgttaatgaatttacaataggaagaaagacttagctgtaatgtttcttctgtctcaccatgggatactttttgccatgctattgtggcaaaaggacctacaataatatgctacggggactgtgacactgcactctagacctttccatcctccaaaaccatgaaccaatgaaccctctattcatttctattccttttcatttttttctttttgcttttgttctaatttgtttgtaacagccagagcctcaatttcaggctggccttgaaactttaactcatcatgaacttcttgcttcataccctcaagtgctggtgattacaggtgtgtgcaagtgtgacggtttgacatctattttttatataaattaatcctgtagcatccattgaagtaatagaaaataaacttagaagacggggattttatttaaagcaataggtgactatggtttagattgttgtcactaggactcattactgataagacagtgtacatggtttgcctgccaatttttgacacaaaattggagatccctctcagtctcccattgccctggccattgattagagaagtgtatttccaactggcaaatgagcaaggaaaagacaaagcaggtgttcaaatgtaaattaagatgcagaaaaatgcttacaagagacaagataaaactaagaaaactaaggaatcccaaaaaaatacctcccaaatatcccataaggcatttgtcattcgctgtcattttataagttaagaaatgcaaagttagccaaacagtagctgaaacattgtcctcaggaagagctttgtttgcttttgtgacatggaagatatcaaaataataataaatctagacagtacacaatagtaagcacttaccatagacaggaatgacctagagggatgcaagttgcctcaaggccaacaagatgtacatctcaagcatgatcaactctagcagagtaaggcaaaatatctccataaaggaccagctagcaaatgttccacttggggtttacataaacagctctttggtacactagccccaaagtaaccatgcacaatatacaaacaaaagggcatcagtgtgttcagtaaaactggacttataaaaaaacacagtcaattagtaagatatgtttcactggctgtaacttaacaacacttactcagaagaatataatgggagctgagcaagtagtctcagcttcaaactgcaacacacacatgtgtctgctcttcaacaagacaactctatttttattttatttgaaaactcaaactttaaaaactagttctttacttataaaactatacttactataaaaaaatctattatttaatgaaaattttatccagaagatttgtgcttgaaaagaagtcccagagctaatatttatttgattacacaatttatgggtttgaaagcaaacctttctgggatacctgataacagggatagatggatagacagagagataaataatatttaccatccttgaaagagcttcctctctatttctagggaaagtttcaataagaccttgtctccaacattatttattaatactatgcaaaatttagttaaatagttttaatcagggatgtttatgaaaaacaggatccactgataaactttcagaatgtctgaggctagaccccagccagtgtctttcaggaatgagtggcgaatcacactatgagaatgctactgtgaagcaaacttaggacccaaaccaattatttacaaagtcaagctctgttatagaagcagaggataggacaacggcatttgttttagacaagtgttctttctattgtggtgttttcagggacatctgtttgccctggttgtctgaagaatagtttactctctgctgttctcttcactcatgctcccttgtgtctgctcttaaaggaaatgtgtttaaacagcacagaaacacaacctgcacagtgtaagatctatattttaactctggcttggtttcagacctttctcaggtgtctttgggggattgagttcatattctgttccaagagtatcagtgctcaatagacaagagtgttgagtggagttgaaatcactggtcaaagatgtattttttttttctttgcaagtccagacctcattcagaatctaaaaaaaaaaaaaaaccttcactctgccttcataaacaatagctgctgtaacttctaagacaaaaataaaatagaaccatagtaacaagaaatattgatctctgactaacaatgtacacaaaaaaggaacacacgaggaagtgcaaaatgtgttctgtatgccaaatgtgagcatgatgacaatctgcaaacatatagaagctatcagaaacccttccttgggaggaagagccaccccattactgagatcagggtacaagaagagatgggtcctgatctctctgtagctttttgtcaaacccaaagtttctgactaccttgactacctagtttcagccagttttgaaaaaaaaatgtgttttggcacacaggtgaagccctttactaaccaagaactgtggatgtggatacagagagagtttatttacaactaagccaactattcccagaggttagactcacttttaaaaaatcttgtggaaacttagccctgggaaaactctatctccactcccccaagggtgtcaacttgggaaatattaattcaatcataaattcatacctttctctgctaccttctacgttccaacagtgacaggtcctacactttcctatcaagaatccctatgaatcaaaatgcccagggaagcacaaaaggttgctgacttggaaaataactcacaaatccagagcaaaaatgctatttctccactcgcagtgccaggctacacaccatatctacagtaatgtttcagtgccagggaaatgttgcttgcctttgtcattgcactttccttaccaagaaagaccaactcagaaagatcagccctagatcatgcctcttcttcttttttaaagtttcatctttctaccctgtcatgatattatttttccttgcattttactatatgtactagttacttttctattgctatgataaaataccatgatctcagtcaacctttaggagaaagagtttattttggcttatggttccagagtgtgagtccatcatggggaggggagggcgggaggcaagacagcagaatactggaacaggatgctagctgctagcatcttcatccacaacagtaaacagtgaaaaacaacaggaagtgggttaagaccatatacgtccaaagcctgctctacccattaaagtacttcctctatcaaggatctaccttctaaaggttcataacctccctacctactgaggactcagtgttcaaacagatgagtctatatggggcaattctcattcaaaccacaatactatgttatgtcttataataaaaggaattgatttaaaatactacatgatgcaccaggaattctgagattggactctctagtgtttaactatctatcaggatcatctagaagcaatatataatctcagaatgaattccaaacagatagagctggagtcttcatccttaaagatccctaaatggctagcacacaccataaacctgaggaaccaaagttcttactgggcaaggaccataaagagccctcacctactcctgggatcctgatttttgccatgacagaaaatctatactgtgcagattgggcagaaagtaatgcttgagatatttctcctgtgttttctttagtcaaaaggatgatagccaggcatcatggtgccctcctatgatctcagcacatgggaggcttagtcaggagatctagaatccaagccaagtctgggcttcattctgagatcttgcttcaaaacaacaacaataaacaacaagaatagtagggaatcatttatcaatgtcactttgtccaagggaagtgctatagacaagaatattccaaagagtatcagttcttctcattataccaccagtgaaaaagagcagtgtggagcttgcaatgggtgttcactaataagctgccagtggaatcctttatttcattgctgacttatgtaaggatctcaaaaacttagcagtgtgatgagcatgagattgcctttctcacggtttcattgccacttattctgtcaaaacgattgtcttgtgagactcagagtcagttgtcaatctcaaatcccaacaacaacactgcagatgaggctgcagacttcaggatattcattgacttcataatccatgcatcccaaacttccgagggcttgttcaaacctaactacatggcacacaactggtgggcactcaacaaacactgctgacagactgcaaagatccatcatcgctggcctgagtttctgtgacttggtccagcctcagagggaaagcattcacaggcttctccatccatgttgagtctggacagactttcaccaacacagagagctaattgcttccttgtcttgagattgcatattgcttagtgctggcatgatgttccaaaacccaagaagcacaagtagtgatcccccaaagctgctttaaccttttcaaactctaacaactttattgtctacctcattatactccccagactttctctggatgacagtctgatgtagaggactcagccagtgtcctttattagcactttcttctctgttggcccacatagcaagtgtcctgagaattcagaagaaaaacttaaacagccttccttcaggattttagtccttcatgtccccagcagcttttccaactaataagtctaatgtatgtgttcaaagccatggactgatggcaagaggctttcccaccccagcttgatgcaggacaagcacctcatcagataatttctccctgggtggatttcccaccacaggagaagaacactagtgggaaacttgggtactcacaaaataaaattaaagtgtgcaaaaaaaggaaaataactgggcaaagcctgggaaggtgccctataaaattatagttatattgtgtcacagttcatcttggtactcaacttaattggatctggagtcaatgacgagacatgcctctgagggaatctacagagtatgtccagaaaagattcactggggaaagaagacccttgctcccaccgttcacagactctcacagaagcttagatacagagctctgaaggaaagtactcatgctttgtcccaccatcaccaatacagagcatttttgccctcttcccgactgatgctgatgcccatcctttgtgctgactgaagaacccagactccttagccttgaagaaaagctactctttgggggatcttccagtcgttccatgcctggttaggaccactgaggcacccagctgtatggagtgagcagctaccaagttctcgtttttctgcagtgtgaagtcagctgttgttatccaggcatactgtgtaagccaatctaataaatgccctttgtaacaaccattctatcagctctgttcctccagagaacactagcactctaccatatttgatagcagccatggaacccctgttaatcttatctgagtcagcttgcaaattcactcatccctttttttccatttaccgttcttccactccagcccattcatctatctataaatgggcaaagctcatcacatgcactataaccctactgtttttctaaaactgctacattgatagtgtatgagaatgtgtgcaaacaaatgctactttgatagttatatgagaacatgtgcagacaaactcaagtgtgacactcttagtttctattcaatataaaaatgtagtaaaactcaaggacaaaaagaaataaaattagggtctagagaaacacctcaaagatgagaagtttatccttagcaagaacaattcttgggactaggggagtgactcagttgcttacctcacatattggaagcccaggactccatcctcagtgccctctaaacctggcacagagacatacacctgaaatctcagcattgaaaggtagaagcaggaggatcagaaaattcaaggttatcctcagctgcatgagttcaaggttggcctgagcaaagatggactctgtccaaaaataaataaaacattcaagccattttatttctttttttgttgttgtttttgtttttcgagacacggtttctctgtatagctttggagcctatcctggcactccctctggagaccaggctggcctcgaactcacagagatctgactgcctctgcctcccgagtgctgggattaaaggtgtgcaccaccaacacccagccaagccattttcttagcagtttccatttccagtatcttctgtaagaaaaccatgtacaattttatccatgagcttcttcctatagtcacagtgtgtgtcaggaatatttttagtcttaaaacactcaaagaatatactctgcaaagtaggcattaaaaaaaaaacagggaaatttcacccctatttatctgtttgtttgttttttaaaattaaacagacacaatattgtcaaataaaaggccctttcttttcagagaaaaaaatctgtttccagcaccctctactcagtgtgaagagacaagccaaacacaggatgctgaatctgtgggaccctcctgtccatttattatgcctaagaaatttgttctgatccagggatcttatgtgtgaaccttcttgacagtggactttgcctcctgatgttcacacacacacacacacacacacacacacacacacacacacacacatccttcaaacaccaggctgtcaggaatctcagaaaggagtggaatcaagcacacagactccccatgtgacacattcagattagttactttgcctaaaacaagtagcagacaaaaacagctatttcattcatttgaagacaatagctttcaatttaacacttccaaaatcccagcatgtctgacaatggccatcagagtaaactgaagttagattctgccagagagggggttctggtcctcatgtctagagaatgtcccactcctcatgagcccagtgccatgaagaagccatgtgagtttctttcttcgccctcttggatggcagagttcttttcacttatctgcatcttaaggctgtagataactgtttttgtctcacctggataaagggttttgcattcagtggctttttctcttggccttgcatagagtggaaagtcactgcagatgtgaggaactacctcagaggggagacacgaggggtgcataagataatttgtgtaaagagcccctagcagtgcatgccacttaatgaacacataatgacagctgttattacttctgccttgccatcaatatccaattgtcactaaacagagaaatgtgataattacttacttctcttcatctatgaaaaaaaatgcaagcctagaagtgaagtttgaaagccatttggaagagtctaaagaaagctttgccccatgaaatgtgaggggactcctggcccttagctagtgatggcctcggtgaagcaggcctggtttctgaggctgatttccagaaatggccctgccaaatgtttcagatcccctctaatggctgagaatgtcttaagagaaagtgtttccctttctgtgaatagaaagtggataattccaaggagttctttctccatgcactcaaagttggctccctggggctctgcagatgctgcatcagcagggtgggtggctggcaggcaaagacacatcctcttgcatcccagaaactcattggaaggtcatgctacattgatagttcagtaaaacataaccacatagcaaaagccagttcctttttgttccctttacaaaaagctcttgcaatttaaattactccaatgtcagggaactcatacatgtgttcaggagctgagtgtctatcttctgaatgggctctgaactgagacttcagactgtagaacaagcctgtcaatgcaggaaacctaccgcccaaagcagttgttacacactttgattatttgataatattaggacttagaaaaaacacgccttaagaacaaatgagcacagcaaggcctgaatatcccaacacagatgaagcagaagagaatgaccataaaaacagctacatgaagatgatagagaccctaaaagaagaaataagaaaatcctttaattggaagaaaaaaacaaaaaattaaagaaatggaggaaaagacaaaccgaaaattgcaagaaacaattcagacatgcaaagttcgaaaactgaaatagaaacaatttaaaaaaacaatctgagggaatgctggaattagaaactatgggtaaatggtcagaaactacagatgtaaacataaccaccccgaatacaagagatggaagacagaatctcaggcattgaagatacactaggagaaacagattcatcgaccaaagaacatcataagtccaacaaatccctaaacacaaaatatgcaggaaatatgagacaccatgaaaagaccaaacctaagaataataggtacagaagaaggtgaagaaacccaactcaaaggtacagaaacatatttaacaaaatcatagaagagaacttttccagcctaaagaaagaaatcccaatgaaagtacaagaagcttataaaataccaaatagagtggaccacaaaaaagtcctcccccacataataatcaaaacaccaaacatacagaataaagaaagaacattaagagcagcaaaggaaaaaggccaggtacaatataaaggcaaacctatcagaaatacacgtgaattctccatggaaactctgaaagccagctacaaacactaagagaccacagatgccagccaagactactacacccagaaaagctttcaaacactatttatggagaaaacaagatattccatgtcaaaaccagatttaaccaaaacatatccaccaatccagccctacagagagtactggaaggaaaactaaaacttaaggaaattaactacactcaaaaaaacataggcaatagataatccaactttaccaacagacaaaagaaaagggggcataaaaacacacacaaaaccaacaacaacaacaaatccaaaacaaataagaattcacattaaatggtcttaatttccctcaacattaacagtcttaattcacctataaaaagacacaggctaacagaatggatagaaggacagaacccattcttctgctgcatacaagaaacacacctcaagttcacaaaaaaacattacctcagagcaaaggcttgggataagaatttccaatcaaaaggacccaagaaacagctggtatagctatcctaatatctaacaaattagacttcaaactaaaatcaatcaaaagagatgaagaagggcattgcatattcatcacaggaaaaatccattgagatgaagtgtcaattctgaacatctatgcccgaaatacaaaagcagccacgttcataaaagaaacattactaaaactcaaatcacacataaaaccacacacacttagagtgggagacttcaacaccccactctcaccactaggcaggaccaccagacagaaatttaacaaagaaacaaaggaaataatagaagttatgacacaataggttttaacagacatctatagaacatttcatccaaatagaaaagaatataccttcttttcagtaccacaaagaaccttctctaaaactgaccacatacttggcaacatagcaaacctcaacagatagaaaaaaaaatggaataaccccctgtatcttatcagaccatcatgctttaaagttagaagtcaacaacaacataaattgcagaaaacctccaaactcatgaaaattgaacaatgtgcaattgcaccatttctgggtcaaggaagaaattaaagacttcctagaattcaaagaaaatgaagacacaatatatccaaacttaagggacactttgaaagcagtattaagaggaaagttcatagcactaagtgtccacataaaaaaagaagaagaaaaagaatagtcacacaagagaattaacagcacaactgaaagctctagacaaaaagaagcaaacttaccccagaggagtagatgccaggaaataaccaaattgagggctgaaatcaataaagtagaaacaaagaaaacaatgcaaagaatcaatgtagcaaagagttggttctttcagaaaatcaacaagatacacaaacctttatccaaactaaccaaaaggtggaaagagaacatgaaattaacaaaatcagaaatgaaaaggggaacataacaacagacactgaggaaatccagagaatcttcaggtcatactttgaaaaactgtactccacaaaattcgaaaatttaaaggaaatggacagttttctggatatatatcacttaccaaaattaattcaagaagagataagcaatttaaacagccctataacccctaaagaaatagaagcagtcatcaaaattttcccaaccaaaaaaagcccagggccagatggtttcagtgcagaattctaccagaaatccaaagaagagcaaataccaatacttctcaaattgttccacacaatagaagcagaaagttcaatgccaaactctttatgaggctagaattaccttggtacccaagtcacacaaagacacaactaagaaagagaactacagatcagtaatcctcatgaacattgatgcaaaaatattcaataaaatctggcaaattgattccaagaatacatcagagaaatcatccaccatgatcaagtaggcatcatcgaagggatacaaggatggttcaacatatgaaaatctatcaatgtaatccaccatataaacaaaatgcaaaagaaaaactacatgatcatctcacttgatgctgaaaaggctttgacaaaatccagcaccctttcatgataagggtcttggagagatcagggataaaaggacatacctaaccataatgaaagcaatatacactaaatcaacagtcaacatcaaactaaatggagagaaactcaacaggattcctctaaaatcaggaacaagacaaggctgtccagtcatacctcttcaatattgtatttgaagttctagctagagcaataagactacaaaaggagatcaagtggatacaaattagaaaggaaaaagtcaaactttcactacttgcagatgacatgatagtttccatgagtgacccgaaaaactctactagtgaactcctccagctgataaacaccttcaggaaagtagcaggatacaagattaactcaaaaaaatcagtagccctattatatacagatgataaatgggctgagaaagaaattagagaaacatcaccctttacaatagacacaaacaacataaaaatatcttggggtaacactaaccaaataagtgaaagacctgtacagcaagaactatgagtctgagtctttaaagaaagaaattaaagaagatacaagaaaatggatatatctcccatgatcttggataggtaggatcaacatagtaaaaatggcaatcctgccaaaagcaatctccagattcaatgcaatacccatcaaaatcccagcacaattcttcacagactttgaaagaacaatacttaactttatacagaaaaacaaaaggatagccaaaacaaccctgtacaacaaaggaacttccggaggcatcacatccctgaattcaagctctattatagagctatagtcctgaaaacagctgggtattggcacaaaaatagacagacagaccaatggaatcaaattgaagatccagatattaacccacacacctacgaacacatgatttttgacaaagaagctgaaattatacattgtaaaaaagaaagcatctccaacaaatggtgctggcataactagatgctagcatgtggaagactgcacacagatccaaatctattgtcatgcagaaaatttacatccaaatgaattaaagacctcaacataaatccagccacattgaacctcttagaagagaaagcaggaggcactcttgaaggaattggtgcagggtactgcttcctgaacataacaccagtagctcagacagtgagattgacaattaataaaggggacctcctgaaactgagaagcttctgtaaaggcaaaggacacagtcaacaagacaaaatggcagcccacagaatgggaaaagatatccatcaaccccacatctaacagagggctgatttccaaaacatacaaagaactcaagaagctagtcaccaaaacaccaaataatccaatgcaaaagtggtgtacagaactgcacagagaattctcaatagagaattcatttttccttttggaacattcttagactgcagagttttctttgaaacaaaaactttaaaagtaaaaactcaaagaaatcaaaataaggttctaaggggaatttacaaactcaaggctcctgatacacactgcaaatttacaaaccaaacgtgagagtgccacctgaaaagttttcattttctcagggatttggatgcatcctgaccactgactaacatcggcaagccattggcctgtccctctccctcatgccacaaatatagaaaccaaggtccccaagaggtcagggaacaggaggacatgtgtgtaagtagtgacagaggaaaagaaaagcagattccacctcctcacttccaattcaggctgctttgacccaagtcctaaatgttgcctctcagtgggacttctgtttgttttgttttatttaatctttgtcttcaaagccttctcagtttaacatgctgctatgctggaccccagcacttctgaggagcttggcagtgaccatctatcagagtgaatttggagatccggacatagcaaacacaggcatctacttataatcatccctttcaagttgaaaagtctcttatgtttgctccagtctagtttcatctctgaagaaaataaagcagttggagggaagtattgaagccagcaggtaaagagccattgtggatggaggtaatttcaggtggagacccatcttgcttgactgtagattgtcctgccctcatctagaattcagaaaggaatttgtggaaagaagggagccatgagagtttatgctgaacagtgaatgtgctgcacattttctgaggtgcatctccccttaaaggaaaaagggaaggtggggttatcagtgtattctgttgattccccttgctgagctggctcctgctgcaatgagggaaagtctgataatcagatttgtgcaaggatttctgtccaggcttgctgagctttgtcagcaagaaaaaaaaagtgctaacatacagtgctttttttttcccagtaaatttctatggtttcatttaattttgcttttctccaactatagatcaaatattttcattcccagagaaaagaaaaatgtactcaccttggtactcatcttttcccctcacaaaacctggaagattacaaaaatgcggtgatataagggtaaaataactgaagccaattcctggaactctacgcataaatatggaattgacatccgtgtcttccaggccagcctggatgtgttcaagataaaccactgtgatggttaatatagatggtcaagttcaaacgctctacagtcacctaggagacaaacctctgggcatatgctctagttatctttcagttactgtgataaaactctgacaaaatcatcttggggaggaaactatttggcttctgcttctaggtcacaatccatctctgagagaagtcagggcaagaactcaaggaggaacagaagcataaaccctgaagaatgttgcttactagcctaccctctggctcttgcttaaccctcttatacatcccatgccactttctaagcatagtaccatcaaccatgatctgggccctcccacatcaatcataaatcaagacaatctttcatgaagattcattagacttggccacagttcataagtggttgccttgcaatgagactgtggtttgtttatttatttattttattcccacatactcacaaagctttctccttttagaatgatgttatgtgggtctccagcacttcccaaggagtttggtgatgaccactgatcaatctgattgagataattctttgactgagtgagattctctttccaggtgactctaggttgtgtgagttgacagtaaaatctcacatgtctgtgagaaagtctctatattaattgaggatggaatactctgtatgtagcatcctggactaaattaaaaagagaaaacaagtggagcaatgacttcctggctgtaggcatatatgacctatgcttttgctacatgcattccctgccatgatagacttgtgcctctgaactgtgagccaagctaacctttcattagttaccttttttcagttattttgacacagtaacaagaaaagtaacagagccactgaagaagatgactaagcattacctatgacccagaagtggaccacgaggccacgccacaggtctgagtttttccaggcaccaccataagttttaatatttcagagaagagaatggagcaataaatgcaaccaaatgtccccctattcacccagggcagaagcctggggtcccatctcccttctccctgtctcttcagtaatcaatctctgtgctcctttttctttttatcctttcctttgttttgtgggtttgtttgttggtttgtttgctgaggcagggtttcttgtgtagctttgtagaccagagctctgcctgcctctgcctcctagtgctgggattaaaggcatgcatcaccaccacccagctctttttcttcttttcaatctctctttccccttctgtttcctccaatttgatcagccctgcaactgtatttcctttgaacattttcaatccattctaatttattcatgtcatgggtttttctgttttcttttcgttccttatgttgctactgagtaagtttccttaaaaaacaaaattggttatgtgatatgcctctccaaagtcctctgtggctccctgtgacttacagaataatgacaccatctctttttgtgtcttttctagctctgttctacttttctggatgcatagtcctcctctatacccatttgttagcatgctccatcaacactctgggatctattaatttaattatgtttcaagacttgaactcagatcatttggactccaacacctgcaaggttaacctctccatgatgtagttaaaccttattatggtccaacagtggactctatctagattatgttttccactcactgcaggactcatgggcaacagtttcagcatgtctggatatcaattcatttccatgctcacatatattacaattttaatatatatgatacaagtaaactctcctcccacaatgtatacattaaaattctcattgagacaaaaccagtgcaaaaattcagacacatacctctaggaaagaagagtaaaatccagattatggaaataagattcaatggtaaaacaagaatcttagcagaaaatgaagtctagttccataggatttagcatcaggtaagggatatagaaggttaggactgagcttctaacatcaagtcatgaggaaaatatgtagtcattggcctaagataaaggaaactgcatctaaaacacggaataagtctaacagtgactacaatctggcccatctgtgaaaatgagactacaaaaatattgaccataaccacagggaaagctaatactgttaggaagctgtcattgaactgactctgttgggggttggaagattacagaattctaaacctcagatccattccagaatggcagacctgacttttcattgtttgtacaaatttaacaacatccaaataaaattggcctaagctattacagccacaaaacttgaacaataacaagtaaggatctattagttaaggaccagcagtagttctatgcttatggacattcccagaaaatacaacacacatggtgtccttatagtaaattattatgtgtaacaaggaaaagcaattaaccataagtcagagaaattatgacaggagatggtttaggtaaccaaaacaaggatcagtagagtcagctgagtagagtcagaaagtatgctaacttcagtagagtcagaaagtatgttaacctcaacaggaccccagaactatccttgaaaacaaaatgctacttgttatggctttaacttatgtgtttgcctatcaggtcaacaaggggacaaagggtgagctagcaatagttcatcttccttgtcagcttgactgggtctagaattacctaggagatgtgcccctgtgcttgtctatggggacatgttcagagaggttaactgagataagaagaactgcctggccaggtgttggtggcatacacctttagtcccagtacacaggaggcagagacaggcagatctctatgggttcaagaccagcctagtctacagaaccatttccaggacaggctccaaagcaatacagaaaaaccctgtctggaaaaatgaagaaggatggggaagagaaagaagaagaagaagaagaagaagaagaagaagaagaagaagaagaagaagaagaagaagaagaagaagaagggcagcaccatcccatgagcagggtgctgaagtgattaaagtggaaaagagatccaacagaacatcagcactcatctctctctgcttcctgactatgggcacttctatcttcatgtcttcccagcaatgatgggctgtattcccaccatgatggctaccatgatggactgatccccaccatgatatactgtgtccccatcatgatggactgtatccccaccatgattactatatcccaccatgatggactgatgcccacaatgatggactgcatcccctcaaaccatgattcaaaataagtccttcttttacatcgcttattattgggtatttagtttatcacactaagaaaagtaactaatagattaccaaaactacaaaggcaatttcctcctcccccccaacaaatttccctttccagtgttcatttgagtcctaatgtggcttcctacatatatatttttaattctctgctctgtgattacctttgtctatttactcagaaaagataactccttgtttccttatggatccatttttccatgtatcacatagaagctatagtaggttaatgtctacaaaatttggttctgtaatttaattcatgagtttatcctgattctgccacttagtaattaaataactttgaccttaaatttgaaccttaaactctttttcaatgcaaaatgagaataataacatgacttataaaaagatctatgagatggtaccataaactctcgacctagggcctggctcagaaaagtattggtaaatgttattcattattattcatgctaattacctggaacacatgctcataatccttacaacaaccttgtaaaataacactattacctctgtgttacataatggccaacagttcgaagaggttattaagtaatttgccaaaggaaaaccttctaccaagagggagagctacagcataaactctgaaacctactaggtcaacctctccacaacactcagggtcacacagaagccaccccccttcaaaattatacattatctactaactcaccaatgatgggcaacaatgaaaattcctttcatatttaggtttattgcacttcaaatagatgtctgaaattacaagaagcacagggaagactttcacatgctctgtggtgaagtgacaaacagatcttacccaccaaggttactacaagaacacataagctaggaaagtgcatttaagctgagacttaaagtcttatgaggcgcacatagaataccttatgaagatgctgtctactggaattacctggatattggaaggatgaagctgcaccagagtggttggggaaggaaaagcagatgagggaagtgaacagcagaaagcaagaaccagtggtgttaattaatggtcattaggtggagttcagaccacatcaagtgtcagggaagccacagaaaccttttaagggtgtgatctgatgatgttttgaggctttactttccaagtctaacagaagggacttcacagccagcatgcaacctatgaagaaaccaagcagaaaatcatggcaatgtgttggtaaggataggaaggcaacagagggagatgagaggagctgaaaacaaaccattgagagaaaatgatgagttacagagttgctgagggttacagagattctgatagaaatggctcgctcattcaaaatcactcactctatatttaatactgctccaccaatggattggctgtttctgggttctgtgtttactcctaaccaatgatccattagcagagataagaggaggagaaaaacaagggataatgctggagccagtaaggatgaaaaggtcccacagaaactgtcagctgcctccccacaatgacagagttccttcatagtacggagatttatcttacctaatattaattaatattgccccaatattactgccccaatattaattaataatgtctattatgtactactgcattatatgtaacttacaaatatattttcaaatcaattaaattatttaagataaaaccaatgtcatctttaactgaaaatctgactctttgttcccattttatctccatattcccctgtcttccacataactagaatatttttttttacttgctgaaagactttaacatttagtaatggccaaaacaaaaggaaaaagtggtacagagagaaaatcagcagttctgttcaataatcgccaattgtttccctgacagcgtccagacaaatcgtctaagtcacaaatgcatttgtgaccctcattttggaagggcttctctaatctcagggattggaattgaacttcaaaaatgggtatcaaggtctttgggggcccctcaatttgctgttctaacaccctagtggctgaatggccaccatcctttttcattcgcttaataaaaaataacatgaaaaactataatagccaaatttcttctctcaaatgccaatgtagagagcagtccttcccaaactccaaggcagtaaaaaaggcaactttgaacaatgctttatttttgcttcatttatttctcaatttttatctccagattagatatatacctataggaagggagacaatgctggaaactgcagagtggtttgatgtcaccaagcagattaagcaaagaattatctataatcaccactgagtccccatgtccatcgttcatctcatgtctttgtgcaggagactcaaaggtagcctggatttaaaatgaaaagaaaaattaccctgtgactgaagagagagtcttagagtcaatgtatcctccttcctgcccccattttcttaggaaatagcagatgaaatagctctcattggataaaataagatgggggtgaaaatagctatggaggctgaaatgcattcacattaattttatactgtgattgtttttgagtttttatgagtcgatttcttaacactccacttgcatgcaagcatccatgaagtatgaatccaagatgcagatgttttttagaaatattaaatataggtatatggaaaaaagtatccctagggaacatttagacttgagtttcagggcctgtacaaataaacaaccaagtatttctaatacaaatgtgcattgctcctctgaattatgaagtattttattggacataccctttggttaatgaaggtttgaataaatcctatgtgttttgaagagaactctgacagactcataacatggccttaaatttattccaatttattgtgtacattcgaaaattaaatgtaaataaaatggggggtgattatgagccttctgtccatacataatacgaaaacacatgcatttcaaatgactaataatgtcatgtagcaactgagctgcactgttaggtttaacaacaatgatgcatattaggcccagttgctcaggaaaagaaaattcatgggtgtgtttgggttttacagcaaaaccaaatttctaatgaacagcagtgggaacaagggtgaggtctacacactatattcagaccaactcataatatatttatgagttatatgtaaccaactaattaatttctatgggatagaatcgttcaagggttgaagacccacactgaaatgttctacattacaaacacttgtctgccactcctcagtgtttgaatgactgcagaaaactcactatgtatatacaatgcgtcatatacatacacaatgtgtgaaaaaactaaacatcaaagtgaaatgcagttcattcagtgttcgttgcattgcatagggtataatccaagtgaaacatacatttaaaatctctcatataacctcccccaaggactcacacaaggagacacacactagataaacactgggtttttcctttctgtttctgtttgtatgtttgtttttagaaccctaatgactaagatttgcttagccctgaacacataaacagcattctttaaggagtatttgtgactatttataactctactcatttgttctccattaggctgatgagttcgcttggtagaaaaagtgcttgcagggaaagtccaggaatccaagtcctaaggccataacctatatggtggaaggagagaatagaccctgcaatttgtcctctgtcctccacatgcttgctatggcacacaagcatccatgcctacacatacacatacacacaaacactcactcacacaaacatacacacacacattcacttgcacatacacactaaaaatattaaaattcaaattatataaattcatagggaaagacaaaatatgacttcatctacttccaaagtaaaagattttttaaataaaatatttcagttctaattaaaaaccatttccaatagatattaaaatactggaaatgcaattgatctcaatgtagtcccaataaaagtaagcaaacaaaagttagaactagagaaaagagaaataagataatattcattgagatgtaaactttactttagaatcttgtatttaaacaccagaaaagtgtaaattaacaataaaatatgtattccattatctcaaaattatccatgtcctaggaaactatattcagctatgctcacaattcaattcatctctagtatgaattcccaatatgtttttcaccctacacttatttttttaatctgtacatatgccagtatatcactcagcactcagcattcagacaataacaagcagatgtcatgtgaaatacacccaatcgaatccttatttctctcattaaaacacttccctacttaatttaggggattagaatcagtgtgggggtgggctgtagctggcccatgctcacccgtaagaatggtttcctataattagattccattaagatgaatccacaaaagacctgagagaagccaggtaggagctgaataggttagatcaaaccctggctcagcagctcaccaaccttgtgactcgaacctgcctgccagtctattgtctacacctccatctactccttcataaaataagtgccatgatacttaatcacacggcctaagagtcttataataattaaatgatataacataatataaataacctcagacactgcctgccacatagtgctcagtaaatattattttttcataaaaatgttcacatttagataaactcccagtgtactatactagtatctgtttaattatctaggaaaacctctaggacaggttttcaacttgtcgattgtgacccctttggggggcggtctaactaccctttcacagggatcacaaattagatatcctgcatatcatatatttacattgtgattcgtaacaatagcaaaattacagttataaagtagtcatggaataattttatggttggggtcacacaacatgagaaactgtattaaatgatcacatcattaggaaggttgagagtcactgatatagaacaagatttctttcctaagaggctgcagagatggttcagtccatcaaatactaaggaagcatgaggacccaagttcaagtgccccaaactcgcataacaatgggcatggtgttggaaattaggtgctcctgcagccttctctcaacagctcagtgggccagcagctatctacatcatcacaagtcgccaaccctttaaaaggtctctgtcacagactattctcttatgtgttctctctctctctctctctctctctctctctctctctctctttgtgtgtgtgtgtgtgtgtctacttatctctatctcccagtctctacctgtctctgcctgcctctcacatgtccccactctaagatgacttttgctctcccctatcccaataaacctcttctgtaagatctgttgtgtggtgtgattttctatgcagcctaccttggcccagacccgccaaggtactctgctactaaaccctaactttggttccattgctaattccttataaacaatagcacacatctggaatctcagtgcacctatagtgaaatggtaggcattgacaaaaacatccccaggagctgtcaagaaggttagcctggtataagcagcaaaaaaggagaccctttctgaaacaatatgattgccctatgaatccactcatactgtcacatgtacccacacccacacatagggatgaatgaatttatgaatacacgtgtgtgaccacaaaagattgttttcctcaaatgaagaagtcagcaatatgattacatgttccttctgtgtatataaaatgtatcctcattttttcttaaaaataagaatatttggttaatattactattagcgtaacaaaattttgtcatgtcaaacttctgcttaaagttttttaaatacaatatcgcattctatgaaagtactgagtaagggctagtagttgctgcttttaagtataattataaaataattctgtgtaacattttaacctaaggtgcagtagttgaccaagtgttaatgctgtcactgttgctcttatttttcctgagccccgttaatcagatagtgcatgaagtgattaaactacattctgttttttaatttgtaaaaagcttaagtcatttaattaagtatatcaatgatcattttgttgtctaaaaattattactgaagtttaatataagtgtaagaggcagatctgtcagttatttcaagcacctccccttaaaccactcaggagatggatcactttccccagaatgtcacacatagactcttagtaaaatacttcatcagtgtgattccaaaatgcatgcggttttcctcttgtcttgaaccttccacacatcagattagcagcaccctatcatgggagatgacttcagaaatatgatggcattcaatagcccagagtttagcgtctgttaacaaacttacccaagtccccacttaccaggctctagctgagtgtcaagagacatgagtgatgtcactttgccttagacttcagagcatttatctgagagagctgtcaagaagttgaaagggatataaggctgccagtgtttaaacacagcctgatgttagatatgattagcattgttactaactgtaggataatggaactataatattctaaaggaatcctcaataattaggtgaaagcagttgtaggagacctgacctcttgaaagtcccctaaagccttcagtgacatctcaaacatttatttgcagcctaaataccatagcatatgctctctgtagtgagggcaagttcatgtccaagaaatctacactcagaaccaggaaaaaaaaaaaaaaaacacaagctaaaagggtaggatctgacacacatcaagcttccctcaaccttcatgagtagtaattatccaacccatgttgtcccaagacctctagggaattgtcaatcaaggcctactggcaggagattccaaaggccacggggaacatctacacagcttctcactgtaaaatcctccaagtcccttaaaactccagatgagaaattcaaactgaaaagatctattcttttccaagacattgtgtgaaatgccagagtactaacactgagaatctatgctgataattatatccggggtgggaaattcctgcccctcagtgcctggtaggaatgtggataaaaaaggtggggtggaaggtgttctatctaggggccattttggttcctttggctctcatagttttataagttctcaattatagtctgaaaacagaagcatcttattttggcagattcattaatatccgatttaggtccagcttctcatacctgaggtagccatacagagtgttttaattctggcttgtaaaaataagtgtttttaaagatgcattcttcatgcttggatcatctataattacagtccacagatttatgtttggacatcaggtacagaagattctcttaatcacaccattaggttgagagcacattattagctctggtctgtgcaccgcccctttctttactccactcttctaattctctaacccactcacattcctttctcatgccttggccaagtattttaacatattttatgtctacctttctgttcccatgagcactcacaatatgaatgtgtttctccttcttagcatgcatttttttgtgaaacagtaaatattcctttttggttatttttgtttttatcattgtgtttttaaggttaaccttctttaagaacacctaattctttgatctgggatgcagcaagaactaactccgagtgtatgctcactgtatatgctctcacttctctgcagaggaatgcctccgcgtggtgtgattgttaatatttaactgaacgccaacctgtcatgggagtcacttggaagatattccttcaggcacatctgcaaggacatttccagagaagtttggctgaggatggaagacccactgagtatcacagcaccatcacatgggctgaagattggattaaaaacaagagagcacatgaggaatgcagcactggttgctctcctgctttctgattgtagatgcgatgtgaccagccacatcatgctcccatcactatgccttccaatcacaataaagtgtcccctcaaaccatgactcaaaataaacacttccttctttaagttgctactgtcagttaatttgtcacccattgaaaaaagtaactgatgcacaaggtatatatggtccagtccaagatgcttctacaagaagatggtggcactattgtataggtcacacagttacctgatgaaggacctttgggattctccacaacaaatcatgtctttcttatctagttgcccaccagaaaccaggattagccaacatgcccatcagtctacagcctccactcccaatcattttcattgtaatgtttagctgcagacagtttaagtctttcttttcttatttataaaaatttctcttaaatatatatcaaagaaaattggctgaattatataagcatcattaaacacattgagaaatgaagaagctctcagatatagccagatgctaaaggcattctgcaaaccatgtattcatttctttgcacagtcaagattgaattggtagattcttagatataaacttgccccaaatcttttcttaactaaaacataattgacaatatatacatttggaggttatgatgattattggtctagaatccataacttatacctacaaactgcaaaatcatctcttcattggcccatcctaaaagtatggaaaaaatgctatctgtgacaactattgttatttatttaattttagctttattcattttatttattcatttttaactttaaccattggattgaaaagcataggcgagtatagaaaaaaatgcagtcagaatactgccccacccgttccacctccaacctacttttatggattcctcaataaagactgttctcattgtttgttgcataaaattgaaccgtattattgatgattactaagaaacaatacttgatgacatttttacatacaaatatacctcaaagataataataaaacaaatgcttcaataaagtgtatatcagaataaaacaagaaacatggattttttggtctctaaatatatatatgaaagttatatttatattatattgtattctattaactgagaaatgctatcatgtcgcaaatacacatacttcttttaaaactgtgttcctaggtgttaaaggtcatgctgaccttcagcaaatgttaccttttatgctagtggaggatgttgccttgatgttggtgagcaccaacagaccagggtggtggttgctgaaggctagagtggctaaggcaacttcttaaaataagacatcagtgtagtttgccacatcagttgactcttctttcctttcatgaaagatttgcggatagtgtgtgatggtgcttgctaccatgtacccacagtagaacttctttcgtaatatgtggtcatcctctccaatcctgtttttgatttagcaaccgagtttatttaatattctgtatcctttgttgtcatttcaataatgtgtgatcatctcggaaaacaattttatttgcttatctgaaagaattagttatttatctaatccagctttatcaagaaattacaacacatcattcacatgttcaggctccatttctaagtctatttccacatatacagttattagttctacctgagtcctagatgcctcaaagatctccaaaagggttgaggtcaacttcttccaaattcctgttccttattggcattctgatcttctcccatgactcacaagtgtttttggtggcacctagaatgtgagcactttccagattttcaatgggtattactcagatccatcagaagaatgacagcccttaccttataaaatatatttattaattaacaagaggtggaatttaaaatgattccttgttccattgaatgtaaaatgggtgctatggtggcagacataaaaacagcatgagttctcttatacatctatcagtgctcttgggtgactaggtacatcatcaataaaaaataacattttgaaacgagtcctttgtctttcttctaaaaagagacaagtatggaatactcagtaatccatgtcataaacagatgtactgttgtcagccatctattgtgacatgtataagccatagaataaatttaggataattcttagagatactaggattttcagcatggcatgttgttggtacattcttggaacgcagtcccaagaatggagtcattcttgtgaggggaattctgagtgcttgtgagaaaactccaagcaaacaagacaaagtcttgtgaccacagtttcttcaaaagcacaaaattgttcttggaaggtgtagcagatagcagggagttacttcagctgttcttatttgtatgcctctacggaaaaacatttttgtcacatgtggtttgtctttgtggttgaatgccttactcatggcattcttctcaatcctcggagtataaattgtctgatgctctgaataaagttgactattgcatgagacttaagtttatacatttgtaggccctactccctcaggttgacaccaccaattagagcagtaaacagtatgtgatcataagagtaatgttgttcccctaaaattcataatttaaaatcctgctcccccatgtgtctgcatttaaaaataacatctttaaggaggcaatgaaggcaaggcagagggaacagcaccctgaaaaaccaaaccttctgaagcattgactttggaccgcctgtctccagaatgaagaaaaaataatctgtttctgatgtatatgcctctcagtctccaatattttgttatgctgtactgagccaaaaaaaaaaaaaaaagaaatgggaggaaaataaaatcagacttacaagctgcattctaccaattttatttattcttgcttactctgaggcttctaaatttacctcatttgggtgatgcatacagaaattcaccattatgattatgtgtttgtcagggtttgctagtatttctaacagtttcgttgaatttatttaaatactctgacgttcagtgcacacaggtttataattcactcataaatcttgcctcccataattgcataatattcctatttattctgttaatgtgtttatttcatttagtgtttttgctttcagtcccattaattatggtataatattaatactgtaactactgcttttcgcatgtgtttctctttagccaacttgtatatgttgacttttttaaccttatttttaagtggttcttgaatatttatgcacattaaagcatatttagactggctttttacctcatacaaatattttcagcatttaaataaagaattcagcctttttatacattgtttaataagttttcttttttccataacattacacatttgtgttatagttttattatcacctatatcccatgttctgctttggggtacatttaatgagatttgtgtttatacattctctattttttaaatcatttttaatgtgcattaatgtaagggtgtcagatcccctggaaccggatttaaagagaattctgagctgccaggtgggtgctgggaaccgaacctagatctctggaaaaacagtcaatgctcataaccactaagccatctctctaatcctagtctttttctttttatttggacatttttttttctgaccctactctttatttagaccatgacaactttccttcctgaaatatgccattcatcatctccaatggaatgctatttattccagtttcttcccatcctaagacaattagattagatacttcttttggcttctgtcttttccaactagatgaagtatttagatttattttagttaattcttattgcattagtgttttttttttctttttcagtgacaagatgcctgaaagggcaacttattgaaaagggatttgttttagctcctggtcatattgtctattgtggtagggtagcatgttggcagctgaccacactgtatccagtcaggcagtacaaagatgagtgcatctggttctcaaatggcttcttctttcttcagtctgggacctcaacctatgggatcacaccatccacattcagggtgggtctttctacctcaattatatatctccataaatgcccttgatgacatgcccagagctgcatctccaaatgattccaaatgcagtcacattaacagtcaacaccaactacttcatctatcaatagactctacgaaaaaaatcttgaagctttggtttgataagttagtgttagaattccagacagctacgggtcccactgaaacataattcctcatttaagttttgttttatactgctgtggtccctttttttggtatcctaccatattaattaagctacagatattgttggtctcattggctacaacttgtctcttaattctctgcaattaaaattgctttttctcatgatttgtcatctggtagttttcttcttcctctaatccagtgcttctcaacattcttaatgctgtgaccttttactactgtcctcatgtgtggtaactacaaccagaagattagtttgttgctacttcctaactgtaattttgctactgttacgaatcataatgtaaacatctgatatgcaggatatctggtatgtgacacccaaaggagtcatgacacacaagttatagaccactgccgtagtccttttctaataggaaaagtagagaccacacttcttacccctaccccaacatgtaaagatagatttctttcatgtttttagtgaatgccagtccttgagtatcagcccgcctccctcatcagtctcctggttttagcatccactgtactaatgcaaagttttctacaaagagccagctgttaacctaggactctgtactataatagcagggtggatagtggtgtatgtaggcaaaatggtagtcttcctcattctttcttattctataactagcttgttctttcttcctgaatgattggaaaatactttttcctttaaaaagaattctgattgacacataccacctgttgatatttatgaggtacaatataataagtgaattcacatattccttggtaatgatcaaatcgggataattatcatatctatcaccttaaaattttatttccttaagatgaatgcattaaattcctctcttctatttctagatatgcaatacattactgtcgattgtattcaccccactgtagcatataataccagaacacattattcctattaaacaataatatgatacctgctgagttcaggaatattctcagggcttggagtaacagtctcatatttacttttttgagcttcttgcagaatctgtagtcaatcttttgtcagatcagggaaattttaatcttttgtttgtctctcgtgtattttttattttcccactgctgctctataatttgcttgttataaaacagaaatgtatgaagcaaatctgttgtatttctggtggtggttcctgttctttgtggctttgttttgctattaagattttttcatctaccttagccttctggtctcagatttgccaattttcctttcaaagtatttcccacatctgaggctgggaaacaatgacctcttttctttccttggagaaaatgtgtgttttcattagatcaatttttattgttaagttaaattcatcagggctagaggaatggctcagcagtaagagcatgtgctgcctctgcagagaaccaaaacctggttcccagcacccacatcaaatagctcactactgcccataattccagatccagaggactgaacacttctgacctacacaggcaccatactcacatggacattcccacacatacagaaatacaatgtacacataattaaaaataataaaaattaagacattgtttaatgtttaaatcaagttaaatgcatccaactctccaaacattttcatttctttataaggaaagcattcaaaaattattctcttagctttataaaatatacagcacataattgttattaatggtttaaaaggactcagtgagaagctacacagtctaatcatacttaaagaaggccgaaattaatgaagacaatagctggaagtgaagcttcttgggtagagctagcaaaagacactatgactggtgaattcccaccctgttccaagagcagcaaagtgggaaagtgtgagatggataaccatggggaacagagccttctactaatgaagtctttgacattgcctaagtgaaatgcagagctgctgcagagatctgagtgatgagtcacatcctattaagtataaaataatcactactatgtcgaaaatcaatggaagagtggaaggattagactattcaaactttacagaataatccagatgagaaatgagaactgggtagagttctatcgcagggttcatgcttagcaagcacaaggaattgacttcaatcctcaggagagaagacataatagatcagctgacaccagagaaggtacagagagtggtcagatcttaaacatatgccccaagtagaagagatgattaagggtgaaacagaagaacgatgcagatgccaaagaatgaagctgataagaggctcatagaaggaagaattgatgcaactaatccttggaatagttgagaaaggatataatcaattccacaaaatgagaaataattaaattaaagaagagcataactattcggctaggattatgtggacagaggaaggtctgagtctagtcatggatactaaattaatacaatgtttgctgtgtttgtctgatgagaagccaatgggtagacaaagggtaagtctggaaaagaaggtcagatcctgatttttacatgagtttgaggcatcaaacatccaagctagtgtggcatagagcttcatctggacattagagtagaagtctgtttgggagaatctgttactagattatagatggcatcgagtgttctgaaacagtatagaatgatcaaggagctagagttgatagggggaaacacatcaaaataccaagtaatagggatccaacattaaaggattgtgaagaagatcatccacccgagagatgaaaatacagcaaggagtggattcatatctttgaaggaaaagaattggatacatcgaaacccattcaagaagtatcccccaaaaaatggaagaaagaaaggggacagaagggaggcagaggcaggtggatctctatgagttcgagaccagcctgggtctacaaaagctggttccaggatagcctccaaagccgcagagaaacactgtcttgggggaaaaaagggaggcagaaactaacaaggaaacaagagcaggaatgtgaagggaaaagacattagaaataacatgtgaagattgattaaaataatcagtagaagatgagaaattgatgatgtaagaagtaggaaacattttgggaaccagactttaggatggctgaaaaagtatataatctattccacaaatgaaattagagaggaatataatgattcagttggtattgtgtagacaggggagagtatgggcccagtcactgaaactaaattaatacagttttgcagtatttgtattaaaaatacaataatccctgtctcagcttaatccatgaggttctgcctgtgttggggtgtgtggacctggaagctcttagcaacccagtggtgataaagaccaaacacaggcatcttgtcatcttcagagagctctcagttccatgttgtagaactagagtcatttctttattagccatcttttctgtcccttcttaatcaccctgccaataccacaagggaaccatttctctctttgttctcctctctcttcttaatcatcctgccaataccacaagggaaccatttctctctttgttctcctctctcctctggtagctcacccctaaccttccaaaccatctgtcctcacaagttactcacacacctctcacctttgcccaggtgagggcctattcagatgcttaggccctcagagaagcaaataggaggcattttaccctgaggccatggtaaacaatagtagccctactggcaattaacaatacaatagtgagctggagctttctggtgtcccatgtatacaggagctggaggctgggccccaaaatattccataacagaattatttggtcccccacaaatccccagagactgttgtttttaaatacttggtcccttcccagtggcattcttttaggaggttgtggggactttaagctggaggacctgcccattggaagcagattgctggaggtttgcagggcagccatgcttcccacttatctgtttcctgattgcccaagtacaaaaagtgttagccacatgctcttgggattgtgcatctccaccatgccttccccatcaacatggactatattttctcaaactgtaagccactataacttcaccttgtcgtcagaacctgctgacctgtcgaacagcacttgaaatgagggtatgaggattaaagagacaagacaaagagttacactcaggaggactgtcagtgaatacttccatctggagttcattctcctctgtgcttatatacagttcagaaataggcaacattgttatagactcaggttcaaggaacagttaagccacttcaaaacatcctgttttcaaggaggtaacatgcatgctgttttacttgtcaaaatatctcgtttgtcctgttcggtaaaactagagcaaaacaaggaggcacctttgacccatcagaccaagatggagtcactaaagctccccccaccttcttgtgagttttgtcagatattccatcacagaaatgagagacattgctactaaggaatccatgagtgggttcttctaaactcttagagttcctctataaagttagaggcaaagcaataaatcagcaggtttgctgagagtctgggtgtgggacccacaggaaaagagaggtaagtttactggcaagaataatataacacattgtgctactatcaacaacaggtatcctgactcactcatatgagccaatttttaaatgccaaaagatactcagacaccgttgttaaacataactgttaagtcatatgaaatccaaacaaataatgcattttcaaaacaaaagtaataaatgttcactactgattagttaattacattttgcagtgttgttcttggaattcttcacacaagctgcatctgcatctgcatatctagaatggtgccccactatgactctcttctcaattgtacattcagtgaaatgatacaatgagtttgaaattaatcatgataagggtgttcacaccacagaaattggaaagtacaaaaatcaatgcttcatctcttgtttgcttgcttgcttagactgaagcaatagagaaaatgttaggagtgtggggaaaatgtaaatgtgtgtggcagtggttgttacattgcacaaacacaaagttaagcaactatttgccccatattcaaaaccatccttgggttcagcaaagacacttctgtgacactgacatctggctaaagttcctatgtaaatctccattgttttactttgaccttaattgttaaggtacataaaagtagcaactgacattgatgctggaacaatatcagttcattagctcaaccacaggtagatgacacatgagaactttgtcaagaatgactaaagctactatctctcagtgcaaagtatagtaatgtaagtgtatgttttgttgttttgctttgcattgtttttcgggaagccagcagttaagaactcagcagcttatcatcttctttacaaaaataggaaacatgggcaggagagtcagtcaacaggagactttcacctgtaatacatgctttttctctttgtctatagtttcagaattcctaaatatattatcactgtcatttgtctactcaccattccctttgaaaatagcaatattcaaaagagtggcaacagaaaagacaaaaggacatcagtcagtcccttcttaattccctttgtgacaatacaatattgtacaatttcaatcccccagaggctcactgaatacccaaagtgaagaaaaactccccagaaaagactccaagtattagagttggaatgtgaaatgcccccacaggctcatgtgcatggatacttcctggtctgtgtagggaaaaaggaccagccaaagaaacacaccctgtgcagagccaaagaaacagactttgtccctggaatcagagccggtgaaagaaatacacccaggccctaaaactagagccaaaaggctagaagggatcagtgaaagaaacactcctgaaaccagggccaaatctaaccctaaacctttgcagaaaactaaccaatccttgagcaggagatctagccatcctaagctcaagggattgaaatctgaccaatccccaccctgaaaaaactctacctcctaagaatccctatataaaccctgtgtctgttcagcttgtggctgttacactccgctctccactgtcctggggagcagagctgaacagtaacaacttttcaggggaaactctcccttactggaacagagttgatacactggagaagcctttctctgaagcagggctgtaagctgctgtgcttcctgtgacttatggtattcgttggctcccaagtgccagaatacctttccatccaagctgtaagaccaagtattctgtgattcctgggtgccagaatacctttccatctgagctttaacattcagtattctttggctcccaagtgccataattcatccccatccatcccatccgatctgtcccaaaatgcttacagtctgtccacaatgtaagaagattcaacatgatgccctgaagtgagtgcaccattccctgatggaccaccattcctctaaatcatgagccaaatcaatccttcttcccttaagttgcttctcttgagtactttttcacaaaaattagaattcaatacagaaaattggtattaggagtggagtcattgaaataaatctgaccaggtattccataggttttttgaactgttttgtgggaggaatgtggaagagctcagaggtgctttagaatgccataagcaaaacttaataggtagttctggtgggagtctggaacactaaatggatttgatattatgagaaagacatgagcatgttgagatcagatgcagactgttatggctcaaatatgaaatatctactattggcatatgcacttgggcttttggtccctatatggcggcacagcttcataaagttgtggaaatatacaccaaagcaaagatggtttgtaggaaaacttgatggccatctctaagtctgttcagagagttagctttcagtattgttggactttctgtaaggagggtagatttattgagcttttggactcatccactcgtagtactcatttataagactatgtgagcagtgaaagtattgttagacttaaaagtcacagacttctattctggtgcccccatagatattaaggaatataaagcattaaggaatttggatcaaatgaactttaagtcctttataagtctaaatttcttcccaaatttactcatggtgagcaaggagcatcatgaaacagcaagtaactattcactaccaagagctatgaacaatgttctaaggctgaattttgtctctaaaacccaagaatacagtctactacctcaatcaggctcaatttataaggaaaatatccactagtggttcaaaggaaatgtttgacaacaaatgaaacagacagcagagcatttaagtttcctagtgtaacatgtattagttcaagagtactcaagacaaggcaatttcatcatcacctcactgtccctactgagatgtatcaagattttttttgtgacaaagacaattatggctcacaaaaaaaaaaaaaatcacttgccctttttcatttcccagatgctcttgaaattgtattgccatgtgacaggtttagtactgataacatgctagtagagattaggaaagctaattctaaatctgtccccttgggagccccacaggagctacctctacagtggtaagttcatgagagataataaatgtgcctactacaaactctttattttccacattaaatacaatacctactaactcttgaatttgtcaagcaatatcaaggaatggctaatacgcacaatgaactcagctgccactgctttccccttccttccaaaggacaaacactgaaaatgaagtattacttcatgtgacaatgcatgtaccatgagaatagaatgcatcgctatggtcaattctgtttgatcaaattaaaccataagtaatctcacatcataacttaagagatgtaaagtgaaaaataatgtttatgaatttttgacaaataatagtatgaagaattgtgtatttagtatattctacaaagggctagagaatgatacttcaggttattcattactggttacttattttttaactttttgttcagaataagtctagattaatggaaagtcatataaaaagagatagtaaacagatatagtactgagagtttcttgaaacctttaaccaaggatgacaatttcatgtaacctagtacatgaacaaaaccaggaaatttatatcagaacaatgctgacatagactttactgggaaaacacttctctctctctctctctctctctctctctctctctctctctgtgtgtgtgtgtgtgtgtgtgtgtgtgtgtgtgtctgtgtgtgtgtctgtgtgtctgtgtgtctgtgtgtctgtgtgtgtctgtgtgcctgtgtatctgtgtgtgtttgtgtagggttacaaagttttatgtactctgttcctttgtagatttcatgtaactaccataaaacatacttagactctttttaatttttacccaaacccctccccatctcctagcaatgactattctctatctctatagatttagcatttctgtaatgtcatatagacacaatcataaagtgtgtaaccttttttatattttccttcctcactaaccataatgctattcacccctctccacgttattgcttgtcttaattgtttgggtttttgttttatcttctttttctttttattgatcaatagaattccattatcttgatgtaccagaagtttgtctgacttcacctattgaaggacatttggattctgtccatggaaaagttgtagctaactatgaataacactgttgagaacattaatgtttgggatttacataagcatgggattttatttctctgagaaaaaagccaagatacaattactagagaataagactaatgcatattttattttcaaatgaattgccaggtgacatttctcaatgttaataccacatgccacctgcaatgacaatggaactatgtcctcctggtcatctataccatctggtcttgacctacttttaattttgccatcgagtaggtatatggcaagtctctttgtggtctcatgtgcacattcatgactaatgaacagcttttcgtgcatgtgcccattttcttttcttatattctctttaaggaaatgcaccgtcatgattgttacccattttctgattagattgtttctttattcttgttaaggttcattacattttcttgatacatgctgtttgtttcatatgcttaacaaacatttttacccactactcttattgttaattcctaaaatgtgatttaaatctaagatttctcacaaattcaaatgaatttggatgaagacgctgaaaattagaatataataagggactatatataacagccatttctgaaacaatgagaaattatcattgcattttaggtaggagatgcatgaaggttattgagacccagtgggaaagtgttacatttcagtcagtgtacctgcaactgattgattaactttcaacatcctaaattgaagacaggggaaaacacattgaagtgatttacttagaagttcatcaagcatgtgccaatataataattttttaatccaacaagaaaataggtgtcaataaataagtcattaataagctaaagagtcttatttcctgtgcattgaagcttatttaaagattaagaacggcatcaagggatgcatttctcaaagactaaagggtaatgttaatgtgctataatgtgctaagtgtttactttcaatgacagaaaggtctaatgcaacaaaaactagtgaaagaaaagcattttatcagcaaacagacaaccagaccttgtataatctactaactaaatatcaagaactattatcactgttactaaattaaaaactgataagaaaaagcaaattactttacaagagtggtaaatggatatttgcttattacctgaaaaaaaaacaaaataaccctctagagtggtttcaagaataaaatactttagtaattaaaacaaaattatatttaatggatcagattgtgtatatatgcagataaagcaagaatataatgaagcataatgatgaaaatggaatagagtgttattggtgagacctcatttcatattatcaaactctagacaaacactactaataaagataatgactataacagatgttctcaccttgcattaatgagaaagttaagatcattttaaaattgttctgaggtcacatgttaacttctctacatgtcttgagaactatgtatttcttaaaaatactattcaaatgttaatgtgcttttcccctgctgggaatggaccacagaatagcctgcttgctaggtaagtaccccactctgccttcatccctgtctcaacaagaatctctccgagtcttacaaaaaaagatgcctcttgtatcaaagtaaacctaatttacaaaagtgaagggatgcctggtctccatagcctaaaaccaaaagctattctattattttccaaattttctgaataccaagtacctcatgcttactgctcaatttagaaacaaactggacatccacccatgtctacacaaggagttgaaattaaaagcaacacgaagctgtcaatcaatcaagtttttagaatgccatccaaaaccatccttcagaattcttagaactccatacctatcaataacatactatccaatcatttacccatatttcaaagacacgagtttcagtggtcatatcaattaacccatgttctgccaggattacatagaagggttcattttatcactaaagctgggtaaacaagagttggtgttttaattagcaggatccaaggagaaaacatatatcattttaaaggtcccagtataccctcattaatttattttctggctcttccagatctttttaaaaagctttatgagaggtaactacagaaacacactatgaaacaaattatttttaagatgaaataaacaaaataggtctcttaattgcacaaacagaaaagattcattgatcttgagggaaacttcaaagtcaccatacggccatgtgtgtttccaaaaatgtaattcagacacatgtattgtggtgcagaaatacaagccatccctgagtagagaggaaaggaaagaagaaggggtgtgcagagagagagaggtatctgttcaggttctgcagggtggatgctgtccactctttctttgggggaaatttcaggtttgttggctaatttgctttcgttttatttttttatcttttgatgatatttctggtcattgaaagtttgacttaaaaaaaaatcttcagttcgttttggaaaagaacctggactagatttctaattgttcctatagtctggtttccaaaggtgattaagccagagtacacagatgtgggcctgcaaggttgtatcccacaaaaccttgtgtggttccctcaagaaagaagcagtgcaatgttgacatcttgggcctttcataaaacaggcccaggactccctgctctctctgagtgatgtggtaactgagctcaggtcccacagcaacttgcccacagacctaatgggggtgtcaggctggagcgggtccaggccagaggccaaatcagaactgtgaaatgtagagcagtcaagtctcatagttcattgttaattaattcccacggtgtttcccttcatctctgtgaacttatggtatagccctaataaaacctatgcttgatctcaactctgtgtgaaagctctgacctaaataaagaacaaggacataaaaggcaaggcagcccccatttggactagaacatcaggtcctagaagacagaagtcttctaaggatgatgggaccttgatgtagaagcaccagtcagtatacaagcctccccacaaggaaatggctaaagagaggactatataagggcccagtatcctaaagtatctcaggaaccaaacatctacaaactcatggtcagtggataattttatttacaaagaactgcaggctgacatgtatatatttatgggcatttttattgtcactgggtcttttgctttgctttcaattaatttttttcagttggcatactaagtaatggatttcattatggcatagtgtgtgtgtgcatgtgtgtatgtatgttcaagctgtgtgtggtggggacacgtgtgtgaatgcctttgtacttgtgggcagataagtcctcacacttacacaccagtcattacccatggagtcatcttccagtactttgctttgtttcatattatggcacttgtatacacatgtcagtatactttgttcactgtcacccttccctactgcccctccacgttcttgctgatcccttcctccctcaacattctgtatattccatggccctctctttccctgaccccctgaaggtttcctcctcccctctcatgagcttctttctacttccatcacatgtagatgcacacagacacagacacacacacatacacacacacaattcattttgcatacaaaagttgtggtatttatttacatatgctttctttgtcttaatataatggtctctactttcattcattttcctacaagtacaatgatttcattttttctttataactgtatcatactcgatgtgtatagggggtggcatgggctgagatcccagaaatgtagtttcactgtcatagagttgaagttggctgggctgtgttccctccagacactgacagggattctgtgccctgcctcttccagatcctggtggctgccagaactccttggcttgttccctcatcccttcaatgccttctttcttttaaacaggattttatgtgaagtctacctatgcttttcccataaagtatgcatgtgattacattaagatctacccagatgagccaggacaatctccccactccaagacactttaattaatcccagtatggagatcctttttcctctgttttccatataaaggaacattgaaaggcttggggcttgaggcaggatattagagggagaccactttttagtagaacagacagaagactgcagtggaggcagactatgaggcatgggcaaacattcagaagcatgagaggactttggagacagcagagttcaatgtggctgggctgctgtctacaagatgggacttggaaaagaaaaggtcagaagggaaggatgctccttctatataaaagagatttggcatggtgcttcctcctgtgcactgagtcctgggttcaatccccagcaccatataacacaggcatggctaagtgtgcccataactctagccaagcctagcttacaagagaccatgtttcaagatatatatatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaaatatctaaaggtgacttttgtgcttcgaatgaactgggacacataggcatcctgtggagctctgtactcacaaatgagcagattgcagagaagcaccggtcccactcatccacagcaatcacacacacacacacacacacacacacacacacacacacacacacacacaacacacacacacacacacacacacacacaaacacacacacgcacacgcacgtgcacacgcatgcacacgcacacataaagagcagcagctgaagggtctaagtatcaacattgtttttcccttaatgtcttggatttctttgggtaagaaagtaagaggataataggctcaaaagtgggcagaggagaatgagaggcatgagagatgcagagagagttatgggagtaagttcatccactcagtgagtacttgccaagcacctaccacacatgtgccaggaaccatccacattgtgcacaaaacagcaaagagcaagatatgagaaacttatgttcttgaagcttggcgttgacatttttgtgtcgtaatataggctctgctccatgctaggctcttacttttattctctttaggcctcacagaaggggccaggaaatatggattgtatgccctcatgaacaaggcagaagcagaaatgtagttgatccatctgaaacgttcctggatgtccattccccatagaagtctgttctctacagctattcgtttcagacttcagtgtgcagtcagatgttctcccaaaactctaaccaaggaaagcagaagagtcccaaggataaaacagaggggcgttcctgagtgtgaccagcactgttggccatgttaagctacgtggacttggctggatactcatggttatttatagagcaagtaagctctaaaataagctgcaactgcagatggctgggccagatgatctttcatggtcccttccaactccatttattttgtgattttttatttttatttttaatttttgtcccagtgtatatcacaaggactaacaagtggactgttattaagaataagaaaacaggacaaaagatttcttgtcataacatcaattgcatgataagaaggtacaaatgtatctttaaaggaggaagtaattgcattcctgatttgagaactcctaattatccaagaacgtcttcagtgagttgtactgaaggtgatttctacaaccaaaaaaaccacaaaggacccggagacatgagaataacccccttgttttatagaaaaagaaactgtgtcctaaagaggcaatatggaatgtgatgtttcctgttcgtccaatggccacttataaaaaaaaagtattcaaatcattttaatacagattttagtttccactaaacaactcatagaaaattctagacccagtaaaatgttaaaatagatgcatgtgatgtactaaatgcatatgatttgtgatcatggtggaatttttatataaattcacataaaaattaatgattatctattgagacaagttctcctaactcattagatagacccaggagctagttaactcttttacaacaagaatacaatactgaagtaaattatagtctccatggtatattatattacatcttacttaaataatttccaaggaaacgtacattaaatctggagcttggcccatatttgaatttcccttgggattcaaggaatcatctggcaaagaaatgtcccagctagaaatttcatccatctgcataatcataaggaaaatgtcttatttgaggtataaaaggattaagtagttttgggggatggggtcctaggcactgttgcttttagaaggaacatgagaattttcagtgaagaaatatcttcatcaatttgaagaataagcatccactcagttgctgctttacttatgtccagagtggaaataaagcatcgagtacaccagactccaacactcagtgaccatggaagacaaaaggcatctctcctccataaacatcattgaactattctgaagaccacatggttttaaagagtcacaatgtatggcctccttagaaaaccaagagaaggaatacagagttctcacaagtacactgattctgtgaggtagcaatactatacttagttggacatagccatttcacaatgtatttcatacttcagaatatcatgttgtatacaataaatgcacataattgtgtatgccatataaaataagctaatagagataatgggatggctcaacagatagaggtgtttatagaggcctgatgacttgagtttgattcctgagttccacaaggtgacagaagaaactcccaaaagttgttgtttgctgcctgctcgctctctctctctctctctctctctctctctctctctctctctctctctctctctctctctctctctctctctctctctctctctctgacacacacacacatattaataaataaataaaataagcaagtatctttgtaaaggaagttcagtctctcttctccctactaaacaaaacaatatgccaaacattccataaatcatatcaaacatcttacaaacataactagaaagattatatttttccatcactccagcagcctcttgctcaataacctttatttagctatggtctctcttcactccaatgcaaaaagtagaagggacagccaggcatcagccttgcagaaaatctattattacctccccaggaagcatcagtctttatttatgaagaaaatcaatgtccacaaaagcctcttagcaaaagccttaggagagaaagatacattattactgtgataaaataactttgggttgaagagaacagtaaagaaattaacatttatcgagttcttataattagctgatacttgacatactcatttaatcctcactaaaatacctctgtgtgcccacttgggggtggcggcgggaggggggactttacaatagtccacaccataaataataaaagcccaggtttctcttccaccatgtttgtgtccccatatcaccacctagagatttttctcatcaaataatgcaaacggggtgatgaaacaagctttcagaatatgaacagccaccttctctcttcactgggacaaaatatgtgcatgaagaaatgtgaaattcttgtagttgtgattacaagttagtttcagaattatttacctgtgggtttcaagaattctgtggtcatgaatttccagccatcagtaaggaaagtcccagatggctccttccacctcccattctgtgacccttgccatatcaaaccttttgtttgtcttatgaggagactaatatttgctggaagttcccctgagggcgttagagttaagcagggatgtacatgctctctgaatgaatttccctcagcattaatagaacacctaacaagacaacaaagacttgtgacttaagagagcttctagctgttagggagtctattgacctctacccaggccctcgggtagatgaaattatacagtctctgtcacaagtttaagcatggtgctttacacatttgttccaagaaagattttcacaaaatggaatgcacacaagaaagatcttttgggaatgctttcaacaattatatttggtataatgtttattgttactactgaaagagtaacaaagtcagaaattatagtatgtgtaaacaaacttatggaactgcttcagatgttgtgtgatagagcacaccaagccaatagtgtgaggggtgtgtgctcacacaagtgtaagtggggggggggtgattgcgtttccatacattgttattctgcgagagagtaaatgccaatgactaatcatggaaactgcttctcaaagtattttctctgtgcttccagatcacagccagctgaaatgaaggcatttgtgggcacgtttggattgcagaagtaaaaatagaatatggtcagatttggtcatggagaggcacaggtgctcaacatgccttctgtttcctctgttggacttctatgtctccttcctggctgctgatactgtatttgaccttacagtgccccagcctcacaaccatagaaaatgaaccagaggcaataactgctccaggcttgtccttcagctctgaccactactgtaaggactgggcatggaagccctggttgaacaacccccagggcttcatggtgacttgggagtcttccctgatgctggactttcatttcccaaccttcatttctccagattctttcatagttggtaaggaccaactcctattttctgtattctttttaaattgctgccatcaatcaagccctggaccatatacatactagatggtactctaccactgagtttcaatcccaacaccttttattttcttactttatatacgttgctcttttccaagtggatttggctgacatggttatcaaataattataattcattatcacttaaaagattaaacaataaatttgatcagaatttagtttttggaagtgagtgtctgggccatcttctacatccttaatacctagcactgtctcagacacaaaaatgcatgcttaatattggtcaagtggaaaaggaataacctttagataacttaaaattttgctccacccaacagatttaatactctataattcagggaaatgaccctaaatatcaaaggctctttttattggccatttaggtaacaagaactgaaactcttgtcaatgacaacaacaggctcctcttgtgaggaagacagacactgcttctgctgatctctccaggtatcagcttactaccacacaactccacacatccctgatgcctattccaaacttcttggtgcctgagttctctgtccacgatgagaaagtgaattaaacagatatgctcagcaagttccatatccacctgtctttccccagcttcagcctgtccccacaggatgatgggaagacgggaaacttcatgcttatttttctctaccctcaactttgcaaagactcacgccacaacctccaaaagcagccttatgtcttagtcacttccataacagtggaacttttatcttcattacttaccagcacttaaaagtaaagaggttttacattaaaattgagacgaccagtgtgccttaaaatagcttatataccaaaatagaagtaaatagcccaagtgaggagctggcttgatccaagctttacctgccacttagcgtcatgcttaccctgtgatttacctgactatggggtaaagagatgtgaactatttcctagacttgtagctgaccctgtacttagtattctcctacctgtaaatgtaatacccatctggtcattgtagtcgtgcatattatgatgatgacctaagtccaatcaatatgtacacaggctgtctaaaggcggggaaggattgtgtctcccatgtaggttaaagagaccatcctgaggaaggggcagatgaggtcaatggttttcaaagagaacactggaaagagtattagcagtcgatgttgctggaacattcactgaacagtagttctggagaagcaatggaagactggccttctacaaggtgtcgcatggagctaggagtgaaggtcaaatggtgtcttgtcaagattgtggaagttgttttctattatgtaaaagaatgaacccccaaaattcactaatattgcaatttcattcataatgagtgatatttgatcatgcctctgagtaaaaagagtttgtaccagacatctgaaatttgtcccgacagagccacactcctccgtcctttattctgacccttgttgactagtagataacagcagtagctacctgagtcctaccttccagccaggttcaatcacaagggagctgggtgctgctgtgaataaaggaaagggttcctttgctgcaaggtcatctcaagttcattgcctctccccatccaaaactgatcacagttcccaaagagactaaagcttcagagctcagtgctgtccctatgttctgcagcctaagggtgcttatggctttgcttctgacagacccaaatcctaacagcattccctatggttgtttcatagcataccttttaaaatagatcctttaaattaataaagaattccttgccgacttaacctatttcaagtataccatctgcttcctatggggactctgactgaatcagccccaatagagtaaaacagttcacactgttaccctaagaaaagcagcactatgatgacaagtgaccatggagcttcaaacccaggggttcacttgcttagagtggaggttgtaagtcagacaggaattgaactggtaaagatttgaaacatggaattctattcaacaagaagatttaaagagtaattttctactaagagagaaaaaaagtaagggaaacagaaaagggaaattgagatgggggggtcctagaactacacagaaagttacagagaagtacattgggtcttttaataggttgggacaaggcatgctctggctctggcccataaaaggcttccacacagcagttgtacactcacagtgtaacatgggcttcaagacattgtctactggtacatagaccattacacacagccctttagatcctgcatccttgagagtccttgagggatgcatactgtttgtggagtacatggcatgatccagtgggattcatatgagtctggaaaagggaacaaaagaagagctagttacatagttcaagctgaccttgatccttctgcctcatgatccttctgcctcagcttttggactgataggattacacgcatatgcccaggcaccaggcttggagtctatattttcttatatcacattaatactctgatactaaagctaagctagttcctgggttcttctcaaagataacaagccatgaacatgggacatctctacccatacgtcaaccctagaaggcatcatcttctggtttttgtcctattctatccatctccagagtagatgatgacctacatctgctggagaggccgatttcctagtcaaatgtttattcatgcaaaaacaccttcagacacattcaataacagtgcttaatctgggccactcaccacttttctccttcattcatgaagtcaataaaatctgtagcacgtaatgattttatgttgtatgagaagtatgattctgcctcttaacgactaacatgtaacaggatgagaattcattacagtggcttgtacaagggagaaggtaaggtcagtgtgtgcccaagtggctgtgcagggggaaagttatatttcagatatggacactaatcacccgggaacatcctgactccaggccagtttttgcagtttcttaaatagatcgtatattccagtgtaaagttcttcctgtggctgttttgggcttgctattgtttataaggtgcctctggagacagaactcaggctctgtgtatgctatgcaagcactccaccactaatttggaccctttacagtttgggttccaaatgtcctctgaagtttgtatgagaaaggcttggacactaacccgtaataccattgtaaatgatgcagccttccagaagtgagacctagtggaaggaagtgaagccattgaaagcatgtccttgaagggtctattaggaccccaagaccacagaccataccctccctctccttcctggatgccataaacactttctctaccacacactctctcatcatgatagactgccctgtcgtagcaccaaggtcaagcaaccatcaacagaaacctctgaacctgtgagctcaaataaatgcttcctcttctaagttgattggcccagatattttgtcactatgcttgatacccagctaagccatatgccctaatccacaaataccttgttttataaatcttttagaaaatcaccaaaaggtatgtaacaaagtatcttcctggataatcattttcaactggatagcggtagcgttagccattgttatcaagatttttaatgtactattctacatttttaaagtgtatacaaggaaacaagaatatagattctcactcaccatgtttttacacaaaagagctcacagagagacatgacgtacacactgtggtctgccttttatttttcacctcacaataaatctccaagctctcttcttatcagcgcacgaggctcctccattctttattacagagccattgtatttcgttaaatggatgagccacactttatttaaccgacctgctccattgacgggcacttgggttgtttctaatctttggcttcatagcactatattgagctcttagataataacaagaaaaaggaaaggaagagacaggagaaagagatggaatcagaaatgagaaagtgctgtcagtggcacaaaggccagcgagctcatgtggggtaggaaaggctggatgaagtgaaggatagtgacaacaaagatcagctgtcctctccaccaaccctaacgttttcctttgaagggttcatgttgcaataagagtagactggtaaacattgtgttttctctgaaaagttggatcatcagcatgaattagccattagaggggtttctataaacatgattaaaatactggggtctccgtcacttcttctaaaaacaaaaattcattccaatcagccagtgctttatttccagaaataaaatactaaccttctccaaattcaacactccctctaaagccatgggctgtagttgggcagttgcagctgtgagggccacaaggggctgactcccagggccacagcccagaaaatgccaagcctgatttgtaatcctcccttcgttcccatccctccagggctaaaatgcccagctgcctctttctaacaaaaatttatttttatcaaggaagcaccatattcgctcagctctagagaaagcaggtctgagctgcagagaccaaatgattgttctcatttgcacaactgcttcgagagaaaatgagattaccagcatcaaggggaaatttaaaaattttccccaggcaagaagaattgacgtcctctgttccaagatgaaggtaggggggaattactgctccacctagctggagcctaataaagccgggcaactggcatgctcatgtgcccatgaacccagaaattctctgtgctgtgatttatgcaaacgtgttaattcataatttaaaagtaattgggatcatcttaatggccttttcttcctgttagcctgcctcagtggaagacccctgtcacatcaattgtggacgttaatacatcaatcccaatgattttattgtcttaaaaataacttagctgctatagcagctgccatggggagcctggtctccaaggaggaaggtttctaaccgtcagtccagtctcatcccccagttactgacatgcagaaaaagaaacattcacttttaataatagggctctctttcatgcaagaaaagtagaggatttctaaaaataaataattcatgctcctccaagctcccagagaataaatttgttccttttctgttttgtttttcttcaagatatgacatcttaggaagaaggggctgagggggagacagcactttctgcttctgtggatagaaacatgcagagtgtttcattccctggtgcaacaaagcctcaagatcaacagacaagagctgaaaaccttttcccaccagacagacagcgccatctaaatgttctctccaaagacagcgctgcacagacgggcgcacagaggcatgtcagttttccctttatgtgcacacacaacccttttcaaaagaaaagagaagagaaaagaaaaacaacgccatacccaaatcctgcacacaattaattacactgtgctgaccacatgaccagtagttctgtgtttacagtttcaggttttttatgtgttttgattcatttgtcattaaaagaacatgagtttctaatataccatcccctgatatttctcaaacaacagtccatctgcaaataacaaaaaaaaattaactaatacaaatttctgaccattactttcccaaattcttattggctttgtctggtataggtccaggtaatgctggtctacttaaactgtttgggaggcactcatataatgttgatgaaatatggcttgacgataaatacatataacaatttcctccctgatacaataacattggtcattcctgaaaattgactttttgtccctctgtgcccttcaatggattgttcttttgaaggcaattgtatatttgggcctggggaatggtgctgttggcttataattgctgatcaaactgaagcagaagtatagaaatatcataaaatctaagctcctgagatattgattcaaaactttgagaaggaagggcaagcaacaggttcatcaaaagctggtggaagctctgtactcttttccagccaaaagaaggggggtagaggagaggaaaggcaacaagggaaggaagcacttcaacacaaattttatacaattctgagggtcactgagctcagagcagaagccagtgccatcatagtcttctgtgttcctaggtcacagagtcaaggagagctttgtattagtgctcagcaatgagaaagaagtatgctctgtgacactatggggaatacaactaaatgattcacaaatcgggaattagatattccaaacacaagaaacaaaacttgttagcaagcatgtaagggccaagatgtctagtgcaaaatcaagcctaacagctaatcatttcacataagccatggcaacagatacttttaaattctaaagtgtaagcatttggggctagagagatggctcagaagttaagagtgcatgctgccctttgtaaaggaccaaagtgtggttcccatcaaccatactgtgcacttcacaatcacccatagctccaagtccaagggatctgattccttcttctggcctccaggggcaccacactcacaggcagaacctacacacacacacacacacacacacacacacacaccacattattaaaaatagtacaaacaaagaaggaacatagtaggactagcatagggaagggatgaagatttgtaatttgagtttcaaaagaatcttcccaaaataaagctcaagcccttggattgcccattccttaattctgcattctgttatgtctttgtgacaattccccaggtgagtcactggcatcacacaaagcaattctccacaaagtagaacaaggtcagggcagagccagaatttctatgcagatattaaggttgctcatcctattttatctatctgattgcacaattagaggaatggtgagatcatgtctacaaggcaacctgagcctgcaaagaaaggtattataataatgtgtagcattgcttcatcagcttcagatggcctatcactgctatctgtttatttaagagtgctaggagaaaccaataaatgccttcttcaaaaagacattgtctatataatgcacacatagattgagtgtcccttacccagaatgcatgggaccagaagtgcttgggggatttttcataatttggaatgcttatatatacacaatgagatgtattagaggtagaccccaagtctaaacatgaaattcacttatggttcacatacaacttttatgcatagcctgaagatgatttcatccaacattttgaacttacttgtattttaacaccagcttagcatgtgaggtcaggtatggaatgttacaattgcagcaaccaggcagcactcaagagaattggactttgcagcatttctggctctaagtttgcagattaggaatgcccaagctatgtaacatatagaaataactaataacaaatgaagtcaatatataccaaatacaaaactcaaggacttttgaagggcccagaaaaagaaaactaaagaagccagaaatgccaattagatggaaagacaggggctaggaatgtacctcagtctacagaatgttttatctatacaagtacacataggccctggattcgatccccatagccatataaactatatttgctggttgtgctggtttgaaagagcatggctcccatgggcttatagactgaatacttggtcaccagggagtggtgctgtttgaaaggatgaagaggtgcagccttcttgtaggaagtatatcactgggggtgggctttgagatctcaaaaagcccattctaagccttgagtctcttcctacagcctgaagatccagatgtagaactattctcagctactgttccagcacctgtgtgctgccatgcttcctaccaatgttaataatgcactacacccctgaaactgtaagccagctccaatgaaatgctttctcctataagagttgccatggtcattgtttctccttgcagcaatagaacactttagtcagttctattgaggggggcatgactataataccagcacttcggaggtggagacacaaaggtcagaagttcatggttacacttggctatgtaaggggttcaaggccagcctgcgcttcatgagacctggtatcaaaaacacaaaaagaggggctggaaaaatggctgagtggttaagaacatgcagtgctcttgcagaggacatgagttcagttcccagcacctacttcagccagcttgcaaccacctgtaactccacttccaggacatctgatacctctggcttcagcagatgctcacacccctgtcacacagatacagacagacacacatacacgcacacacacacacacacacacacacacacacacacaagagagagagagagagagagagagaaatacaaacaaagcaaatcttataaacaattatttcaaaagttaaaggaaggcagggtagaggaaggacaattaacctgtactttattcagttgcctcctgctaaggaaaaagacgaaacacaaagtttatgtacatgaggtggtgatttgtttgtgggttagtaataagggtcattttgtgtggctttacctggcttcactcctatgtctgggactgaaaatggagaacgttgaatatctgggacaactcaagttttagggtctctctccacttgtctctcatccttcaacaggcagggctctgaaggatcaaagcaaaagcctcaaagcttcgtatagccttggttgagacctcatggtcttcattgacacttcattgtgtcaatcaaaagaagccacaggccagcctagaggcagacaccagcaaatacacacttgtcacaagagggattgcaaattatttgtggtcgctttaatcaaccaaaaaatactatccatgaacctgtacaccatgcaacgctagcttcttttaaattaggaaagactgtttcattacgactatcggcctgaatgcaaaaaaaaaaaaaaattcatgtcaagtaagacattgatcccacagcatttattaaaaatggagaggccaggcacacacctttaatcccagcacttgggaggcagaggcaggcagatttctgtgagtttgaggccaacctggtctccagagtgagtgtcaggataggctccaaagctacacagagaaaccctgtctcaaaaaaaaaaaaaaaaaaaaggagagtattttttaaaaaaatgttttccagtgagataataaaatgtctttttgaaatcttttccttctgtctctactggaaagagaaagaagaggacagaagcaagaatgcttgcagtccagcagactcagagatatgtgtatgaactctaccatgccaggagcttgcttcatgatgctctgaatgatacagcccattataacagagggtaaaggacagtgtgccagttcacctgtgcatcttttctgggcttaacaccgcaggcacaccatgcacacaagagcacagataaaaacacacatatgtaaatgtacattcaggaggagggaaaaaatactcagaaacctatataactgttgggaaaactgtaactcattaaagaatttactagtagctgtattctatggtttttatttccaaaactaattattcaagtaaatacttttaacactaaatcttttctttcattattgtggaaccctttaatagcccacttatggtgatcacaaaaggcacccttccaaagagtttctctacaagaacacttaaaagcagtaattccaaatttgattgtcccaccatgagtaggccataaaaacaaaattatagaattctcaaaatgcaaggagctaagtctagttgggtttttatatgtactattgtgtcttgtgtttatgaaaatctgttttcaaagattgttaagtcattgcctggtgatgtttatttgtatttagtatctacttatgaaaactgaaagctaaacttatcacggaatttttgctttccaaagctgagtcataaattgatggtagactcactgctatgttcttattgatagatgatagattaacagatgggagctcagataatggggaaacttgatcaaaatgcttcttccaaaagcaagaaaaacttctccacttaaagaaatacactgtggaggctggaatgctttaaatcaaacccagaaagcagatatatcttctcacagttatgataaggtgttagagagctaatttactctcttatttgaaacaatggggtgaaatagaaaacaggaaaatgcatgaaaaaataaaacaacatgaggcaatgcatgaatttggggataaggaaaataaaggaagaaagcccttgatactctacctaacaaactaaagagagaatccaggctgggcatagagaacaccccaggaagaagtctgcattgtggaatatatctcaaaatccaagtaaagatgaagtggtagagttcatggaccagtacaccagagaacagaccactagctgtataaaccaacaacagataccagcagagttcatcgcttgaatttcccaaatagaactggccacccatgtgacagaaaactatctgaggctaaggaaaaacagaaaatccttaaggtacccaagaaaatgtcctttggaattcacaccagataaacactaatgtcttcccaacagccagcagaatgtcactaaaaacatgaactgtaccatggaggatctagaaccactgcctaggtattgaagaaagtttaaacacagcttttgggctgtctaacaaggcttggacacaatctgaaaagacaaaactttgtccaagtgatctaactgcattctaaaatagatacagagtacgtatggcattttcaaatttatccagaaacaacaagaaaaatgcctcccattttcaaaaatggccaagcatgatgctcagtattgtacacagtctcttgctggtatttgttgccctcagaggccttgaggatagctttttccaaagtgtctcaggccttctgttactcccagcctacgctcctcacaatcatgcaggttgcctttggaaagccccagggcactagtgtccagagttcacactatccaagtcatcatgttcatctgtacctagctataggacaaggagaatatgattaggcatcgacagaaggccaagcccaagatctagaataatacctcttaaagtcatggggtttacctagattaatacaaataaatttgaaagcatggtgctgaaaagtggcccaaatcagctgactgtggctttttacacatatatttccttggacacaggcaggacctttgttgatgagtgactcccagtgctcagcctgccccttagtcatccccatttgtacaaaatgagaaaatgtacaaggtattgaaagacaaagtcatggttgagatactttgaatgagaatggcccccacaggttcgtatattgaatgttgggggcccagtttgctggactatttaggaaagattaggaggtgtggccttatcggaggaggtatagtcttattggaggaggtgtggccttgttggaggagctgtgacctggggatgggctttgaggtttcaaaagcccatgccaggctgtgtctcactctcattatttctcctgcctttggaccaggatgaaagctttcaactactgctctaccaccgtgtctgcctgctcaccgctatgatgatcatggactcagctgctgaaactgtaagcaagatcccaattaaatgctttcttttataagttgccttggtcatggtgtctcttcacagcaatataacagtaactaagaaaatgatttacgaagaagaagagaaaaattagaaaaaaatactgacctagaaataatagtttttaggttagctgacaggtatattaaaattattactgtgagtctatcccatacttcagagagctagagaaacatctacatattaaaaacaaaataaaaccaccagagataaaaaataaaatgactaagataaagaatacatcaaatgagaggagaaaagaaatagaaaaaatttagataattgttgaattttctacacttgctaaaaacataaatatatggatctgagccctgagccttaaaacatagatacacaaaggtgcagcatgctaaattgcttaaagccagctatgaagaaaatagttaaaaatacccagaatataaagaattttatagagtgaggaaaaataagaatgtaagggtcttccccttgttaagggacttgcccttgaaaacatgcagtcagaaaataacagagtactataatgaaacatgaaaagataaatagaagtcaatctacaattccatgctcaaaatatgaaggtaaaataaagaattttcagggggctggagagatggctcagggcctgaggagatggctgggtagctacagaaatggttctagagttgggaggatggcttggaggctacagagatagcttagcagttaaaatgtgtgctgttccttcacagcactaacagtctgattcccaaaatctgccttgtgcagctcacaacctcctgtaactacagctccaggggaatccaaggttctcttttggcctctgtgggcacccacaagtacatgcacataaacacaagtgtacatgtgtatgcatacatgtgtgcccacacacaaattagttaagtagttaattaattaacttattgaaaattttgaaagaaataatattgagactggaatgaactcatcattggaagaccttctctacaagaaatattaaagaatgatgtctaggctgagggaaaagaacagccaatggaaacccagatctacacaaaggaaggatgagttctagaaatcagatgtatatacagaaggatgaagattctcatcttagttctgaagtggtcttcaaatctgactaaagtgaaaatggtaacaatgctttgcagtttgtgacactgcagaaccttacctacacaggttagaaatggaagcatattgctggaagtctcttttacatacataaagtaacgtggttatcagttggtgagaaacaaggttggtgtatattatgaaccatgcatcaaacactgaaaattcagacaaacaatgagatctggcaatccaaccaaggagacaaagtgaaattatgtcactaaaaacaatgtgaaagaaagtgagagacagaacaaagatctcatggcactaagagaaaacagatgcagtgaggtggtagatcttaagacaactatatcaatgatcatatcagctggaaatggctcaaatgtcccaacaaaagatgaaagtggttcaactcgatattaaaaaatgtaaaagccattattataaaaaagccattgttattcatactcaatcatatttccataatataattattatttccataagaagcccaatttaagaatcagaatagaaataggttaaaaagaatggaggataaccattaataatagcagttaaatcatatgaacaacctgacaaggttttatctaagaagatcttgcaggctgtcaataggaactgggggtaaaattacctgccaccaagcctgacagcctgagttcaatccctgagacccacatggtagaaaaagaaccagctcccacaagttgtcctctggcctccacacacgtggaatggtgtacatgcattcacatacccaaacacttccctacatatacacatgacaaataaattaatttaattcttaaaagtagaagtacttgctactttcatgtttaaaattaatatcttagatgccttttctctttgattttagaactacctgtaaagttgatgattacacagtcacacctttgtggtgataggggaatgaaagctgaaattaggagatgaaaatgtctttttgtatttatttcttttctttgggctttttattttctgttgactgaacagcaaaagaaagcagcaacataatcttgaggtctttttgctcagtacaccaaccacatcatcgatccactatcacggagtatataaagcaatgtttgcttcagtggctttaagcttccctccaaataaacagaaataggattgaaaacagacgcctacaatggtaaatttaagggaaaatgcactttaagttggttctatttccccactctgtatctcttacaaataatgcagctggattgaaatgttttcttatgcaagaatgctgaatattgttggtgaattcaaagttttctgtagagttattgtttaaggacattcggtccctgtgcaaagatagggtgacgtttaaaaatagctaaaagcataaatacccaacaacatggcctgtgcttcatttaactatggtctattttcttgtgacctaagaggctcatcagtccttctaaaattggtaagcatgcagtgaggccagggttgcaggatgtgaagcagtgcaaggaaccagatgtagttcagctggaagcagaactgaaataaaaatacagtgtccccacatgtctgaatatgtctgaagagatactgaaactgaacaagggaagggatcccagcagctggacctcagatacaagaaagaagaaatggtgaagagaacatgatgtgtccatggggtgaatccatgttgccactggcattgactagacaaaaagacaaaagaagacatttgctttcaggggacagttcaccgtaagtagggaagttgaagaaaagtacagtgaggtacagcttctaaatggccctcaagcacaccccaagcacaaccccttcagcatccaatggagaatgaaaggcttccattcctttaagaactgatcagtttggaggtaagctgttacccatcttcagccctagactaagaatactgcatgtctagtgagtatccagatgagcaaagagaaagaataccaacagcaaagactgtgagaggaacagtggtcaaggggaacttttaaaaatctgattctcagcctgcatcaacctacaagttaatatactaatatgcattctatacctaagaaacaaggtgctggtcatttaaatatagaccaaagtcaaatccttgggaccagtaatgtataaacaagagatggtctaacaccaaagcccaagctggcttcattaaaccacagagtacggatccttgaaggctcccatagagtatttatggaaattagatggacaatgggcagttgcccgctgtatttggagatgattcgtcttctgtgataaaagaaatgaagttagaacccctccccaggtgcaaagggcatgaaggcataagtagaatcacaggcaggctacaagaaagacaaaagcacagagaatatagtttactggtacatggccacacctgagtcttgggtacataaaatcttattgtcagcctaatgtgaacaaaaaaaaagctcctgcctaaataatcccttatgataacaacagctgttaagtgtttactatgctttatatctctaataagcacagtaaatgtatcattatggtcttcacagccacaagtagatccagtctcaacctatttaaagataagggtctttaaccgagggtccaagttaaaccctttgcaaccaactctagctctgccttctgtctaattccagatgctaactacagacctgtgctacttctcttgaaactagccctaaaataattttgggggcatagtcaattcaagaagaccaaattaaagaactacatcattcaatttcaggaaactgctagaagaaatattttccctatgaaccagcaaaagggaggagaggagaaacacaaataaaagggaggaaaagggaacagtgggggttaattttaaatgtcaacctgccacaacttgagcatcatctttgacgagaatctcaatcaattgtctgtcaacttggtctatagtcatgtctgtaagtgatattcttgattatcagttgatgtaggagactcgccccattgtgagtggtagaatccccaccctttagatgacaaagataacttgaaggaggtggcatttatttaggtgcatggtttcataaggtttggaccataatgacagtgaggttgtcagaccagagagttagcagagatcagaaagcaaagggtcccgctacagttttcacgcattcccctttatttcccctttactccagatatacctctgccagaccatgggaggacaagatgggccctccttgcagttcaacctctggaaatgcgctcttaggaacaccctggagtgcaccgcagtctcctgggtgattttaaaaccagtcaagctgacaatgaagactaaaacatagcataaagatacatcattacatttggcaaatgcttggctgagccatgcatgcttaagatggagaaacaagtaaaggaagagaagaaaataaggaagaggggagaaaagggggaaacatcacagtagcctaaggaagaaagataggaaaagaaatagtgacactgccaaaaagctgggctggcacagatgtagcacatggacgtggggaagaaagcaaaaggagctgacttacagagacctcaggacgactgtgactgtgacctttccagaatgttgatatcgaatcattaatccctctaaaatctgcctccatcttcctagctcaccgacatcatctgagatcaggccctcacagcattttatcagaacaatggtctatcccacccattcctccattccttgactcaccaaacccaatcggtcattcaaacccatgtcaaatgagggatcaacctgctcctgtgttaaaattccttcctcggctctctgtatcctcatgatgaagtcaagtccctggtttttctgatactgtccccagtccacttacagcttcagcttgtgctgtgcccttgtataacctacgttccattaatagctaaaatattttctgttcgaggtgatccaggatcttttataccactgtgttttcccacaagcatgaaaatcaaccccccccccccgtctctatctggttcattactactatccatggaggatgtacccaaagttaactctttcccatcccattgtcccctcctgctgcacctatgcacatcattgtcagcctacccctgtctcccttactggcctcttgctggagtctagcacacacaagagacacaaggcattattaatttatatctaggatagtaattgacacatctaagcaggtgctgtgtgattcctgagataaggcactagcaagcacaccatttcagagatagtgagcagactcttgctctcccttgcttgtagcccatggctgtttgtgtagttcccatgtgacatggtggtgttaagaactaaacacaacattatgaagatagtgatatttgctgaccctgtgtgggtcaatatttagaagctgcagcacaaagctgactttcacttgacttaatgtcaaacaaaatgtcatattttctttgcttagttttgggaggtgtttcagtttatttgttttgggagtttggggaagggggaaaatgaaattatttatagccagtttttcactctgctcttcatttggcttttttttttcagttaaggctcaatatgatatttttatctcattagtaaaccttattgatttagatccataattctgtcaataacaacattctgcattctaaagctatcattcagaaggttattgagacatatttgcatattaggcaagcatacattttagctttacaaatatatacatataaaaacacattatatatctcatagtcattggtagacaaaggacatttgccacagaaacatgaagtacaccactccctaacttcctctagctcaactactgcactgtaccttatccctccattgaaattcttcaacttagacttaccagccattctagcattcttcatgaagatctggagggaaaaaaatctacaacctgatttgcaagtgttatttaactcacgtaatctacaaatattaataagtgctactcaagattagttaagctggcttgtgcttgatgaatgcaacacccttccacatctccatcaccccagtccatctccaaaactactgaacaagcatcttgattaagccttggcttcccatttcctaaaaaatggtatatttcaagcacctccctttctagatttcaagatgtattttataatcactttaagaaatatcttagttatcaggggctatggttcctcaaagccaagagccctagatggcatttaacacaggcagaggtttactctctcttcagtgctcactaccatggcattgctgacttctgtgttcagaacaaactcccttgatggaaaggagaggagaggaagtagaactttgcaggagcgcattcttttgggtcatcaggtcttcgtgacacctcttgctccaggcatttcaactgacccaaccttgttgtccttgctccaggcaaacagaaccagctgactgttagtgtatgagtctggctaaactgaatattttgagtcatgctactacagctctctaatttgggcctattctatagacttggtttaaaatgctctaaacctttctgaacttatgcttttcaaatactacattggcagtttattaacactcttagcctcatccatcagaaagagcccctcttctgttgaaattctgatgcctggtttctagaatatttgctcattttttttttttgctaaccctaaaatgcttacttatcaagcatgtattgaacaccttcatctacctatctttccaactgtcacaaatgccacttcctgcagctctgagggtaagctgtctctcacaagctatactggatttctcacgctgtcggacaggtccttgacctgagactctggagaaaaccgtgttctaaacataattcccggtcactcccctccttgacctcacatccacactatatcccctgagcttcctgaatcgtatctgcttcaaagtattatgtgcatctgaccttcaggcttcaaagtacaactgatatccacagtattgcaaaagttttcttaactccccaaaggaagctaaggctccacctgtgtcctagatgtcactcatggccacccagacccacagccaaggataaaattggagaaactaaattcaagccttcactgcttcaccagaaaaaaaaaatgccgttgagctctgagggacagctgtgcattttcagggaggtatgcatttcacagcagctctggtacctataaattgacttcccaatctgcagcacacataacttttcttaatgttcactgaaaacaaacaaacaaaaatattccccaaaggtattcatgtgaggaatctgcaactttcttgactccagacctatgatgaagtcacctgagacaacagaaaaaaatgatctggagcctgaagcactgtccctggaacctgccctgcctctggacactacaaagtgacagattgtgtctgctcatccagcttctttctgcaatgactataatggatgctctccagctcctttcagaccctgctatgagcccctccctatgtgttatcccaggctgtgtaaagatgagctcagtttgctgctaggcttaacctgccaaacaacacatatctcctagaatgaacagaattggaacatgaggccaatcaccagatgcccatttaggaactctatgttcaactgctcccatatgtgactagtcatattctttatctatttaattggttgttattgttgttaaagggttgtcccccaccaccattaccaccaccaccaattcgttctctctcagtgtaacaaatacctaagataaatcaacttataaatatataggtttcttttggctagcagtgtaaaggtttccatccatgactggttggcctcattactgtggagttgttgtgaggcagtaagggaagggcagaccaggttttctttctaatcatggatatggcattcataggtgtatattacagcaggagtgcacggcagagcaagacggaaataagagaaggaggaagggatgaaatcttgcctcccctccaaggacaataccctaactttctactactaagctgcatcttaaacattccatcatctcccagtaggaccactagttggggaccaaccccttgctatataaacctttggggcgctttctagatacaaactatagcttacttctcaaagactaacttttaacttcagtagtctcgaagacaccacagagttacctccatttaccacccacaaggggctgaactaagtgttccttacggtcttttctagcagtaaaatttatgatcccatataagaagcagtttcactatctgcctgagattacacataaatgcttttcttttatctgaatttatgtcaggtgggacatccactaaatctaaaagcaaagccattttacttaggatccttttagaacaaacagaatagaacaaaacaaggagcctgcatgtaagttgtcttttgctaaaagaacacatacattttcttgaatatatagtttatactgttgtaaaaaatattagatgataattcttccatgaaaaaaataggacctcataatgattcagagttacacaaaagatgattgacataagtgaaataagggcttggagagatggattaggggttaaaagcacttgctgtataagcatgaggtcctgagttcagatatgaatgcctatatgacaagctggccatagactcacgttcatctgtaatcccagcactgtggtgggtagagacaggatgatcaccaggcttgtgggctccagcctagacaaaaacacatcctccagctccaggagggaccctaccttaaaagagtaaatcaaagagtaatagaggaggatacccaatgctctccaagtgccactggtgtcctacacaaatgtggatgcacatatacacacatatgtaaaggctctctctctctctctctctctctctctctctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacacacacacacacacacacacacacacacacacacacacacacacaattagaaaacgggtttccaaaagacagtgaaatagggaaatcttgagtgggtgagaccttgctaaactcatctcattccgaaacctcgaatctctcattgggccaaatcccatgggtaaaatgcatcaataatgcaagacctggccctgaaaggaagggagttggaaatgttccttgttctacattctgaaatatcttgcagctgccgaagacagcagtaagctgtgtgttcttttaagtatatgactatttttttagttaaagaagaagaaaccccacggatcatatgtgtctctctcttgtttctaactgtcacagaggcagaggctgctggaccagtgagactgatgcagcatgacaggggcagcacactgctctcaagatatgatgatacaattccaagagagagagagaacctctgccactctcattatctgctgctgtgctctctggatgccgcctctgctcccttcacaatgaggggggattattaaatataattctgttaattatggcttggtgcaaaagttggatgggtcctgaatcagtgcccccaaggaagaacaacatgaggtaaagattggagggcttttatggtggtgctcaaagataattataggtatggaaaccaatttcagagtgagaaaaaaaaagccaaccaagcccagactgttttcataatgcagcatagctcccttttaatgtgatacattaactgattttccctgagggaggataattcttgccatgtcagtctcctggacagaaagtctctggcttagggcaagcagtcagcaggaacctaggagcttcaagtgaatattgccatttcccagcctctcactgaagcagtcaggaggctgcatagcttatttttccacaggtactccagcaagaacaataaactgaaaaaaaatatatatacatacagatgtacagatagccttcagcacagattatgcaaagatgtaaatgggtccactatatggcacagcatcaaaagtctgtatttgaaataatgataataactcatcttcagttgtgccttctgttaatatccaaaatattagcctttctctttaaaatattatgggccaggataacgatcctaatacacagactgaaggagagtcactttaattccaggctaaggattgcaagcatcttagatgggcttcctaatggagtagaagtgggcaataaaatctctgagaaggcatctactgtcacttgacaatgatggactctcagttttttatactgctagctaagatttctctaatatcttcttggtgctctggtgaaatgtgccttctgataaagttcggaaacatctgttccatctacaacaacgcaatccagtgttctccacattatgggacacaaattcgtgataacctgtcttagtcagggattctattgctgtgatgaaacatcatgacaaaaacatcttggaacagaaagggtttatttgcttaagcttccttccatacatttcctcatcaaaggaagtcaggatgggaacacaaacagggcagcaacctggaagcaagaactgatgcagaggccatggaggagtgttggttgcttcctggcttgctcctcatagcttgctcagcttgctttcttgtagaacccaaggccatcagcccacaatgggttggggcctcccacatcaatcactaattaagaaaatgccctataagtttgcctacagctggatcctttaagagcattttctcaattgaggttccctcaccaatgaccctagcttttgttaagctaatataaaactagccagactgccttccctggggcaagaaatagtattgagtttgaagagaatatgagataggaacttaagtacaaggactcactgcatgctctttcaatctatcaaactataactgaacaactgtctcagttggtatttctcaatctaaaaaattttgtgaaaggcagcagaggagatgtagctataataaaaagaatgatggtggtagaggaatgttggtctagaaatttagactgggttgtgctatgtcagcacctctgacctggagggaacaggtgtttctgtttctggggtgaagctgtcctgtactctgttaacagtcacagtatccttgggacctgcccactggatgcagaaagttacctttccccaagactgtgacaccaaaaggtgtcttcagacatttcccagtgtcccctgtgtaaggaaggagccactctgagttaaagctaacttagggcaaagtgatgtctgcacacttgtttatgggcaaagattgtagagaacagtgttggacttcacagatatgccaatatgaagaatttcagggattatagccatcaaccaaaggaagatgacaaatggagtcaaggaatgctatttggataaatttcaataaatttcctttgagggttttccctgtgcactagttcattcaaatacattaagatcagccatcttctaattacagattccagctgtgaaccctcaaggcaaggtgctgagggtctttgcctttgcagtttgtctgtctgtccaaccagactgtagaatggtctcatgaattttcataaagaaaaacacatgatcaaacctgccgatctggtatgcctcagtgggctaaactggctcggctttttgatgaggtgcttggcagcctgaatatttaattttgttcttttatcttatggttgaggatgcatatgcccagaggcctttggacacttgcctcttttttaataaagctaataaatgcccctaggaaatttacctgtatctaaactgacataaccaagctgatacatcagacgggtcaggcatgagagattccagcaatttatataaacggaggaagctggcatgggcttggactgcctggagttattactcaggccttggcagccttccaggctgctcataattttaaataaattctgatcttggtgatgtatacttattgatcaagttttcagaaagtcatcaccatgtactctttcactacatattgatctgaaatctccacagttcctgagagaagtctggcattacattagctattatctgcaccacaatttatccttctatctgaatcaagcttgcggataagtgagctattctgctccacttactatggaaagagacctggcaagctgtaagaaaatgagagtcttgggtcccgagtgtctcaatctgtcactaattttcattggttattttatttctcaaactctcaattcctcccttgtattacaaaaagtaaacagcgttatcagtaggtaagcaattctagcatcttttctctcccttcaaatggttgttctgaaaatgctctgttgcagacaggtcgcccacattcactaggtggctagtgggtgtcacaagacaatcttgctcaatttcctttgtaaatgatggcctgtgtttctacacagctgacctgagtcataggcgagctgggccaccagagagctttcatgagtacaagtctggctaaaagagaggcatctggacgttagttcctcagaaaattctcgggtatgtgctttctgttggatcttgtactgagatcaaccatagataatgaaatgcctctactccccaatacctcaagtatgaagattctccactagacacatgtgacaaatgattatcatattacacaatttgggagagaccactcccacagctgccttctgatgagctgcaactgagtacaaaccactatagcattatgcttacatgatattatgtcttccctttgtcttccctgcaaggaacaggagtcaccatggcagtttgttgtcacaatttggtaaaggaatatggtcacagagcctcaccaggtgcttctaccctgcaaccaagaaacagtaccccacacctggctagtcagataaaaataacctatgagaacaagtgctttggctttgtgtcttcagggttcatattcttacgtgatccagagacccccaacatgcattgtcaccagaacctcccccaccccctttttaaaacttccctgtttgagacttgtaactgttaagggacagacaataaatgatgctgaatgcccagccataaaaggaattgtgtacatcacccctgaaggaaaatcatggaaaagggggcagggagcaaaagaggactgcaaagatgcatcagggatggctatcaggtgctgctcttacaaaggacctgggttccgttcccagcacccacatgatggctcacaactacccaaaacttgaatttcaaagaacccaatgccctgtggcatccaaagacacctccacacgcatacatacactcaggcacacatgtatacacataaaataaaataaataaacctttgcaaagaaggctgcaatctggactatgaggaggtgtgctgtcaatcactgtcttctggatttggcatggcgcctgcattcatcccctcattacagctgtgataacctgaatcatatcctgtggatgatatcctgatggagtgggtatggactcacaaggacttaaaatttctatgcaactaatggttaggaatgggagtcttcctcagaggtatgccaatggaaatgttctcatgcttttgcaaagaaactcccacctgaactcccataaacaactttaaggaaagtagaaacaaaagaagttaatgtggggaaatgaacacgatcaataaaacgcaatatgtacacctatgaaactatcaaaatgaggcatattattgtgtacagttaatttatactaataaacatttttaaaggggcaaggtcttgtttagagaaataaacatgaatttataagtaaattaaaaatgaagaacttgggttcttaggccacagatctgcttgtgctctcctccaacctgtggagtatattctaggcttttagcaacactctgaaataaacttgtgctttcattacaaaattacaaaccctccctactctacagatgatcacattctctctggattagtgtgtcagtgggctcctaggtgaagccaccagtgtgaaatagtgcctaacacatggagagtgttcaatggctacatattgaattaatgacaggcttctttgctacactaaggaggcaagttggagacagtaccctctgtcactctcaggaatgaatctaatgatatctattgacagatatgtgttggaatacaggagggcagtgaatagaaaatgccctgggaagctccttgcaccaataccttccattctgcttgtttgcaatacccactgtcaactctcaagtgtgctgagggctggaaagatgcacagacttatgagcacttgttgctcctccagacaccctgaattctgccctcagcacccatgttggctgggtactgactggaattccacatccaggaaggagaccaacactctcttctggcctctacaggcaaccagacatacttacacacacacatacacacacacacacacacacacacacacacacctaaaattaattaaatctataaaattcaaagtttctagagtaccactgatcagtctgtgcaaattctactgacaatttcaaaagaaggcagaattgcaattttgacaatacacaaagggggtttctgacctggtgagtggtagctgtaaccctttgttcttccttactatgatcaacgagagagagagagagagagagagagagagagagagagagagagagagagagagagagagagagggctgggagctgagagctgaaagaacagaattgacaaaaataagactgatacataggaaaggtcttatcttgagtaggtaaatatgatgtccaggccagcttcctcccaaatgcctaagaacttcatgagggaccactccaatccccagaaaatgctggcttcccagcacgcattcctacaggatttgagttagttaacaacgtctccactaaggatgcttgcctgcttgttgcattggatggactgagctgtattacctggaaccctgttcaaactgcacacactcacatgccactgctttctaatcttctctgccattaaagatgactataaccaatcctccacagaccacagctcttgatatttagcatagcaattatggtgatagagccattgcttccagaacatgtccacacagtttctcagaacctagctgtcatattataggataacattcaaatgaagtcattgtcagctgaccctaaaaccaaagcttatcctgactgactaggtgaaaccaatgtaaacacaaatcacttaaaaagggatgaaagcagaagtgttcctaacacaatggtgcaatgtgagaaagacccaaatggttatcgccagctatgtacatggaaggtggccagtggccaaaggagcagacaaattctgcacactgtcaatgtgcagaaataaatgcagtcctgacaatacccactgaactcagagacaacgtgggcttatcttcaatggacagaacattataacaatcaatttatgttgtttcaacccacaaagtttgtgataatttgccattggtaattgacggatgcaactacaggaaagtaatacagtaacaagccacgggggcagggcagggggagaattggagctggggagagagctatgtggtaacttaactagatgcctaaggactaacactcaattctcagcactacaaagaaaaagagctaattaatcacaggtatgtgaggagtgatttgggctaactctctgtttctgggtatctacaggttcagaaaggatgggtaataaagtcagccacaactggttctccaggacatgaagtctcctatgccctagaatggttccacccagtaaattaatttcaattcttgctcagtttcttctttaagatattttatttttatttcatgtggatgagtgttttgcatacatacatgtttaggcaccaaatgtagacagtgcacacagaggacagaacagaccatcagatcccctggaactggcgttacagagggttgtaagtcaccacactggtactatactaggtggtgtttccttttactgaaaacagattttttccctcacatagcatatcctgatgtggttttcccctctatctactcttcccagtcccctccatacacctcccttcccatccacagctattccctttctatctctcattaggaaacaaacaagcttctaagggatttttttaaatttatttattagttctagttagggaacaagcttgtttcttcctgtgctgatcctgggcccttcaccatgtgtccagggccagagtgtaacccttcacatgggatgggctctcaaagtcccttcttgcaccagggaaaaatactaatccaccaccagaggctccctggagtgcagaggcctccttattgacatccatgttcaggggtctggatcagtcttgtactggcctccctgacagcatctggggtcgatgtactctcccttgttcaggccaattgttcctgtgggtttctccaacttggtacagaccccttcgctcttaataaaatataataagatgaaactaaaaccaaatatcaggattagaaaaaaaccaagaaacagaaaaaacaagccccaagataaggcacaagaaacactgaagaatcccatgaaagcactaacctggaagtcatgataaatacgcagaggacctggtgcagacccatacaagccctgtgcatggctgcctcggtctctgtgagttcatatgagctttgatcgccttgatttggaggaccttgtttggtgttctccatctcctttggttcttacactctttctgtctcctcttccttggggttccctgagccccaaggggaaggatttgctggagacttcccatttagggctgagtattccaaggtctagctgtgggtctctgtgtttattcccatctactgctgcaggaggaagcttcttgatgatgctgagtatagaagaatattattaggagtcattttattgctaagttagtattttgtttgtttgtttgttgtttgcttgtttttagaccaatattacttgtttttaccctaagtccttggcctatctagtctaaagttcttgatcacccaaatagtgccaggtatagtttccatctcacagagtgggccttaagtcaaatcagatctagcatggtttcttctacaagcttgtcccaccattgcactagcatatgttgcaggcaggacaccattgtagatgaaagggtttgtggctgggttggtgtttacatttctccaagggttgatttccaattctcacagagcagctcacaactttctgtaactccaggggatccaatgccctctctgacctcctgaacaatgtggtgcacatatatacactcagtcacacacactaataataacaataaacaaataaataatttttttaattctgagcattaagactgtgtgtcttgcctgcagcacagtttcatgtgctttcattcaaggcttattttcccattttttaacataacattctaaatggttcatttagctttcaaactgaatgacagataattagaaaatagcacattataagacagaaagactgctaaggatacacagcctgttagcaaaagtatatggtgtgattgtggcagcaaaaaaaaaaaaaaaaatcaaagacaaggtggaaccaattgttctacaggcaagtagccagagactgttacattcgcctgtactcacaatgatcctgagtctccttctaaaacctgttcaaattatgtcctgcatactctattgtgtcagcaaggaagtatatactactttggcagagatttcattagaaactgttgacataatttaaatgttgatgttccccggaggaccatattcactcttcagtttgctgagtgctgtgtaccgcaagacagctgaagagcatgcgcagtgggtcccagcaaatgggaaaagaagactcgtgcttctgctcaaacctactaaatatgtagagagccacagaggcacagtgacatggctatcccaaatatcagtccctgctattagtaaaatcacagttcagagggagagattgaagcaatcattccaggcgggacacacatttgcaaatgtcacatcggaagtataactttattatgggaaagcaatttaagttcatcactaatgcctgacatttcaggatggtttttgccccgtttttactaatcacactcagggtagctctgtctttcacagctccatttatgattagactgctgaactttacagaaagagttgctgggtgaagctccagaatttgattttccagctgatctttaccaactcaagtagcttcagtctgtctccagctttttttcctttatataaacgtatgtcataattccaagataccttttatgagaaataaatgacgtcatcaacaacatcaacaaattctggaaaggtaggttgccaaggaaacctatggtaggaaatccacccctctgtggttcattgaattgtttgggggttgcctcatagttaactcctttacaaaatggttcaggatcccttgattgattttatggttatctgttggtaagacattcttcttttttttttattttgaggttttttagtcattgtaggaagccggttcctgcattatccattacaataataggtgcctcatagggtaacacgtcccaggcggctggccagcctttataagggatggttttcttggttcaatgtctccgctctggaaagcttatgctctcccctcacaagatgcattaaagcttgtctgcagaaggatccgagtgtcctgcgtatgatttcttgccggcgagaaatacagagcgcgcgggacaagtcatgaaatctggggctaaggttttacagtagcttgccaggctatgcagacagagacctcagtctgcctcagctccaacactcatgtctatattgtacccaacatctccctctaaaaatatgtataaagcaaagatggtatcaacatataacaaagagagtcataaatagttataatgggacttgtctggaagatatacattgtataacatctatattattgtataacctaccacttgtcaaaacccagctacttggtaaaataatacattaacaatttattatagcttataatacaaaaataaccgtaagctactattctggagttatatatatttctccacttttgatgtggaagcctttcactaatttagaaaggatcttcatggtctccttagtcttgtctcactctctaagttccaggtagaccccattattccttataggatacaaggcgtttataattcttgtctctcagtacccctcctaaagaaacactgtgttgcagatatggtcagactagcaaaaatatcactgtcaactttaatctagatggctcacttctgagcaaagaaactttcttagggtgatgccagtgtcccaggtgtttacatcctaaaaagactctcaaaggtttgctttgctaatccaaattgttatttttgtcctcctgaaatattaagctgttgagctccacctgaattttcaatctgatgaaatcagtttggatgatgattcgcatccatcatattatacttgtttctaggttctgtcatccacaaattagataagcaaacctatgtgtctttatgtaactcaaaattttaagaacatgtatgagacaaattttaaacagagtcttgttagaaaatttctaaataatgatttctaagtgaatgaatgagtcactcagacaaaattctttgagaatgaatatgagctagctatctatttccctgctgtatccataaccatccacatacttgacacacaatcctgtatagttaatcaagacatcgttttcatctatctggtctcttgggatgttttcatttctccatgattttaaaataattgtccaaaacattcactagcacgcaactcagcctaagacaacacagtaaaaaacacagaatggtcttatgtgttcctcagttctcaacagcctgctaaatttttccagattaataactgctctccttgcaagagaaagtcgaatcaaaacagtgtgagcagcctcagttactccctctctgtgtttgtagtgcaccatctgaagcaagcagtgctgcaggaaaattgttctcactgctatctgctgtaccaatcaagttaaaccttggatcaaagagcagagtcagtgattggctgactggaattagccatagatttgttggaggactgaggaaatcagatagagaaggacaggaagagataagaagggcttggagagatttcgtggggtttttgtttgtttgtttgatctaagaactgtggagagtagggtcaggtgattgttcctctgttgttttttggatttatcaggtttttatctcaatttctgactcctgagtttttattaacattagaacaattaaggtaaattctttaaagcaggagatttttcacttactcatttgattatggtaacactgactgaatgaatatctgagcttcatgtttctcacagccgtcaggggttctgtgatttgtgttcaccctttcttttctcttccctccatcctgggaggcctgttaggagaccccttaagacacagaaagtacacaactcagaagtctcagtaagtccctgaaacttaggaagatagcattcacaaagctccctcctcagtaatagctgctatggacaggagagtctctgacccatccaactgcttacaagtcatgtagagttccaggtttcatgactcatgacccatgctggaatgggctttcagtgatggagcagcgtttgagtcatccatgctcctgaaagtaaccatactcctttaagtattctccctaaactcactgattgaccatactggacttcagtggtactgtccatctattataagcttcctatctgcagtgagtagacgtttgttcacatctccccaggaatagtgtcgcccaacacctatttgtaattgttctttaacatctatgctcacagaactgccattataccatcatcatttctatcactaagcataccaattccattccccaatccctcttgagttctttattgttgaaattcacctttcttttgtcacagaattgcctggttggtaacatacttgagttatttgccttggtaagtgatatcactggaaggttcagacgttttttaaataggaacggcataaaagtaatctctaatattatttcaggttattatttactacaatctacatgcatgtaaatcgatacaattaagaagcaaagtaaaagaagcatgtatctgaacacagtaatgtacaaatcagaactcactcaagaaaattgtggtatccaaataaacagtccagaattcatggagaagccataaaaataaatcacattcaagatgaaatgtaactatatgtcttttagtatagtgtaccttggtaggcaatggcaaatgagacaagaaatgcctcttgcctctaggagcttccattatggcaggaaagactgtataataataaggaaattaataaaagaattaaaatgctagatgggaagatgtggggaagagtgttcttttaggtaagttggtcagagaaaactctctgagaaagtggaatgagttcaaaactgatggataacaagtacccagctatgcaaacattgaaaagagaaatccaggaagagggcaatatcccaaagatcaaaatgagagaaacctatcaatcacaggaaacctgcatagagaaaaaagtaacagcacagggatcctaagtatcatgaatatctatactaagcctaaggaagcaccaaagaactttctagaagacaaaaacataattttacaaaggtcagagaataatgccatatcaaagaagtacacagacaatttttctactttaaattcatctcaaagtggctggagagatgccacagcagttaagaacaccaactgctcttccaaaggaccagggttcaattcccaccgtacacatgacagcttgcagtcatctgtaactccagtcctgggtgatatgaacccctcttctggcctccaagggcactacatgcacatggtgcacaggcaaacagataggcaaaatacacataacaataaaagtgaccatccctgacctacttaaatattccatctacaaataagctcatgcatgattccgtatgctctaacatgtctctaacaactgtatgtttagttttaagatgccacttttcacttttcacttttcacagctactgagaattgccatagttcaaaaatgttaaaccccaagtgacagcagcctcttttggggccttcccttctcagaaccctcccttctccatggaaataacctttcccttgtccaatctggtgctcagaacctcagtgtttcttggggttctcgaggcaatgctcagagaagtgaactggaaaacatgcacaaagacaaaatgacataaaataggccacagaattatcattttaaggtaaaaactcaggtcacatcactggagagatgactgaacagttaggaatgcttgctgttcttgcacaggaccagaacttgggttccagcacccaggtggctcacaagtgcctgtaacttcaggtccaggtgatccaacaccctcttctgttctctgtgggtacctgcatgaatgtatatacccacagaaacacagatatacacatatataaaaataaagcctttttaaaaagaactcaaggtgggcatggaggctctcaactgtaattctagcaattgagaaaatgaggtaggaagattgatacaagtttgaggccatcttgggctacatagtgaaaccctgcataagaaaaaaagaaacaatgataaaagtaagtcctcctcttagtggttcaaggaggcagagggaaagatgacagaaccagggcagagcaaggtgaggcagagttctattgaacaggaagtggtgatgcaggcagcggcaaccacagtactgtcatcaaaggggaagagcagaattcattttaaggaaatttgtaaattataggaaaggtaattttttgttctgtggcatatgctataattccttcctctcacttccttaaggcctcttcaacataaacctgaattactttccaaggtctcgtgggatggagttgagaataatggcttgcttttgttaggattttataggcgaatggacagtctgtaaatccttactttataggctcagttgaacccttaccatctgttgcttgaaaacacatcactgattctcctttctatccaaaagaatggattattccagattttccttatcacatcccttgccctcctggttcctagccaggtccttgctcactaactcactaaaataataacccaagtcactcgtattcctacctcttctcttccacttgctcccatttcatcatctgcttgcttccttctgttagactgggggaaaacatgctcctgctcctttgccagctaagcctattgccctccctggcttactaaggtgaatgtatcatcagtcatcattaatacctcaggtggaatgtctttctgtatgctgtgaatatgttttattaccattggttaataaagaagctaatttggccaatagccaggcagaatagagtcaggcaggaaatccaagcacagtttcggggaaaagaaggcagaatctgggaaatgccagcagccactggagaagcaagatgtgaggtaacaaccacaagccacatggtaaaatatagaataacactcctccactgctcgtgggagtgccaacttgtacagccactgtgaaaatcagtgtgttgactcctcaagaaaatgggaatgagtctaccacaagatccagcaattccactcctaggcatatacccaaaagaagcacattcatataacaaggacatatgttcaaccatgttcatagcagcattatttgtaatagccagaaactggaagcagcctagatgcccctcaaccaaagaatggatagagaaattgtggtacatttacacaatggagtactactcagcagaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggattttgttttttacttttttgttgttgttgtttgtttttttgtttttgtttttttttgtcttggtttttgtttcttttaaatggagtgtgatggatgtctctacaattttgttcaaatgactgcagaacctggaaaagctgttgctgctattgatgcataacatattgccattattggtctttaaatataaatataaatataaatatatgctaattgaaactcaaatatgtgatgaatcttaggtgtttcagttagtgctcacctgtgcatgcaaatttgatttcatctttagtaagtagtaaagttatatgcttgccaaaaacaaaagtgacacactggaagacaaatgtcacacaatttcaattttatgtgtaacctagaaatgatgaacttatgggaacagagagcagaattgtggctattaggcttcaatgtgggccttttaacaatggggaaatgattggtttaaggatataaaactgcagttggacaagaggtatggactctgtgatgtcttgaggtctactgagagcatgataaatatggttgataacaatatgctatattttaaaggttgtgagatcgtatactttaagtgttctcaaaacaaaaatgatgaatatgtgtgatataacatgttaattggtttaatttagccatgccattgtgaatatactgtattatgtaccataattgtgcatgactttatttatgagctaaataaatgaatggaaaaaatacaaaactaaaaaaaaaaaacaaaaatatgaaacaaaataaaaataggttaatttaagttgtaggagctagttaataataagcctgagctaatagaccaaacagtttgtaattaatattaagcctctgagtagttattttataagcagctgtggtacctggtgggaggcataaaagtctccagctacaaatatccttaatattattttctgtattctcaatagtttgtgtggtaaaggtcccctaaagactcatgtgttcaagtcttggacccagtgtgatcctatgtgatgataatgaaactttaaagggtagagtctcatgggaggaagttgggctattgaagcatgacctcagagagcgttctagaattcagcctctcttctacctctttgcctttggcgtccatgcgacaagcagcttctcttaacctattggtcctgtactacctcatcacaggtccaagtagcaggatgaactagccatgcattaacacaatgagccaaaaaagcagtctcctccttgtaagttacctcaggtgtttcctcacagtggtggaaaattaaccacacacccttctacttctgctatagcctcttccttctcttgctctcatgtctcaacctctcagttctactcttggaaacaccataaacaaagattcacattcctattacagtatctcatagcagacctccaacaatatataagttcacaatccaaacactgtttcctcagtttctagtctcaaagacataggagatgtccccaaaaatactatgatacattatatttgatagtgtctcattcttatgtaaggtttttttgaatgctaacaatttttcacccttttccaattactcaccaagtgctttggatcctacttctgaaatgatcttcaaaccttacctttccctaaggtgatccacactccaatccatcttcagtgcatctctggatagtaacagattcatagcaggatccttattgaacttcttgactctatttcagcacttttaccattctattttctcagagctattgcttctaaaactctaattggatcatgtcattgtcaagctcaaacacctccagtgactttttagcacctaaaaactaaagtacaaatctcctacccagcatgtaaaaacctcaaggatgtgacaccaatgtccttttcccatattttcatctccacccatcacacacacacacacacacacacacacacacacacacacacctctatacacaaacaagaaatgctacacatcagcatatattaattatacaacataatacatggttttcaattgttatgtgttcatacatgtataaaatgaacatataaataatcatattcccctacacatgcatttttccttaacaccttttttctccttctattggtctcctttctcctctgaaatgctcctgcttctactttaatgtcttttttccagtctagagtctttaagttcaaggaaaggggtgccattggtttttttaagtctggactatttgtttaacataatgacttctgtctacatgcatgttcatgcaaattacataattgcattttctttatgactgaatgatacccattgtgtttctgcaccacagtttctttgcccattgataattgatgggctcctaagttgttttccatacctttgtcattgtgaataagataacgataaacatagatatgaaagtatctgtgtgttgtgctaacttagatctcatgggtatatatggaagagtggcttaattggattatatagtaattctatttgtaaattctattcgttttcttttgaaaactcaacatcaattgttagagtaacaaggctaatttgcattgccactaacaagtgtctctgttcctacacacttgacagttttcacttgttttcctagtgacagccattgtgactactgtgggatggactcttgttataatttttatttgcattttctggatggctaaggctgtgaacactttcacgtttttactgaccacttgcacctgaccttcctttgagcaggagtttagtccctccagcctttgtttgttcttcatagacaaagaaatggaattacctctcatctatgactcaaccagatcctactcacatgaaccacaccaactgccttgtgaagcttgactcaggacactcatggaattgggtattgcttttcactccagtactgccatctgtccccagcactgaagaccatcctgtgtgacacaggtactcttatagttctaccttcctccagattgtgaatatttggaaaatagggactttttctactcacaattgatttctttctaaatgtataatatgtagtacataccttttattgaataagtatttgttctctggagtaaatataatagatttgtccatgagatggttaatattgccaacttgacaagacctagcattcgtcatgggctccaactctgattttcatatgtcacagtgtttttcagttctatgcatagcagtaaaactgatagactaagtataactcatagtgtattgcaatgcccatttgggattgcagtcttctttgagatgcagtctggcagtcaaatctctgggcatgtctgctaaggggtttctagattagatcgattgaggtgaggagacgcattctaagtaggagatgcattccacaggcaatgatactggactgaattaaaaggagaaagtgggctgagaagcagcattcatttctctctctgcatcctgactgtggaagataatgcgaccagctccctcaagctcctaccactatggctgtcccaccatgctggacagtacctttgaactatgagccaaaactaaatccttcctgccctaagttgcttgtgtcaagcaatgaaatgtcaagtttgacacagcaatgaaaaagtaatagtatttgtatccacatagcagttaccagtatcacactctgttgattgctttcactgcatatgggagaattacaattacaatgcttaagtatatttttgagttttgttttaaatgtaagaacaaatggaatgaagatggattttattcataaacacctctttggaaccacctgtttaatactaatcatagcaacagccattgattggatgtcttctatattcagacacttaattacagttttgtattcattgtatcacttactcttctaagaaaatctgtgcagcaaataccagcttaagcctatttcacattaagtgaaactgagtctcagagaaatggtcagtcctgagccacacagaaaagtagaactgccaggcatcaaaaggaaatttgtgtggtgttggagacactgtattctgccaagtctgtttcaccggctttccttgctgcctgctgtggagaactacaaaaaccaagcaactgcctcacaagaccgaatcaggaagagactacaggctgtgtcagaatgcaccgagagaatgccgcatgttaactggaaattgcgagaaaagcacagaaggaattacagaactggggttatagagccaggagtgcagcagtacagaagagtctttgtaaatgacaagtccatggtttgaaatactcagcatgccaaaacctagtccaacttatgaggtatcattcgcctgtgcccaacccccccatcccttattaagatatatctaaaaggttgcccttaaaatgacactagaacttatgttcattttagtttcatcttcatataaaaataattctttaagttagggacagatgaatctcttgaagtaatgaccacatttctaattttgttttcacctttgtttgaaagtgtttctgttctccacagaagatatttccccagaataactcttgagatcacaaacagagaaagaaaaaatgtctagggacgagtgtttatacacagacacagtggccttacgttaaccaagcatgaattcccacttctagctggaccggttcatggtgtgaaaactgaaaagagttcattttgtttctcgtagcctaggagccctttctccaagctgatggcaattaatttctccctttcctttaagttttctcttcaaacctttacctccttcctctaaaatgtcttcaccataactcagtgtgagtgtgtggggaggggtggtcaagaaaaaaatagatctctgaacatttagctagatgtcaaatatgtctaccccaagggaacaaccaagtttctccatcttcattttctcctttatggtcttatgtgtctcgttagatcgtaagtcctcagggagaattcatgcttttagtatctattcagcaagcagcatattgcaacgaccgaaaagatgcttatctttagaaaaatgcaatgacgtaaagctatagtcatcactgaggagaactgacctatttctttgttaaattatctgcagttttcatgtcagagataaaagtgttttattcaaaatattaacctctagaaaatctcctaggaatgagccttggctgagaattggaaatggaattcgacctaattcttttccctcacagagtctatgcaactgatccagcttcttcacctctttgtatctgttttcttgttcatgaaacacatattctagccccgttcagtctccctcataagaatctctggggctggagagatgactccttcattaaaatcatcttctactcttgcaattaggttcccagcacccaggttaggcaactcccaagaagacacctaagagacaagacccacccgtgaactcaaggctgtagaaatattcagggaatggcagaggaacagctaagaactgtgtaagtaaaaactcagcaggcaaagaaaatcatagaatactaacaaagtactaaagtatattattttgaatgttttaaatttacttttcaaagaaatcattatatactaatggaagttgatctggtctccacttttgatttttctctactagatcatagtaaattcaataaagggtgaaaaatacagtgaaaaatcatcctaaaatggcccatgcaacttagaattgtctcaggcaaagtcagcccagtcagggcagaaacacatgtccacaacagtgtttgcctgatgggtcattactcacgagaagtggaaaggatgggccatgggggtccttgatatatctgagggcacaaagctacctcaggtggggttgggatcagccacctgaactgccttttgtgaacaggatcaacaataaaatcacctactggcatttctcccttattataccccaattctgtttccaaatgtcagtctgatggtcatctatcttccataaacctctcattgtctcacactcacaaatcagaataaggcttggtcactgccatccacccagcatggttcctgaatgtccatgtccctgtgcccacccaacagagaactcttcacctttcccccaatactcagatactttcatctctggaatgctgtccaactttccctggccccatccttctccaagggcttatggacagttcattgttgacaagacagtgaaagacatttttttcaatggttcagtctggcatcctcaaatagatcctcacccatcttaccctaagtaaccgtaattaagccattggttcacaaagctggagaccagtggagtcatttctttgtcctgtctttggtgccctgtctggatgaacgtttgttcatcttcctagaaacaattcacacaataggactataaaagtcacacaaccaaacacaggcctccatgcttacaagtcctctcagacagcaagctttagtagctagagtgtgagcctatacacacgagcaactgtgtggtaacatccttgcacagcctgacctggagacagcagtggatgcctggagaatccacaccttatgaaattagctgatcacagggtgcagaccattcagactgcatctcaaagcagaccatactcccaaatgggcattgtcatatgccgtgagctacaatttgcctatcagttttattgctatctagagaactgaaaaacactgtgacagaatgaaaaacagagggagagaccatgtcaaatgctattggtcctgctactgcaactttctggggtaagctaccactgtttcttctaattctttggttttgtcttttgagatagactctcagtgtacacccagatctgcaaactttctgtgcagcttccaagggctggcatgacaagtacaacaccactcctggcttttcaagcttcctgaggacaggaactcagatatctgtgtcatcactaacctgaaatattccatacccgcgttgaactaaactcaattgaacagatttggggttttttgctttgttttgttttgttgttgctgttgctttgtgaggttattgtttgtttatttgtttgttacttatttttgtttgtttctgaaaagtaagaatctattttggctcacagttcaaggacacagcccatcaaggcagggaagtcatagtgagcttcatttggctgatcacatattatagcatcagtcaggaagcagagagcaatgagcagtctgcttcctttctactttttatggagtctgggaccccagttcaagggatgctgccacatccatttacacagcatctcaattaaacttacctagaaaatccattaaagacacaccagaagcttgttacctgggagtcgctagatcctgccaagatggtaatatgagcaatcatatctagcaatgctatccccaccctgctgattgccattccattggcttcacagtgagacagacaggtggcagtgcagttacttttgacactggatacgaactcttttattaattaattaattaattaattttccagcccaatcacagttttctctctctccctcctctcctcctagttcctccccacaacctcccctctctcctaaccccatccacttctcctccattctcttcagaaaaggacaggcctctcacgtatatcagtcagcctggcatataaagttgcagtaagactagatacctcctctcctattaaggctggacaaggcaacccaataggagggaagggtaccaagataaggtaataaatagtcagacacagcactgcttcctcggttaggaatcccacaaaaagaccaagccacacaactttgctgctttacaaacataaacagcctgtttaaatacatgaaatattttatacttaacatatttaatatgttaaacatgtttcaaaatgttaaataactcattttcatcagtgaagtctgtggtagagagtggatcagaacacagacttccaggtgaatatttctaccactatactgtactaactcctatccatttcagaaaaagaaaatttaaattgagtactttttttctctacccattattacatctctactattacgcctaaattcctctctgctccagcttgttcgggcagcatttaatgatgtttattgaagcccacttagcccatgttcaacaaaaacattaaatgcacagtttttaaaaggagaaaaacatagcattgagtattgccttactttcagaagataattttgtatgcatgtagaacttactatggacttgggaataattccactttatgaccctcatattcagttgctaattactttttcgttgtcttcaatatatttctattgcatcaatgggaaactatagcagtcctctagtgacaaaaattatccatatcaattgttgtgaatattaattaaaagctttgtgtcttcatggaaaaccatctacatcctacttcaaagacatttcattgcagcactataaaaaatattacatcagttaaaattttcagtacattccgatcaataagattataggttcctttgttgttcttcaatttctgaaaagacaaacattttttaaatgaagtcattgatctaccacactttgcctgtaaaagaacctatttcaaaagaaaataaatgtgtcatatctgactgagggaaaacaatatcagagaaagaaagccagttagttgttgaggcttcttaacgagagtgcagttgagagaatcaatcagccatgtttgctgtgtgccaagcctcacagaagtggaacacagagggaagagtaatgggactgggttctcaaggtagagagactggtgtcttcacatgtgttcaggcatgtcacgtgtacacttaggtacgactatgttcaggaaagcactaagatatgtgatgagataaactcctgcctgtactgatattgttctctctcatctccttgttttttgagagagcacttcaagaatacgaagtgagctgtaccgaaggcaacttgtaccaagatattgtgtagaacactctgtcttaattaatcttggttatgctacctccaaggatcaatgcagttctctaaaatattatatctaaaacatcaaaatgtggccaagatttactagagcaaaaattaagtcattttatgttgctttttaagatttgttttctttttgatcctatgtatgtagagttagattttgtactcatgagtataggtgcctaccgaggcaaaaagaaaaaagaaaaagcatcagttccccaggaggtggagttacaggaggttgtgagctacccactctacaccgatgctaggaacttaactcccatcctctgcaagagctgcaggtactcctagccactgaaccatctctctagccacaaagaatcttattttataagcgtgataccatttatctttacctgaaagaaggtccttgcttcaaacacaattaacagtgcggttaatttttacaaacaaatgtgttctgggcctaggccctatcccaaaggatacaatagactctgatgacacccaatgcatggcctcaccatccaggggaagcagaaaagatatgtgatagatagggttttagttgggagggtaggagaggatgggagggagaggggactgggattgtcaagtaaaacaatcctgtttctaattcaaataaaaaaagttggaaaaaattttacaaatagataatgaggtcttgagtttcaaaaagtcaagaggaataagtcgacaatgactggtgcacagcaatgtttcttctgcataaattgcacactcattgactatcacagagcccatgccagtatcttccctagtgccatcattcacctgcaattctaatctcaaagtgactgatgctaatttgagcattgtccaagtctcatttgtaaaccctgctctcttcagcacaggatcaggccactatagagatgagatctgccttttcctgagctgattgcatcccatcttggggcttgaggatgaatgcttcccaaaggctcttgtttccagtgcctggtgcccagacagggctatctgggaagcttgggagatgctaccagttggagtaagtgggttgctggtggtggatcattgattggggacatcttgtccctgcttccatcatctcattctctctctctctctctctctctctctctctctctctctctatctcccccttcctctctcttcctctccttttttcctctccctctccaaaaaagtgaaaaacagcctctcagcctctctaccactcccatatctccatgactcaagtatgtgagacagagcaactgtgggatggtcctctgaacctgtgcaagccaaatagtgttttctcctccctctaacttatcctttcaggtattttcatcatagatataagaaaagtaacaaacggattccatttatcagatagaagactctactgaaaattagagcagtcaaaagaaataatgtcacaagcaggaaaaaaattcaaaaattattattttgccttttgattgttaacacacttcttacccaaaaatagaaatgttgcctagattgtggagaagttaggacatttatcagtcaaggttagattataaaattcacagtaaaaccagtatgaaaaacagctttgtagctcaagatgtgaaatacagagttacatataacctggcaattccattcctaggaaaatacccaagggaaataaaagcatatgtcctgctatggaaaaaaaaatattttgacagttgttaaaatagcaaggcagactttattcaggaccattgtgaaaggtgtcaagattgcaataggcaagagaggagtgtctcagctcaaagcaaggatgctggagtatggacaacaagcaaagtggggagcagacaaggactcaaacacatcaaaagaggattctccctacaaaacttaacagggtccttattagaggtacattcgaggtctcacatatcaaaattcaataatgagggacacaatgagcattcagagtagaaacatgctttctaagccaatttgacagggatttttctcacactcacgtctccagtcctggtgagaatgctgctatggtaaaggcttcactgagaggacttggaagaattttactaaatttggtcaatgaaagaattagtcagtcctcacaaaatcctgtacatgtaggtgtctagcaaaattccccataaccaccaaaagagagaagaagtaagtaaatgcctatccacgggagaataagcagaatatatatatatataggaatattcttcaaccctacaaaggatgaagaactgatgcatgctgagaaggcaaacctttaaaacatgatgctaagtgaaagaagcctgtcatgaatgatcacaggatgtgtatgctcggcttctttgagatgtgaagatgaggcaagtccttggagacagaaactaaattggtggttgccagaggacagggaagaaagtagggactgggcggttatggtatacagtttcttttgagactagtgaaaatgcagtagaattggatagtgataatgattgcccaacaatataaatactacaaacactggatagagtgttttaaagggccagttttcacagttttcaaaatccccagatatttttacaggtgaggttctaggcacacactacttttctcaatcctttttaaattcttccttagtggtggggtgtgtgggggagggtgattgctctcatctagttatgcagagaaaatgcactttacctgcttcctgctcaagctcactcccaggcaggcctctccctcccttatacaccaacacacacacacacacacacacacacacacacacacacaaataaataaattaattaattaaattttatattaaaaaatagctgggattgggatgtagctcagaatttagggtgtttgcctagcttgcacaaccctctgggtttaaacctctgggtttgccacacaaactgaacgtagtggtcacgcccaccattatcccagccctgagaagatggaggcaggagaatcagaagttcaagcccatcctctgctacttagtgagtttaattccaacctgtgtatgttacatgagactctgtttaaaacaaaataatcttagctagctgtatgtagtcacaatgtgatttccatgaagtcacaatgattccatgaatcgcattgaatgatcctcatgccatccattgtgctcatctactcacagcccacccctggagccctcaaactctctctggtatcatgaagatttcagatagggcatgactatacagcaaaagtcacaaagacactagcatgaaaagacatggcactgaggatgctgcagatataacagtagggaaaagtcacatggagaagctgccagtcaatcctttcctggctttactgaacaaagaacaatgacacaataagtcaaacgacctgggaacatagctaattcaaggctcaggattacagtcttccacagtttaacacaaaaccatatcatgatgacttagactagagtccaggagtgcccagaccaaaggcaaatatgaaacctcaatgacttcactgggggagaagctctcctgtgttcccactccactgtcctagaatgtagatttttgttctcctgttcgttgcctcatgtctgcaagataactacaaacccttgccaccccccccccccacatacatctaagttccctaaggaccagaccagaaaatataaaggattggatgaagaaaaaattatgaacatttccttaaagtctccttgatcaaaaccctaccccttgatgtaaactaatatagaatgtaaaatttgaaaacaacaacaagataataataataataaggtcttcaaggtaataagattagaatgcataggggtaggcaattagagttagggttcatgaatacttcctcaatggcttacagattttctctacagtctgtatgtgcacacgtaggtgggaaacagatacatgtatgcacatgatatggaagccaaaggaaaatgtctagtgtcattcctcaggcactgcacacctgttgtttttgttttcttttctttttttgacaagatctgtcactaacttggaggagtccaagaagggcagacaggctagccttgaaccccctgtgttcctcctctgtctgcctcctcaagactgggattacaaatgtgaaccatcttacttggccttttccatgagttctcagcattaaactggagccctttactgactcaactatttcctaagcctttaaaaaaaaaaacctttaatttttaattttcacacagagtatagcttacagataaaattcaaatatagagctagatgcccatctcctcatcaggtgagtcagaatcaatttgccattttcattgccgctaactaaatctctatttgtgacaaactgatgccaaagaccattattttaattgtcacagactaatgagaaaaggagataaaagctagaaaggggtgacagtgcataaaggatgggctgggacaaagtgaaaaccaaactacactgcacactattgggaaaagcagatatacttactaatctgtgaattcatcagacaaggctatgcctctggctgtctcccggagcacttgcttccagacagggagcgagaagcccttctgatagttttcttcttttcctagtgtacagggtcaaagtagttcatagagccctgtgttcagagaagtgttagccctctgatttaaattcaattgtttttctttgttgacaacaagatccaagtcttggatttgacttcaatttctgatcctcctgcctccacttcccctgcaccgccatgcccagtttatgtggtgccggggatggagccaagggctccacgcatgtaaggcaatcattctaccgacttatcaacttagctacagtccaagcccttaaggcagataatttaggtattttgttaaccaaattgcatgtagctacttgcgacacaatgaaaaaccacagcagctgtaaaataagaagaaaacctgaagaatgtgcattattatgactaggtagcttctgcagattcctgctatagtctagtggttgttgaaaaacaaccctccctgaaactatcaaccagagtaattaaaaaaaaaatcaccaatgttaaagtcactgtggaaccagctgagaaatttgatgagcttccatctcccagtccaagaagagtggcattgtgtagcctgctgagctcttgcccagtttcaaagcatctttccactcgatgataaacagactggcacaaggggctgtgccaagtgttcatcgttgtgaccaagatacccatggaatcgagctcaccctattatcctgcctggactactaaacaatcatgcaacaatggatggttatagggtctccaaaagaataatgtgtctaacttaaaacctccagaacagcttcctttattctcttactctgaagaaagcaatcctttgaatgctctgtggcttcctggagcagcctcagtggatttgagcactctgcttttctatttaaagctcctaagaatgaaagatgccattatagagagaactagccaccagcagtgggagcatgacgagtcctgggcttcaaaatgaacttgtaatggcagagttttccaaccaaggaccatctacttaatgatcctcaacccgtgttcaaaatctccccaagccagcaagactcttctttctattcgaatcatttcttattctttccttggacaaatattctggagttgtggctcacaagtccttcacgctgtacagtgctatctcacccttccttacccacttcccagtcttctgccgggtaagataagcaatgccccttaagctctcctctttcaacaaagtcttccactaacagtgtggatgaaagatttcagccatcacacagcttcttctatcattcctgaattctgggcctctagtattcagatgagagtttgatttcattttcttaagattgtgtgtgtgtgtgtgtgtgtgtgtgtgtgtgtgtgtgtgtagacagggaaggttcttcatcaaggtattatcctgggctgggaactgagaagctggctcagaactccaatgttccacaagagcaagcagcactaagggtgcaaccacggtgccatctccccagccagagagtctgctttctaacagctcagaaaacacagggatgcagcttagaactgggagcaagtgctctctttaatctcattttctttatcctctcattccccaggttttccatatgaaaagttgccaaattcttcttcttaatcttccccaccatcaatttcttaccccaattctcccagaggccccctctttctcacatgttccttctgcactctctcttttctgattgaccaatcttggaaaatgcaaacactatcacctacctatctatcatctattaatctatcatctatcaatcatctatccatgtgtcatttatctctatcatctgtctatctagctatcatttattgacctctgtctatctttatgtctatatctatctctatacctaacatctacctatctacctgcctatcatctatctgtgatgttagttttaactgtcaacagagcctggaatcacctgggaagagtctggatgaggaaatgtccagatggggtttgcctatggacctgtctatgagggattgtcttgaatgctggtgtaggaagatccagctcactgtgtgcagcacaattccctaggctacaccctgaactgtttaagagtgaaacaagtaagcaaagatccctctgtttattaagttcctgcattaacttcaccacaagaagagactgtaatctgaaattgtaagccaaataaactctctcttcccaagttgtttattgttgggttattttatcacagcaacagaaatgacactagaacactatctcctctctctctctctctctctctctctctctctctctctctctctctctctctttctctctctctctgtgcgtgcgtgtatgtgtgtgtatagctatttatatacatatacttgtaacaagaggcaaggtataatacaagacagctatctccaagctttacctcatgatattggggagcaaaacatttgtatacaaacttctttaagtctttgttcacataaggcttgataggaccatctggcattcaagtgatccaaatacatcttttacatatggagactgcttccctttcctccccagccagagtggggggggaaaggagcataatgcttgcttctaatttagtgcttggtgtcttcagacaccaaaagcaccaattgaacagtgagttagccattgagaagacaactcaggtattgttaggttgtgtagatatcaagcttggaaattctttcaggtaactcacaaagctccaagaacaagtgacaaaccctgctttagcccaaacatgtaagtgtctgggtgaactggagtgagtcaacctagaagggtgattcatcactgctgacataccacctctaacacactcaaatctgaagtcacttctttcttcattgactctggggacaaatcttgagaatgaatgaccttcttagctggaacagctagagtgagatttgaaaaataagccctccctgagccagaggagtttgatggtggatttctccaaggcaacgagcaaggagaagctgacttcactctaagctgctaccataaatggttgaccagttggcatctctgcagaactcactatggccactggtagagacccacccagggccatgggggcagcctgccattctgtaactgctctccccacctgtcctagagcaggggttcacagactgaagatgtggttgttcagctactcttttatgatctgaagagggggtagttctgggcttgcctagttacgaatgccttgctcatgctcactgtctcttcacatatctaccagtatcctacctgagcctttccacttgtggtctagaaggccctcacacacacaccccacagaaacctactccagctgaagcatgtctttctgcttcccatgacatgtttgtggttaacactgggccttctccacagctaaattccaaacctcatgtaatatccttgaagtcagagacattattctctctctccctcccttcctccctccctctcataatgactgagagctgtttagaattgtttgacactatgtcagaagacagaacaaaggaatgggacaaggggtggctgttcagagtgatggaacaaaaaggagaaaacagggcctgggtcctagcacttatgtcgggacagacagatgcacagtacttctgggggcaatgtggaaccttccacattatcctgcattatcatctccacatcaaccacaaatttcataagaggaaatagccaagattctaaaatgcagcccaaaatgactttgttttttttttgttgttgttgttttattggtaggttggttggttggttggttggttggttggttgttgttatgtttttttgttctgtttttgttgtggcacaaccaagctctgtcattcataatatgcaaggaaatgtatctcttttctgctcattatcagagccagcgtcccatttctggtatagagaggctactgctgcttttgtggagcttttcatactagctgatgatggcacttttgcaggctgtctttcctctggtgaagaaacattcctggaacaccaggtacagtattctggacaagttgcaagtctttcctgcctccagaaagcctcacagtgggagtcctgtcctgtgttgtgagaggtcatagaaatgttctgaattaattatggatgaggactctcagcaaggggtgagccaatagccagacacagagacactgtcccagaccctgtccctccagggagcagagaccctgagggagacacttaagactgtcctcaatttctacacagtcacacaccccacaggggatgtgactaagggaagagaaagatcaaagagcaaaaagtaaagccaaaggaggaggcagagaaaggtggagaaagggataaaagagagaggagggcaagggagagtaaggaaactgagaagcagggggtaggcaggagaggacagagacagagatagggaccgtaatgaggtggctgggcttctgtttcattttctctccttgttatttaaacgcctcccttactggagtgggtgggatggtgctgaggttgagctggctgctgctgtgccagtgcctccggggctgtgggttctggtctccatggaccctcaccgtgccctgcactaactcctctgaagtgtgggaacttgaaagcatccactctagacagctcagctatttcaacaaaatccatttccatcaaattatcactagtggcagtgatagaaaaattaatgatttcttgaagggactattgtatttaaatatttcaagcccgttggtgtgatgtgtgtcagcatgtgagaaacatattgactgggagccacagccaatgccggcttttataaatatcctgtcagataaataatggctctcaatggatccagtatgatgtacagttctaaagcaagcagggttttgccaggaggctcaaaggaaatgccatcacaatagcacaggctgaataatgggagttttcgtttatcttctgtaccagagaaagaagctagagaggtttgctcagcgggcaccaaggagagctgagattgagtcttcagattctgcaaagggtccagccttctgaggctactactgagagcctccagaataccaaacagcaagcaccatttgcatttgaatctctatccagcaggctggccaagttgaggcagcccaggctggctgtgctgccagggaacagctcctcttggctcagaatctcaggatcaagggagaaaaccaagtccacaaagtgccaatcaggatcaactgctgtcccagcaatgcagacatgcaatcatccacctcatatcccatcacttccctccctccttcccctaaccccttggctcattcacgtcacatgaaaacagaaacctgattaggaaaagtgaatactcttcatcttgcttcctacgaagaacaaccaacattaagtgaagggaaggatgagagaggggttagaattgctgagtggatactgtggattccccatatccacacacagctgctctgtcagaggaacactggcatggccacggtttgtcttcaaaatccatttgaggctgagaagttgcagagcatcagaattacaaacaacccaattgaaaaggagacagtcagttaacttggactcttccaacctactctgtgtttaacactgccttctcttaaagcagtcaagactatctgttctctagcaaataaacaaagttgaaaattaattcaaacatagagcagaaaatatgctgccataagtcataagaggatgaggtaaggggaaaaacaaactaggtaaatcatcagtaattcaaaagacctcatcttagctgaaatcaatttgttaataacttaagatagaatataactctcaaaaatataagtccaggttcacccacgtagttcaatggtagagccactgtcagatacatagagaactgggttctatgcccaacaatacaaaaacaaatataaacttgcataaccactatactaactatcctcggacacatgaggcacatacatgttcctcctagaaatccatctaggttaaaattgtaaagaagagaaatcacacttcatccccattgtgcctagtggtttgtttgaatgagaatggagatataattttcccacctccacaaatttcatggccacttcttttacagagtaaattaggctttgtcatataactataagcagacattgattaatgataaggcatgttctgaggaacaatgcatcatcatccagtgatgttgttgtgaggcaagcatcacaaagggtatttacacaaactacatgcacccagatggtagaacctgcaacacattgagctatatgggatataccagtctgtcattgaccagacatcattatggagttctactatgtttatatttacatcaccatctataagtcggttctcttaagaatcaaggcttttgcaagccctccacagacacagaaagccacaccatatcttgtaccaagtatagtcacactggggacctaaagagatgactctcccatcacatacaagtgatacaagataaaccttggctctccatcacatggaaacaatgacagcttcggaagaaaaacgtgattgatgcgtaacctgcctgggtctctcatatttgtaaaggaaatggccttacatgacaccagaccaaatgttccatgcttctcagttgctcagctccttggacatacttgttcaagaaaaagagaaagatgaaaaagtcacaaaaccagattcctattttcagagtctctgatcacttgtctggtttgagctcaagttggattgcctttcaactttcagtctttcaccatggtgactgatcatgcaggcagccaaaatgtccccccatcttccatgaagctattctttcaaattctcactcttcatcttactgacatgagaccgtcatatgctagagggaaatgtcagcttcctacaacctcctacaattagggggagagcttgaactaaagagcataagggacctggttcttctatgagtccatcagtagccattcctgactcctcccccaatcaaacaacacacacacacacacacacacacatacacacacacacacacacacacacacacacacacacacacacacacagtgaccatgtctgcagtgtataatgggcccaaagcccacactgttctctctcttgatggtgttagataagcaaacataaaaaattttcacttggaagctgtgaggcattgggcaatgtgccatgttctctcaaatgtgccccaaagatggaaccaaagatagaatgcctcatcctggtgccagagaccatttcctcctggatacctgaggtgctcctcggtccaaaattacatgttcattgttcttcatcctctggcctccctgtaaatatgcagtttctggaacattgcattgggtgccaagtaaaaggatattctttgcattgagaattgatagtgaagacattatttttcatacactaaaccactctttatggggtagcttccctgaaccagccatagcacctttattataccctttaaattcagcagtgaacattgttggggtctctgctgtcatgcatctcacatgcttgtttgaaggaggacaagaaagaaattgagaacagaaaaagaagccaaaataagtaaaatactcacacttgtgacaagtacattaagtgctattctgccacagcccactgagtccaggactttagagaggttgcagcagcaacacacacacacacacacacacacacacacacacacacacacacacacacacacagagacacgcgccccccacacacacacacacacacacacacacacagagccaagttcctggttcccacaatggttgctccacacagcaacacacacacatagcaaagctcctggttacagatcccacaatggctactccactgttcaaacagtgactttctgtaggttcctacttaataggtaaaagaatgtccatcctataatcacacagtccagtcaagtgtcatcactgcaattgaagtgacttctctatctgaaattccaaaatgtggggttaatgtcctatcttaattcctatcctatttttgttcacccagtgtaaggagagatgccaagagagcaggcagattaaaaatgcatgacttctcccactgccatgattccttttgcaatttttctagcagactttgagaatatggagtttttgaaggggggttttctttgttcctttattttctatgactttatagctttcaaggctttttatcttttccttcaaaatgtttgaaggctttgctatcagcctctaacaacctaaacctttgtttaccttgaaagccatttcctgtagtctcccagagactcctcaggttatgacattaccttccaacttggtttagctgccagcacttccttttccctgagctcctaacccacaaagaatgcccaggtgtccttagacctggtcacaagttatgtttgcttctttgttcttctccacgaccctgctgtcattggcagccaacccagaaagtggctgtttctacagactctccattccacatcctgttttgtttttctccagatgtctataggttttccaacccaaagtgagcaatagcttctctggaagccatttccacaccagcaggcaagccttgagactctaatgggaaattgtggaaagaggtgaagtattcacccaaagtttgcagcaggaaatggcagctctccaaactccagcagagctgtcactagacaaaggtagcaaggagaattgtttcagtgccattccccagtgccaggtgaaaggcattttagctgtgaacacagactacatcttgattttcagatgaagcatgagtttttaataactcacaccagagttttttaaaacatatggaatcaggctgggaagatgtctcagtcaataaagtgtttgttaccaagcatgagaacctgagttcgatccccagaattcatgtaaaaatgccaagtgtaatggtactcgttcacagtcctagagataggaggatttctggggcttgttgtccaatcacactagcctacttggtgagctccacaacagtgagagatgctgcctctaataactacacatacacccagagataaccaaaagaagatgggaattaccattatatatcaggcccactggtcaacaaagcataaacacagagagatctagttaccaaatcacaagagaaacttcatttcctcctccaccaatgacctgagtcaccacatattatcatttatacttatcagccaataattatctcttgcctgctactgctccagaccctagataaaaatggggtaatgaaggcttggaactcactttcaatgagtttataatcaacaactatgtgtaagacagaatgtcagaactataagtagagtgttggatcagcaaagagaagagagccagatccttagacagaagtgggaatgatccatggggaaagcagcagttgaagtcaccttgggtgagggatgatgaggatggagagcattctaaagcagaggagccaaggtagactttgtcatcttctcagcaatcttctacagctcccttttgtctgcatcaaatccccaccaaacctcaaaagcagcatcccccagaccaacctgtactgtccaacctctgggcacctgttcatgttctgtctagtgaaatatggttgactgtgaattcagtaatggggaggtcccagtatttatgatcctggtagtctcacacacgaagtaggcaacatttaaatgtctcttaagtgacagactgtgagggaaatgaagtatatgtgttaggaagtgatgatggcacacttggcacacaataatgattctatacatacttggcattcttgaagaagataaagatgatgatggtgtggaaaagcagaaaaactaaatgagagcatatcattgatgtgctttcagatgaccacactgtggcactcatgacctctctggggctgtggtatatacaagacctgcacaagaccaagccaacaacatcagtcaatattgcagcatgccacactaattgaactcattgaattacaagggggtggtgtttacaacttacttaagagctctcctagaaagaggtggtgtctatatcttccccttacactaatgggctctgtaactgctttggtcagtgaaataagctgtatgtgacagacactgtgccagtttacaagccaggatcttgacaaactggcagcttccactatctgtcatttagaacactcattcccaaaacctatttgccagacagtagtagctccagccacccaaggagagactacttgaaaacaaaccaaggctcaaatccagcactatatccccagtcgacagccagcacaaacctgttcatcgggagtaagtcatcttaggaagtgaatcctccaggctgagggcaccacctcagcttcagaggactggaagagagacaaacaacgctccaaccaaatggaaagtcatgagtaatgaaattagtgatgtcattgcaggctcttaattataaagatgtttgctgggatagcttaaatgggtctagagaaatcagttactcagtagtagagctcctaccttgcaagtccaagttctaggttcaatcctcagtaccaaaagaaagggtactaaataatgggccacctaagtccaatttcaaaaatctaaagttttccttaacttctctatatttgtaacttttcagtgtggccaattaatgaacagtctacttgccacagtttgaaccttaaaatattcctcaaagcccatttgctcaagcttagtctttgcttatctcagagtataaacttgagggcacagggcctaattaggaagaagtcaggtcatggaagatatgaccttgaaaaggattgtaggaccgctgtccctctgtcttccttttgctttgcttcgaagctcccatgagttcaacagattcctataccacttgttcctactgagatagtatgctatcttaactgcagcacaaagacaataggatgaagccccccaaactgtgagccaaaataaatctttacctttttaagataattgacttgcactatttgttataggagcagaacactgactaacacacccttcatcccaagtgaactttaaactgtggtatcatgttcaaattagatcctaccgaaatctgagtggggatagggctaagcaggaattgagccttggccttgtgtgtttcaatcaaaggtgctcctctgccatctgttttgacattctgagttgtccctaggaatccatttgaaaaggattttggagctgcaaaatgcttgaaagatgtttccctgcactattaaacccagaaaaccaaaggctgtgttttctgagaggaagtctgattacattcacgaaccagtggaacaactacttcaattgttttcagatttcaggcataacgttttctaccatctctcatatgctgggcatttttgcttctgcctgggatgcctggtacagcaaatttaactcctgaagctttcggaagctccctctctaagcgacaaagcagtgacacctgcttggaaaaattcctcccaggagtcatggatgacatttctgggaaggatcccagaatggcacattggaaattaataagcgtaccaagcaaatggctcctgtggaagctgtaccctcttgttcattcagcaaaattgtattgtcagtgtaatgacctacctgtctccctgggccactaccactgacttctggagccatttaacattatttcttataggtcgacgcttgctttagacactagcatcccatatatcctcagtcaggggtgatttacagatatataggtcagaaatacaagcgtttgggcttgccaatgaccttggttagtccggtcttccttatgactagacaagactctcctccagtgacaggtgcctgtatgcctctcagttgtgagcacgtggctgcagccttgctccctacctccataaacagccttatccttggtttcttcaagcccatcaccatggaatctttctcattatgcagccctgtaggcccctgccttcctgagtcagagcatcttgttgtgttccagatctctccccaccacacctgtctgcctgcacctccctgtaaagcaccacctgtcaactcttgatggcccatcttgatgctaggaattctccaacctgtcttcactttccagatgtcacacaatccagagtggacaatccctatccattccagcagagtcaggctctctctgggcctgccccaggacagcaagtgttattctaagatactgtttcatttctgttttagagttccttgaacaaaataccacaggctgaatgcctgcaacaacagaagctattgtctcatggttctcaggctaggaacttgaagcctaaaatcaagatgtcaacagtgtccattccttccaagagccgtaagttccaatatgctctccttgactctcaggattcactccgtcatctccttgggtaggcatgctgtcgaccctctatgtgcatgtctctgtcactcttattctaaggcctcattgaattagtgcccaccctaatgactttgttttaactatctctgagaagatcgtgtctctaaatgcagttatattatgaggtgtacaggtcaggacttgagcatatgaaccagaaagaacacattcacctcttcacagatgttgtgtatccctccggtccatcgtcgggcctcaggcataagtgtgtcgcccaagctcctggcacaagagtccccttctacctgagaaactgggggaactctgggagaaaaccaatttaaaaagaaacctgacgaagcagtctggacatcacttgcatgtctgcacattctcatttcttagggggaggaaaatggagcctcagctgaaactaaaagaattctttttccttacattttatgaagatgggtgttttgtctgcatgtttgtacgcctgtccatcatgtgtatgcctggtgcgtgtggtgaccagaagagggagccagatcccctggggctggaattacagatggttgtgagccaccatgtgggtgctgggaatcaagcctaggtgcactgcaagagcaaccagtacccttcactggctgagacatctctccagcccctctttcttgtttgtttaatttgcagtttagacacacgaatcagtgctgcctcaggctcataaagaaaaaatgtatccttatcccttacctaaagtagttagctaggtacaatgacaattcaggaagcacaggggtggcagggggcacttggacaatccaggggtctggtaatcagctacctgtgacataagtcatcacatagcagatgactcctctagttcataagcattcatgagaaggtcattgagatgctcaaaattaatggtgaaggtgtaaggtacagcatatttatatctgctaaacacaatagctagcaaatgtgtgttgcctttaaatacatacagatttgtgcctaactggataagtagttagggctatgagtgtcaaaattaaaaagaggatttccacaattctaacattttaaaaaggaatgttatttggctttgccaagtcataaaggtatactttgtgggaaagggttgcactaaaatatgtgcctatcatataagtgataagccagaggccagtctccaatgtcattccttaggcgctgtccatcttatattttgagacagaatctctcattggcctggagattactgacttgactaggctagctattcatggagccacagggttcctgctgtctctacctccccagcactgagattacaagcacacaccaccatgcttggctttttcacctgggttctggagatcaaacttattcttcatgcttgtatggcaagagttctactgacagagccaacttcccagcccagagaggtcataatttaattagctcctgtcggtacattttctccactaacaccatgtaaggggaggcaggcttcagcctctttgaacaattgtaggttgtcgttttcatttaggcaaaggaattgagtgtttgcagagccacaaagaagaacactatttcactcacctgagctattatgacttcatcgaggaagcatgatcaaagccagagcctctttggttagctttgtctgggcaaacgaaattcccagaagaggaggtacatgagcatcaagagacagccagagaaccaagcagctgccaggctaactgcatcaaatcctagcgttccattgagtcccattgactcctaattgtgctccatagtaaaaggctgggctgcctgcaatgaatccatcaaccaaagtgaaaggtttttgataatcttatttttctttttgggaagaatatgagaaaaaccaaggagagaagggaaacaaagggcagaaatccagaggctaaattacaagtttatgaaccctggaaacagtattagcctactcacattccaaccgagtgtctacattctattggatttctctccagcttagatagggcgggcgccatgctctatgctcgactgccttctagagtgttgttatttaatagttgacatattccgccagctgtggcagccattcccacagaggtttcacattagcttaattttcaaagctttgcaaaaaattctctagtttaacagaagtgatacacagaggtagggagtttaatcaaggttgttcttaatagagatatgactcacaagtgatgcccagtgtggacatcctgacctggcacctcgacaggatagatactcagcaggaagtaccgcctttcacatccacagtgcccacaagtgttgccttatactcagtcatggcacatattttcaaatatatccctaactatatctgagaatatgcatcttcagaaccaagttcaagtctgtaaggagaccaacccttctgccatgctactttgtgaataaacacacagctgaatcctcactctgagctcagtggtcattctggtggttgcccaggagttacatgggactcagaaaatcagcacctggactggtgagatgagccagaaggcaaaggtccctgctgtcaagcctgatgacttgagttcaatccccaggacccacatggtggaaggagagaaccaactctcacaagttgtcctctctacaatgtgtatatacatgcccacatccattaataaatgtaattttttaatgtctaaagaacggttgcagtgtgttttatttgcttgactgtgttgttttgttttgtgtttggtcttgagacaggatctcactttgtagccctgaatgaacttttttttttgttttgttttgttttgttttgctttgagacagggtttctctatgtaacagacctggctgccctgaaactcactctggagaccaggctggcctccaactcagagatctgcctgcctctgcctcctgagtgctgggattaaaggtgtgcaccaccattgcctggatgataataataattttaagacgaaagaaattctgcagaggctgctgtacagatcaggaggtagaatcaaatgctcttttccaggcggttccaccacagcacatccatgcctccatcttgtcatttgtgacactccgctgtcttgtaggatgttcggagagtgcacagggccctgtcatcttaattatgaagcagactgcgcctttaaaagctgcctgtggctatttctgctttctaggttgtgcaacagaatttatcttcaggggagaattgtttctctgtctttttttttttaatttgggaaaacactgaagtatactttttaatctgcagagaaaatgcccaaagcctaatatgaaaagaaggatggaacaatgtgaaaccagtgttaacaccaagccgttgggtggccttaagcacccctaggaagacagccttgccatcttacttaaaaagtcctctttgttcatccccagggaggaaggtgcctgaggctctggaagaaaccacaggtgaaaggtaagaatgaaagaaagtggaccccaacataagatggtcaccagccaggaccgggacatgtacttgtgaaatatcaatagccggtgttcatttaggcccatcgttctcacacagtagcctctaaactgctactgtggtctgtctgttcaccaccgcctcacaacagcacagccactgaaggaagaaggtgtatttggggaaaactggtgcacaaggaggcagagcaactgtgcaaatacagagaaaaggtgaagagggagtgcatgccagagcagtggccaggaaaagtgacagcactggagcatagaggcatgcaccactatatttgatcaagaaaatacttaccccggaagactggacactgtgtctatttcagtggctctggggaatcaaactcaaaccttgaactcgataggcaagtgctctatccctaaagctacactacagtcctgaaagactttttgttctctttgggttatatttattagtttagcaatcagtagccttctaggcacattgaagatgcactgaaaatattgggtaagtggttgattgaatggaatggaatggagtggaataaagaaatgggttttgtttcaatgtggtctcaagtctatactcttcctggcaagttgcatcatgtcacattgtatttctttcttatacttactttgcttttacaatgtcttcaggagatagagaagactctaaatacaaagaaaacacacctccccaacccttagtcccaaatgcaaagtgctgatcttggtaaaacagggaggaatattggctaatcagcctaagatgtcatagacctcatattgggtcctatgcatgctcctcagggcagcctcccatcacaccgatggcctaaaaggacattatgctgggaaggcttggtccaagagctcctggttttcactccagagagtcttaaggtgacaagcaactcagcagggagtggtcaggggacttctcctaccacagggagcctctgggagtccttggaagtcaggaagaaagcaataggcctgtacaagcttccgggccagaggccttcaggagcccaaggtcagcaaccttccatttcagaatgctcatccagcatgaagccactgtccctcagacactactctctcacaaagaaatttgaaaacttttgcattgcctgctgtgacccctgcacgcttcctccttctttggcttacttctattcttcagaagtcattggattttgtcctatgaagcacaaaagtgtcgcccttctctgcggtggctgaaaagttaaggtcacaggaaatcccaacatgcacagagaagcccaggtgtgacccacactaaaaacagagagtacagacttcactgcagtgtgccaggggcctgcatgctgacgcgtgcctgagttgccagtgagtaggcctgcaggcatgtggaaggaggcgggcaacagggcaccactgggaattctcggctctcctgtttactattttaagtgcctctgcaaagaatatgagaggcagaaaggtcctggctgtgagctgcccacaactgctcctagcacaaagacttgacaagaggtagggaaattacagaattaatgatgaaacaggagggagatcaaaagagggatggaacaagctgagactgggaatgaatgtgttcatactctccatcctaaggggtgaagaagacagggggcacaggacacaggagagacaccaaggtgcacacatcagagtgttttaatcatgggggacaaaaccaacaaagcacaggtgagcattgtcaggaagagattcgctgttggttaagaaattatattcagactttgtgttattcaaatgagcactcctgtctctaggtacacaaaagaaaaaatttgactttctaatatatttgaaactactagtctggtttccaagatagaaacatgaaagtatcaagtcctgggttggggatgtagttcagagtctgaaatgtgtgaatctatgggatcaaatcctaatactgcatagaccaggtgtgatagcacacatctatagtcctagcacttgggggatagagacaggagaaccagaggttcaaggccatcctgagctgtatagtaaatcccacatcagacaaacaagaacaataaccatgcaagcttgatgatccagatcactggaacccacataaaggtggaaagaaatagcagattctgcaaagttgcccttggaccttcacaagcactcatggcgagcatgcactcacacaccaccaccaccaccaccaccatcatcatatgtacacagcaataatacctaatatttctgggtgttcctggcacacgccttcaatccaagcactcaggaggcagaggcaggtggatctctctgagttcaaggtcagcctggtctccaaaatgcgtgccaggataggctccaaagctacacagagaaaccctgtctcaaaaaaccaaaataataataataataataataatacctagtacctagtatttcttaagtaactttgaattcacatttttcttaaccttctatttaaatatgttggggagtgagcctgatgcttgtgtttaagatattatttatcgtcacaaccagaacacagttcaaatgcagtattctgggcctattacaatactcttgcagatgcctagagcacaaaagccacagttaaagaactactgtgctatgctgaagcaatgagcctcttgcttttgtgtatgaattactattaagaaaagctaaaggtgggctgtgaatgtagctgagttggtagagagcttacctagcacgtgcaaagcccttgggttccatctccaaaactaaatacaccaggtgtggtggcagccacacctgttattccagaatgcgggagttattccagagtaaaggatcagaagttcaagctcatggtcagctatgcagcttgttcaaggcaatcctgggatacatggaactgtttcgaatacaggaactagagagatggcacagtggtcaagagcaaccttagttcaaatcaacatacacacccccatttaaaagccaggagtggccacatgcatctgcaaccccagcactgtggtaagatagacacaaagggagcacttgggacttgctggccaatcaacctagctccagtttcagtgtgagaccctattccaaaggactaaagaaagtgatggacagggccatctaatgtctgcctccagcttggcacatgccttggtgggcacacacacacacacgagcatataccacatacacaaaatgcatacactacatgtcacacatatgtggatgtgtggatgtggggttgttaaagatgaaaatgaataagaatgtgatgcatttagaagaaatactataaaataggaaaacagaacatctaaatgctattagtaaatttacctgcagtgttactaatcaactaaatactatttacttataaagccaatatttagatttattctctttttaaggaaagaacaaataagacagtgctctaaagcacaggaaaaaacaaagtgggtttttttccaaggaattgttgctactgttgcataaccttaaaaagcaacactgcctaatttctcttgctaataatacctgccaaacagagactcagtactgttggctaaagtgtaagtgtgccaagacaagcagcaactcacaaccagcctgaggaaaagtcttgaaaatcatgctctgattgaagggaaatttccatgccttcagaagtatgttcagtgtggagagacgggtcagccagtaaggcacttttcacaaatgcttgaagatgtgagtgtgactccccaggagccatgtaaatagctggatgcaggccagtgagatgctcagcaggtcaaggcacttgattccaaaaccaatgacttgggttcaataccttggacccacatgtggaaagagagaaccaagtccttcaagttctcagacctccacatatacaccattgcataagtaagtacacacacagcactgcataagtgagtggccacatacacacaccatggcatggattgagcgaatgtttacatacatgcatgcacacataccatggcatgaatgagtgctcacatacacacacacacacacacacacacacacacacagagagagagagagagagagagagagagagagagagagttacagctagatatactacttaatgtaagtcacttgttcataggcagatatgaaatatgaaggcagaatgttagtttcagcatgatgtactaaaaatctcacaggaaaccaattctgagtacagatccatttcccatgcctaaatctcctgaaaatagaaatagaaattcaatccccagcaatagctttctctaaccacaagaccttactctaaatctgagacaaagtaaatgttatctttatgagattacccccaaactaccaggtccatggttctgatacaaattcggggtgatgccacaggctaaagacagtgcaagtgccaccctgttctgtggagaccctgtgagcatctgctttccatgattggttatgtgtgccaagggatgcagccatgaggaagacagtaagatttctcaccagggacttgtttacatttgtactgtcagttctaataggtttttattgaattaaattcttcttccctcattagagtcctgattgcttgtccttgagtgtgatgtgtttgaattcccacagggtgttagacccttctccatcttatatactgcccagcagggatcaagaacaaggctcagttagaatttgggcataatcctggactgatgctacatggcttgtaccaaacttttcctttttggccaccaaccagctccaaaatcatgacatggagacttaacattagcttggcccagcttagctctcatttctagctagctcttataacttattctgtttgtcttcatctacatttacctcagggcttttttccctttctttctgtatgtcctactttcctgcttctcgtgtctggctggctggtggctgcctggcttctgaccccaagcctgtgcctctctttctccattgttctcttctctcttctcttgttctacgcaagcctagatttcccctatttattatctctacctgccagtcccacctatccctctctctacctagctactgaccattcatctctttattagaccaatcaggtgccttgggcaggcaaggtgaaacaaatgtaactcatcttttcattattagcaaaggcagcataaacaaatgtaacacactttcacacagttaatgtaatattccacagcataagcaaatgtgacacatctttacatagttgaatattccacaacaatggcttaaatatgagatgccccccttaggcccatgtgtctaaacacccggtccctagcaagctacactatttgaaaaggtcatcgaacctttacaaagtagagtcttgctgggggtgaaccttgaggttttatagcctgcacctccttgctgtgcaccctccactttgtaactactgacacgtgacaagctggcctcatgtgtccaccttcacaccttcctgaccatgacagagtctatcactctgaaactctaaatcaaaagaaatgctttctcccctgggttgctttccttggggtattctatccctgcaatagaaagaaaagtagaccaaatacctttcaaaaaataaaataacttaccattcttctgccattggctcattctgtgccactggcacaactgtgatgacccacagccatccagcatcagcatggaaatatggcacagctggccctcctacaaactgcacccacaacaacatgcacaagcaaaatggccagagcccaaaaccctcgagaacaatatcacctgagtcatggtttttgaggtaagaattactcctacaaacatagtggaaggcagagaaaacacgtggacaccgaggagggcagatagttctctgctccatgcgaaaagagatctttcagattgatggtcacatgccccgagcactcgtctactaagcacaacttacaccttgttcatttaatgattacaactcaaagaggagtaatgcctgcacccacttcccatgtgcccctgtggaagaaactggggtttggaaagtaattcttccatgttcacattcaaggcatgacccagaccttggtccggtggtttaggcttttagttcctccctctaattcctaccctggccctgggcaggagatcctatactcactgaaatgacaggccaggagcattggagacacagaaatggtccagctccggagaaagagtagaactcacaagtagattccaacacagagacctcagagttcaaatgcacttcccaatcaggcatattcatattttagaatttgctgtttcttcagtaattatgtgaagagctattagagtttgctacctaataatttatggcaagacacaaacactctctcactcatttacctctagtttccagccaagaaagcaaaaggtagtccataaaactatgattggaggatatatttaactaccagatctctgcatctctatacctcaacattttaacatttttataactctcctgatttctcacagtttcatggcctgggtttcttactgccctcccttaagaatccaaatcagtattctggaccctgggactgtgttctgacataagttctacaggccatcaaaatgagaatctctgtgatggttaaccctggttgtcacctagagcttgcctgtgagaatgtttcctgagaagattaactgaaggaggcaaacctgctctcagtatgggcacctcccagcaggcagccaaggatgccaacagcccttgttgaactacccaaatcttacagcataagccaatctaataaatctactttaataacatacctacattcttttagttctgttcttctacagtccctgacatgaataacaagctttgcaattagatatcaatcagtcatgatctgtctgtctgaagagaaaatccaaagagatggccttgggatggaaggccaggagagaggccaggatacaaagagagaaccaccttctcagtgctatttaatttttctccaagaaacctgtagtcagttgtactggtgaatctgaaaatttcctcctgttataggcaaacagttagtctagggagagtagcgtgtaagttcagcatttgtttgttaatgtattttattcatataattgaagctcaagtagcttggcttaagacctgctattgaaactgggcattggcagcacatgcctttaatcccagcactccagaggcagaggcaggtggatctctgtgagttctagaccagcctggtctacaagagttaattccaagacagcccccaaagccacagagaaatcctgtctcaaaaaaaaaaaaaaaaaaaaaaaaaaaaaacctgctattgtctagtcttctgcttcaatgactgttttcaaccatgcccctttcaggaagccaaacagggtattttctcttgctcttttctttcttgttcccagtctctctcttcactctgagcatcccagccttcctgagaaacccatccatacattgtgtctaggatgcatccttctgttttttttccttgccttgcatctcaggatgccttctattctaatatcattcctttccccaccactcacaggctcacagtttggtacccaagctgctttctgttcattggcatctagccttgaattccattctgccacaggagttagctctaagtcaggcagtaaatgagctctttacaaacctcgcttaatttaaagaaccatccctgtgagctgcatttctgcagacatttctcaaggcattagcaaccaggctatatgcacttgcttgtacaacagcagattggctgctgttcctgtcactctgagcactcaatggtctgcctcaaattaactagcaaggtaaaccacaggagccagagagagattgtagagacttggggcttttattgttgttattgttgtttttctcctcttgtttgtgaaactttagcacctaggatatgctgaagtggtgtgggatggtggtagcagaatagtgagtttgttgagttgagggagagttgaatgttggaagatgaaggctccttagttgtgattctatcactctgcttaaattgggagaattgtggtaactcagtctttcatttttattcctgtggtacttcatctcctatgccttcagtgtgtgtatacacatgtgcagctgtgcatgctggaatgcatgttcgtgtatgtgagagagagagagagagagagagagagagagagagagagagtgtgtgtgtgtgtgtgtgtgtgtgtgtgtgtgtgtgcgtgcaagtgtgtaatctgccagtttgttttttacttgagttctggggatcaatatctttttcctcgtgtatagtttagagcataatttgctttacaaggctagtttttcacaagcttgttatcaaagacaaactgtcacctggttctgtctgtgtaccaagtctccaatcaacttgggaacattatgccaaagagggccagaaaatgcaggactcagtggcaacatcacagaagatggcccagtaccaggaagtgcagcacatggggacaacatcacagtatatgattcagtaacaggcagggtagcactcagtggcaccatcacagccgattggcctgacattcatttggggagagtatgcttttcactgtgattaaagtcatttgccaaggatataaggactcctaacagtaaaaggaaaattccattctctggtcctttctcataactgagctgtatcttcgatgtgtagggggtgatagtgaaaaactagaggacatggtagaaaaaaaaatggagctctaacagtagtgagggtgggggagtcctttgtgtgctagcacaacaatcaagccacacacagagaccagcatctccgctggacattatgggtaaggcccaatctttcactgcccaatagagtatccactggccatagataactgttgaactttacattaattcaaattaaaaattcagtcccttaattgcactggccacggttcaggtgctaatggccacatttggtcactgcctaccgtgttggacacaacagacaataacatctaaagtcatcacatgaggatctccagacttccaacctctaataaattccagactaatgaagcttcctgacctgtagcttcaatggggagccattctcaaggcaaaggggaaagccttacaaggctattagagaaagagaatccacatggccctagagaagcagccaggaggcccaaccacagctttctaacaggaacattgagaacactcttgcaggaactggagagatgccagagattggagcatcttcttccaaaattgtcggcttcccccctcccccagcctgagggctcaccagggagttacaaggaggagagtgagttcctcctataaattaaaattcagtagaggtcagtcctagcactcggggcctgggaagtcaagagtgccaacatgattacataattgaactgtctcacctcgcccagtcaagctagattccaaggagggtaattaatcttcctgatgcctgttagtccctgccctgttcatgtttctgcccctgctcaaagtcaagtttcccaacctggaagggaagaaatgggggtgggggaggacaacctccatgcagagggggaactttaatctggttttgtgaaatccatgcacaaaactaggattaaggctgtaattgaatgtaaatgtgtatgcaaatatcagagaagcaaaagtatcttatctttcaaaaaaactctcagtcattgtgactctgcaagcccagagagaaaacaaacaacacttgaggcacagccaagtggacgggccatccttgtgtggcccacattagtcactagtcaagagcaaagccgagaaaggagacaggcatgcttatggctgcagtgttgaaataagctcattcactctacaaatattcatcaagcagttggcagcaggtactcactgtgctgagcctgggatctacccctgagcaaggaaagtggtggagtttcagtttctagtgtcaaaggatggatttgttcttagtgtgacataggggtccatttcaaagatgcaaaacattcacatattttcattctgtatcacctcctgcagagccacagttttactcctcagaaagtatatccacgaggatgcctcatcagaactataatcctagggaagggccaggaccctgtgttgtaagtctttgtggggcttcagtcagatccagctgacttgccaggttcgtgcctgagagggggaatatggattgagaaacagcaggtaaagatgctaaggaaaagacagagacacagaagagtcaggaaggcaatccagtgaatactggacaccccaagtttattcttcaacatccttaaataccccaaccaaaaaggcaaaaacttctttttcaagatacaaggaagaaacagactttcttccttaattctccaaacatttggtaacccatcttaagactaaatttctcttgtctgtccttgaagtttaagagtaaccacacctcaagcaagtctcttattatttagataagacatccaccaccaagatcaaacattctacagtagccatatcttagacctttaggtcttataactttaaccttggaagattaaagatagttttgaactctctgaccttaagccaagatgaagcgaagccatttttgtgggccccgacaaccatgaaaatcaggaacccagtttggcaccaagggtaactttccagccaagctcacctcacttccactgaacttcacaaactgaccaggcacaccaaggggcaacccacagaaggtctggctttaccttgaaggagagcaggtccttggcagtaatgcaagaacaatgagctgagaaaggcaaatcgaagaaaaaacagaaagtataaaatgtaatctcactacgtatccaccaccacccctaagcatgtatttatgaactgacgtgatatggcccagagagtcttaatactacaatattaaattccaaacacagaagacacaaaggcggcacattataacaaagagagcttgggttctgtgttgttggttttctggtgcttgctaatgttctggtttttagctttgctcacatagatgttatgttcctttaaagggctgccttcctgggagactgttttccaaccaaagtgcaatgctgccccctggtgtctgaatgccatgagcgcgcacgcagaaacctagcttccccaaagccgactccggttctacccagatttcattttgccatttttccatcttccaaagtgcaactatttcatctttaaagattcactgctcgggggtattttctggcttacacgctaatcaacacgctattttctcctataacaggaaccgtgctctggttacttaacgagggggagttgtgggtatgtggcagctttctcccctttttgctttataaattaagtgatctccccagagaagctcagaaatcaggcctattccatgtaacctttagaatcttcactgcgattctcgctggggagacgttctccgagagctcaagctccaggagatcaatgcctgggtctgacagacatcccactcctagccaaatgtatttgatttcagttcatccttcagttcttgtaccggggaataaactgaaaccaaaagctctgaaaatagcaatgcaggtgaaacacagagctggggaaagactccttcctgggttgcaaaaaagcaaaactccccacttagagaaaagcacgctgcatgaaaataccaagaaggactagtggaaggttcaggggcagctggcttcaccatccctctggatccagccaccaacgtgcccctccagccaacaacatgcccctgtgttaataacctgagaatctgtggaaatgcatgttgaagagggccatacagagctactgaatactgaactctgggcataggactaagaagcctgcccttaccaaggttctccatgacttactgcatacaaaactttgtaagccactgagcaatatttaataagattttaaatctccattaagaagttattgttgttagggattgtcgaatactgcaaagatacaaacaacacacacacacacacacacacacacacacacacacacgcctgccactgccttcctttgatttttctatcaaattaaaaagatattacctggcaacccgaggacacaaacactgataatcaccaaccaaagtcatgatcgacatttggtaattgctgatgataatttctaatggaatttgcaaaaccaatgataatccttttaaaagtccatcagtgaaaaacaaactaattcgttctggggaaacagtcaccggatctgaggatcaggaagcctggagatatttgcagagcatttttgccttgaaagaaagggacctaaccaaaaatcagcaagggaagagaaagaggaatgaggaggagggaaggtggtaaatggggaaaggggagagagaaggagtgaaaggagggaggggaaatttcgaactgactgatagtcaccttttgtagctctctgaacaacctgccagtcttagtactgcctcttgctcacctccctctcaggcagccattgtctgcctcttgctcacctccctctcaggcggccattgtttgcctctatcattcttctataaccacttgtcacccggtcctgctccaggccatggtgaaaacagagtatcttgccaagcccagctgcaatgccagcacagccggctgcccggtacacaggctagcatggttaagcggtgccaggcccaacaggttgtatttcactttccccctttaagtcctgactgagccacaggaggtgggaacacggaatggaaaaggttgtgttttgcctgaaggacattgcatgatgttaacagagggtctgttactcttctacctgtctgacctgccaacagtcactagggggatgtgcaaaaggaaaaaggaaggggcagattgaaaacctttcacactgtgcagagaggtggcaccccggcttctcggggctgggattcccggagaaactaacattcagaagaagcctccctctgagtctcccaccggagaaaatgctacagtggaaatcaaaacctgcccaactatcaagaaacacaaagaacagtgactgcgtgggggggggggaggtctggaagcatgatgacactagcagaagggctttttgttttagtttggggacaggtacaggagccatgtcaagtgcatttgttctggaagagaaatggaatattaccctaatcctaagaacctatgactaagttccccacacagcagaggagatgtttgcagatgtggttagttaaaagactggtgtggggagggtatcctggaggaacaaagaggtccgttaatcccagggtccttctaaagcaacagcaggagagtctgaacaggagatgtttcaggaagacatgggctggggtgaggcaatcgccagatttcctgacgggaggagaatgcccatccaagggatgtgggcctcttctaaagactgggaagacaacagagttgaccaacccctagagtgctcatagtcctctagagtgtctatctgtaaggtggacctatgacaggataaaacccactttaggtttctttaaggttttattttatcctcaaatatatatatatatatatatatatagaagagtcttgatttcctggagctggaatcacagactgttgtgaactgacatgtgggtgctaggaactgaacttgggtcttctgcaaaagcagtacatgctctttactgctgaaccatttctctagccctctgggacccattttggacctcagactcccagaaacacaaaatactaaatctgtgttcttctaaaccactaaattgggtgtaggggtagactctaacagtcaataggaaagtaacagtctccatgccctttctgaagagaactgttgagttgagttctgaagagagagttgttatttggtatttttcaagaactgacaatctacaagacactcaaagtcagtgaaattctggggtatgactaaaatcagacacagtttatagcactgagcattgagcactagaacaaatgactttgaatatatcctcctagaggaagtattattaagaattcatcacaaagtgttccagaatgaatgaactatacttgtggaagaagcctggcagtgattttaattgtttctaatgtctttgcatctcatgatttaacaaatcatggacaactgacatagaaacaatgaatatgagagatcattccattaaaatggactttgtgaccttcatatctaccagatggaccaagatattttgtatggtgtgtgtgtgtgtgtgtgtgtgtgtgtgtgtgtgtgtgtgtgtgtgtgtgtgtgtacatatgtacatatacatatgggaacatgtcacatcccaatcacagaagtccatggaaaatatgagggtatagaaaagccttcagagagcatgacttccctcccccaagagagtaagccaagcagactgtgacttgaacaggaaatcgtacccttgaactaacctctgagggctgtctcttcctgcctacctcagcaaagaggctggagtggaatagccctcaacagaagggacatggaagacctttctcttttataaccaagacaactggatactccgctcatgtttcagtccttattcagatatttataagtggaaagtaagctgggtgtggtagctccggcagttggtcccagcatttgagagacagaggcaggtggatctctgagttcaaggccagcctggtctgcagaatgagttccagcacagccactttctagcattagtcacttgcaacacagtttctcgatgagtctgggatagggtggcagccagcaagctcctggggaatcctcttgtctctgccagcccccagcattagcttccaagaatacttcatcttttatatggtgcaggggatttgaactcagttcctcatgcttgctcagtaagctttcttactcatgaggtatctcactccagtaagtgtttcttaaaaaataatctgattttgttcaaaccccatggaaacaaccaaagtcccagaggcttttctttcagtgtttaaggtgtccttcccagaagagttgaagtcttgcctttcccttccattttgttttcttgtgttttagattaactgtgtcttgggagctggccagggataataagagtgtgtggaagggagaaaaggtagaaaatgaagagacagggaaagaatcacccaggcaatcagaaaaacaaatcatccatctctctagctaaggttgaggataaacaaggagcccacacaacacagggcaggctggtgcagcaggaaccatggctctaagctgcagaaactgatggacctctaacttctccatagcagtaagtaccaaagatgaggctgtgtgcctctcctacaaataatagggaaaaattgctcgcaatcatctctaatgggttgtcagtttcatgacagtgggcttgacaattagtttgtcaatttctaactaaatgtaaaaataatgataatctcctcaggagcctttgcttggcctggcagcctttcacctgaggccaggaagtgaactccactggcttgtgcatatttctcatgcccgctattaggcctaaaattaatccactgcactcaggctctgaggaagattccacaggacagcttggctatcccctccttcctttcctggaccccctaatcgaaaccaaaagagacctttcactccaccccttacatatgccctaagtccaagatgagtcttttaaaacacttgacttctggcctgctgatagggaattaatttctagaagtagatgctgtgtctgccaaaaacacgtttgcatttcccttcccagtcttctaacaggcacagcccacagcctgctctgaggaggttacacaagcccccatgaggggaagttatggagagaaaaatgacaaggagaggatccaaacatcccctgaagtacaaggcctggtgcctcagacctgagcaggagatgagttttcctggctggccctggcccagatacttccagcaaatgccatcaatgctttgtgttcttcttccattcttgagagaaaatcatgccaaaccctattactgctgtgcctcagagcacttcagagaaaatactctgtgaattcaaacccaggcaccatgttattaagattttcactcaatggctgcattctttctttctaaggtttgaggtattctgccagcccctagccacctgctcacaatgatggacagaagcaaggaggatagacagggtgtccctgccaaggacacatggtgaaccagcaaacttcaaagcaaattcctcctcctgattcttgaatgtgaactccctgcattaaaaagattggaggcctatggctttctactcacagcctactcagtggtccttaggcaaagtgcccctggaatgagaaaaaccagaagagcttgcttcactctgggaccagagctatcacaataccataggtacgcaattctccgggacccttctctggcaattcagtgaaaaccatagaccctccttattcagattgcagccttcatgccttgtgacacataaactccattgtcattgcaagggaacaagtctatttcatcccagcatcaaccacagagctcaaccctacattccatccaactaattgcctaattaattaactgcaattgccatgatgacaatggtagtcagtgcagtgattccattttacagatgagaaacctaggcctccctgagaggggtaatggttttcccaggtgacgcagctatgtagctaggagttcaaacctcttggactctaataccctgaagtacccccgcttccacttcatccgatgaagttgtctaccctctccttgaggttgcctgtcatttcctttgccaccactgcccttttctgtgggccctcgggttgacttatacaatagctcatattcatagaagccatttgtttccttatacagaaagaaaatgaagctgaaaagaagaaaggagatagggagagaagggaacatggggaggaatttgtgaacagcacatcctcaagagagaaaaagcaaactaacggaatcaaaccagcaaggtccagagagagcatgcatttagcctctgcagaagagggagctggatgagctgcagagcccagactcagcctgcttggtcctgccacttgccaatgttgctgcagaccaccctatagggattctgctgtggatgctgagcagaagctggaagaaatgcctgactccaggagagctgcttccctgtgctgcaccaagcctgggggaagcagaccagtacattcccacctgttctatttgcagcatcccaaaccttcagtatttcccacctacaaggagctagagaaaggcagtgctgcaaagataaaaactttccagttcagaggtaagcagtgtgagcgagcgcatgtgtgtgtggtgtgtgtgtgtgtgtgtgtgtgtgtgtgtgtgtgtgtgtgtgagagagagagagagagagagagagagagagagagagagaggaagagggagagagagagactgtgtgtgactctgtatgtgtgactctgtatgtacgtgtgtgtgtgactctctgtgtgtgactctgtgtgtaactctgtgtgcgtggctctgtctgtgtgatactgtgtatctgactatatgtgtgactgtgtgtgtgactgtacgtctgactgtgcttctgactctgagtatgtttgactctgtatgtgtgtgtgaatctgtgtgtgtgtgtgtgtgtgtgtgtgtgtgtgtgtatacccacacatgtgcttgtgcacatggagaacagagaacagccttgggtttcaagagccttccaccaatcttaggttggtctcgctggcctggagcacactgattaagctaggctggctgacccaggagtcccaaggatgaatctgtctctgtcttcctggcactgaagttgagattacaccacacccagcttttatttttaattaatttttattttttacataggttctggggattgtacttgggtccaatgttacatatactatactacttgtggatagactttaccaactgagccatcttaccatccatcccatagcatgcctgaaatgttaagtgaaaagttttactctatagtctgctatatgttttcccgtaaggccctggtgaatgcctgatcatcagcacttaagcagggagcatctcacagggtcagacacagagaaaatcagttctccatcctctcgggctcctgtgtctccacagaacacaattacctcctcgaagatctttactacacccagcctggggtgccccagctagctcaagagaaaataggaccttttagaggcaaagagctctctgtctatccagactgtcactacagcaagggaagaatttgaaagtatgtatatacaccactgaagcaaatcaagaatggcttctgtgctgcacgtccttgtccctgctttaacaaaagtaggcccctcctttggcccacattatgcaggggggaaaaaaagaggtttatataaaggatcacctatttgccacttctttattctattacaggcaggagcagaggctgacacccacaaggaccctttccagtgagggattatatatcatgccatagaaatacataaaagacaaattatcctgagatcatcatgcttccattgacctgctcaaggtttaaagccagctgcaattagatgccatggtcgcagatctgcaggcggcttaaaacgccagtcacgtgctttaatcctacagaaacagacccgggtggattttatgggtacctaagtttggattctgtgggtctgatcctgattcgtaggaggttagtaatctgcttttgttaacgaggtcctcctcaacttctgagatatttataatatgatatctaattcaggcttaaaacactcatgaaaattaactgcattgctttttaaaaacacaaccagggagagagatggcaagggaaagcagcatgatgtgctaaaatcttatcactctcccacattcaccagagagttctcccagctgctgtggctgacaaatctcacagaagctaatgtgccattccttaagtcagacctgcctttctgacatgggggctaccgactattgtaacaggagaaattgaaaatctagccacatgggagcatatagatttcatttattttaacacttaaaaagcatgtaagacacctgttgtaaagatcttagggcatggtagaaatggctaccaagttagtgattgccacacccttttgtcttcaattataaccattcccttattaggtgtgtcctatgtacctagcatggttgtgagcactttacatagtaattcacaactaactgatgagctggtaggagaagaaagggaccccaagctatacagctaacactggttaactcacagattttgaacccctcacccattatccatctgatatgctacttgcttcacactgatacttctaagagagacagagacccattagatcatgacaaccatgttccctaaacattaactatgctttaaatatcttaatttatgagtttaataaaaaagccagctaggtgcattccgggactatgatgtaaaagatggatctgtccaaacattcgagaaatatggctgcagagttctaaaatgaaagaattgcctgttcagagcacaaggatgtaagtgtgttcctccaccaagacaggtcagcatcctgtcttcaaagaacaccagtcctttgggccaaagatctaatttcttcacagtttcagagtgaacccaactccatctcagagacaggagagaaacaaacagcagtggacaaacccacaatcccatggcattcctctcccatgaaaattaggtctgccaaatggtccatagcagaacactgtccgcctcagtatctcccaaggctgattttctctgaggtcagcatggtacctgaagggcaatgttgaacgtgaaatcagaatgtgagatgtgggttaatgctcctgggggcagctcatccacaaatctacttccacaagaatgtcttgtgactcagacctgactgaatccaattgtctggggcttcctctcctttaaactatgttctgaaagggcaggtttctgagacccctcattgtctatgcctttgtctgagccacacttgttttttttttcttttatcctttattttattaggaattttccaacaaaaaatggcaagttgaccaagttgacacctagtaaatatttctgctgcaggtaatttcctataggtgtctgcgcacgcctttaatcccagcactcgggaggcagacgcaggcagatctctgtgagttcgagaccagcctggtctacaagagctagttccaggacagcctccaaaaccacagagaaaccctgtctcgaaaaacaaaaaacaaaaaacaaaaaacaaaaaaaaaaacaaaaggcttgcaagttaattgtagcatctctgtctttaaataccttttgtaggcaaataactattccccctctagtttccaaacgcattattttcaccaacaaatttggatcaggaattgttgtggcacagctagtttgagtaccaggtatcaacatgaaacttaagtacagtcattcttggtgcatttggctggttcccagccattcagttctagtacatagaggcacacattattttttttctcccacatctgcagagatccttttagaatcaatgagaattacaggctgttagcacagtggagaagtctcgtaagactttattgtgtcctttgattttttttttgggggggggtgatatacaaagagtgttctagaactgactgcaataacttttcacagttgtaaaggacttcagtcacctagctgaacactcctcactcccaatttacacacagaggcttcaagactctacattattagaataagaatagttaatggtagagtggtggaaagatagtttagataacacagtacaagcaataaggcccgagttcaatctccagaacttgtgacaaaagctggataggatggtgaatgcttttaatcccagttctgggaaggcagagatggtgagccacacttcttctcattgaaaaatccttgtcttgctttcttggatatcaccgtgttgttattgattgatagctctctgggctttggtgaaaggggggctaaactttaagacacccccagtggggttccaatggaagcaaactttgagatagatatctattaaggaatgagtttatgactgccaacaaagacagggggaaaggaataggggaagcaaggcagtaccaaccaagcccaagccagcccaccaaggattcaggaactggatgttatgctgtccagtgttgtcccgagatggtgtgaagtattgggtctttgtgcatatccaatgaggagtcattggatggtctccctgaaaagtgggcaaggctgcttgctcttcaggtgacgcaattcagaagttctctgggtagccagagaagtccttccctcccgaagggtaagtggacaatcttccaaagcctctacaacaaagaatagccctgtcctcttgaagcaaactttacctaatcccatccacattgcaaaccagagaaagactgagcatggggagagtgaggcaggctaaatctgctcttctacagccaaggatacaccaggactacaagccatttccaaagctaggctcctaatacacccaaaactttgctgaccttcccccatcactgaaaaacctttccaaccctgatgttccttcctctgccataaacaatccaccatcctctcctccagacctaagctcagatggatctgccaagggatctcactgctctctgcccttctccatggttctcccagagatcagcactgagactgaggaatggctggtatttggtaaacaaacagataaataagtaacagatgaattcttgtacctcagggcaacaccaaaacaatgagaagaggctcaggcagacctccagttctgagatggctccaagaatgatccatccactacagataaactatgtccagctggtttaggtaccccagcaagatgtccctccaacatgtgcccctagcacagcactaagttaatagccttatatatacctattggtttgcttttgtttttttgtttgtattttcaaattatacttaattacatgtgacatcagaagccatttctgtctgattcattgttttatctcccagcacctggcccagggctggcacatagtattcaagaaaatatgtgctcaataaataaaacagaaagtacagcatttagttagaaagttctgtgaactgctttcaaatttacactggcataaaatgaaacatatgagaggtttaatagcctccaacagagctgcaaacaaaagggcgggaatcggaatatctgagaggagtataggagccctagagataatgctttagtgacagaagagtcatctcttccattaaaagagttaggaggtgattgacacattgcaggatagccatcattgattatagtcatagctactacactaaaccaaggacataccaagtccaacaggggctaagcatgttaaatatacaatatcattaaaccttcatagatgactggaatgtaggaattcttatgcccacttttcagataatgacatcaaggctcaacgaaattcagatacctattccagcttaaaacttactagttagacacagaacaaaagtctaaacccaactttgtctgactacaacacctgtgctcaaactaaactccgtggtgaacatcctctcaccaaacaatcgggatcctagtcacagagtattcagtgcaatatgtgggcacaaattgtgaagttgatattatgatagccaggcttttaaatagcttaccacttacccagcttgcacacatcacacccacagaaaaagagagtggagttaattataagatctcactggttgaaggaagcattcatttgcaaatctcaactgccatgtttttagaattggcacccctatgtctctgttgttgtgaaaaacattgactaaagccaacctgaggaggaagggacttatctggcttacacttccacatcacagcccacaaacagggaagtcagggcaggaactcaaaacaggaacctgttggcaggatctgaaacagagaccatgaaggaatgttgcttactggcttgttcatgacttgctcagcctgctttcttattcaacccagaactacctgcccaagggtagtgagactcatggtgggctgtgccttcccatagcaatcatcaatcaagaaaatgccccacagacttacccacaggcaaatctgacaaagacaagtcctcagtcacagctttctcttcccaaatgactctagtttgtgtcaagttaataaaaactaaccctcacaccctacaagattcggatattggaatttgccatttggggcaatagtagtacaaggtgggcctttgggaggtgactagttcgtgaatgagaatagaccccttgtgaaaacatcccaaaagaacttccttgtcccttttgccacatgagaatacaaagaaggatcaaccataaggaaagtccctttgcagacaccaaatatgccaactcctcgaccttgggtctcagagctccagagccataaaaggcaaattcctcttgattataaattacatggtctaaggcactcagtgatagttaccaaaataagctaacacactgactatagtctggtcactaaagccacaggaaatggaccctcctttcacatctgtctagtcaagacccatcagccatatgctgtgctttgcaaagcctacagagggcctgcaggtttcccatacgcacccggggcaatctattcacatggaaagcacaaatttaaagtgtacagctagaactgagctagacagagcatttgcctagcatgcagaagaccctgggttctgtctccagaccctgaagagaaattaaacataaaatgcatatccactcaatctacaaaacagaaagagaaaaaagaatgttcggcaatgcctctggtgatggtgctggttcaaacgaccaccagggtcaaggctacttctcattctggtttgtcacacctgaaaggaaaaggcaggtagggtgaggagatctaaagaattaatgtattaaaacattttttcttatttaattcctgtgtttccatggtaactgagccatcaaccaacaaatgtgcccgtctctccagcaaattaaaaaaaaaaaaatgttttcttcaaaggagaaaatgttagggacacatttatctaccttgatgagtaatatgtctggggagcttccaaaaacaagaagccataccttttcaatcctcccatcttcctcattcttcaacgacacatacaggaattaagtactacataaggacagaaaagctacagtatacctaggagatggctttggggcagcccttttactgaacccaaagaaattctaaagttgggatttgtttttttctctctgaacttcccagtacatggcttccaaattttcttaattatatctactgggtcaattttataatcctattactcctgtttggcctctaccaaatactgtaaatagccatgacccaaacctcaccccattctccctgctacagccctatccatcacgtgtttgtgtttccctgaggaaatggagcttctagggagtggggggcttctggagtaccctcttgctcatctgagctcagcatcctaacagtttatgtagcattatatttagtcactggttccctgtcctgctttctccttgcaactcatttcttagccctgaattccacaaaactgagtgcagccagcttgcttgatcacatgtcatggctatcctggactgtgcctaactggtgacagtcctaaggaaagttacaacaccttcagaataacagtaattgggattctccttcaaaataatattctacatacactctgtcttttagtttgttacttcccatttaaaagggaaaaggtaaacaggtagacagaaggaaggaaccacgcacagcagacacagccatggtaaaaaataaactcagccttgaagctgccagtggcaacagagaccaggcctcttgaatgcaactcctcttggggtatgttctggagttgcttccatttgaagtcccctcactagttcatccaagctgccttgtaacaaaaatgggtttctgaaggagatgggacaataggacagattcccaccataactgcaaggcccatctgtgcataagacagtttgggtaccagtaattacaaccaccttccaggaaccttgtttcctaatgtcattgtcacctctgggacctaaggaaaaaaatatccaaagcatggccctcagtgggccacaggatatagtaagtgtggggtggactgtgtggctgtgcctgtgacttttttgagagttccaccagtatttctgctgggcaagcagatctgagactcccaacctctggcagtctagtaattccaagagcacatgggaggtgccagtccccattcatcctgtacttcagctagtccaagcccatgagtggcacgagcaacagcagtgagctaactcattcttgtaccatttttctcttcctgctgtacaaactgccatgaactgaacagctaaaagacagctccagttcatgaccttgtgtttatgggggtcagaagcctgaaatcctttttgagagctaaaaccaagatggtggcagggctgtgtcccttttcaggggactaaaaggatcaccataatccatgcccttgtctttctagcttcggtttctagaagccaacatggtctgaagtaccagccagcaatgacatcatcattgatcctcagttctccagatcctggctctcctgcctccctcttccattcattagattcattgtaattacactgtgttgggctcaccaggataatcggagataatctctcccatctgaagatcttgaatgtaatcgcatctgcaaagccccttttgccacacaggattatatattcaccagctctctagattagatgtggatatatcggggaatggggtacattattttgctcatctgactcatcttctaggaatgttggaggatccagtcagagaatacttgtctgccaaaggactttctcattactggggcctcaaacacatctttggcttcagttgccttgctctttctgcttgcttcttatttccactctgtgtttcctggctaatggtctgctcccatttcatctctccttgtcttcacagaaacacagttctggatgagactcagtgttcacttctgaaggagatgagtctctctgtgcttggcaagcacaaaagaaaaataattccagagcatgagtttacaaactttttgtgaaacaagcttgggaaactctgccaccaaatattgtcaatcagcattcctggcacgtctgctcattagatgctatgcaagtcaagccggtctttattgttgttgaaacagcaaatctgcacgttctgtgtggttccaaatatttgtaatagtgctgctactaaatatataagtgtggcgtcggcctcagattgcaatcctctctaatagtgacagggggaatcaaacccagccatatctctctagggagttttgctcatgataatagagagctctagagggtaggtgggaggaacaattgtgcaactgaggggataggatgaaggaaaaacagctggaaatacactgtggatgttgcagaaaataagaaagtttcttggaaattaaattcaaggaagatgaaattgaaagcatgaagagataaaaatgctcaccgattttgaaaaagcatgcttaagaaaaggtaaaatgtgtggcacattcttcttctgatgcctcttcgtcgttcctgttcagtgttggccaggtcgtctttgtttttctaacgcagcattgatcttttctattggtttgtacatctttgtgtattagggctgttaatttgccccctccaaaaaaaataaaaaataaaatacatgttacaaggagatttctcatttcttaaccttactgcagataaacttatttttttccgagtagaagatttaaatttgagtttaatcatccctatcaactttttctttatgttttgtgaatttattcttaagatcctgccaggataattaaaattccacccactagtaattaaaaatgcaaataaaagggagatttaattttgcacctatcagatccactcagtcatttcttcaacaaacattcatcaaatgccctttacatggcaagcatgggaagaaaaggcagaaaaatacaacaaaagctctgctggggggcagggggtacatttctgcttatcgggtcaagagaagcacaaacacgatgaataagtaaagtgaataatatattaaataataagcactacagaataaaagaaagctgggaagggggacagcgagtgtggtaggggacagctggccacttaaactgcatgacaggggaacagtactgcagggaactatgttggcacctgggtaaaaaagagagcacttagcatgtcccatgtggctagttacaaagggaagagcacaaataggggagagcagcaggcagggaagcttggggcctgtcaccaggggccttgtggtctgctgtaagaatacaggctttttctctaagtaaaataacacctacatgttaaaggcttaggtcccaaggtagtggaacctttaagagctgggacctagcaggaggtgtttaggtaatctctctgtcattctctctgtctctctgtctctgtctctttgtctctgtctctctcctcttcccctgacctctttctcccctcctccaaccctctatcggtccttccttccatctcccttgctctctgtccttccttcttcaccagtctttctctgcccctttctctcttcctggaaatgaggacaagagttttgttcttcccacatagtctgtgccctgctgcctcactacaagctccatggcaacagagccaactgaccatgcactggaacctccaacactagtgtgaccttttatttttaaggttgattgtcttgggtagatcttgttatgtaacaggaagctgactggcacagatagtttgggagggtattttggcatagaatgatgttattttacaaactactattttctgttttccctgttgaaatgggcatcaaaacataggacagacagcctgttgtgtgagagatggtggcttgagccatgaagtggctaagcgttgggtgtgacagccgagggagttaagccgagggagttaagcttgaagtcagtgttgaggccttcaccataggcacacagaaggatgaagcagccattaactgtgaagagcaacctacaagtggatcaggggggtgagagaaaggaagactgaggactttagtgtaaggcatgttagctttagaatgttccctaaagatccaagccaaggtgtcaggtagacaggtagacctgcagagccaagtcccccagctgtctttcatctatgagctggaggcatacttctgggagagagcacaagggtttatggaggtcatgaaactgggtggggttgcttagagacaaggattaagaacactggcaatgccaaatattagcaggagtacatggaaatccatgtgttcacatgcttctatctaaatcaggataataaaccttatggtatcaagtataaagatataagcctctgagccaatgattccatttctaggaatttgttttaataaagggactcaatagttcagtaagaatagctgatcattgtagtgaaaagctacatgtgaactgaatatagaccagaatatacaatgacaggtatagagttattttttacatggccattaaatttgcagtataaagatttttattcacatgaactgtggaatctataatctacccaacagttcagtaaatacagcataatattttgttgctgtccttaagtttaggctgtgccctaggaggggacaattgtactaatgatgagcccactccctggggtggtcagctagcactttattacaaaggctgtactccagaggcgattactaaaagccgttctgtaattcacatctctaatcaacaagaaaggttctcctaattagcatactgaatttcagaaatgggttttcataggggaaactaatggggtgctaatgagcataatggatattcaaaatgggcaattgttagtgaagtttatggattttgagaacagagaagccactaaaatgttttagggacacttgctcctcccgaatgatcccagcagaaagcatttagagagagccaaggcctgtgatgtgaggtttattccaagaacctccatccctaccaacacagactgaatccagttatctgtttcttgttgtaaaagtaagggaatactttttgagctataggatttgcctacagagcaaggactgaaactcatctaggagaaaacataacatgactttgctcaacatataaacgggtaaaacagagtgtttcactagtgagtggtcatctactgagggtgtgcacaggtgggagaacagctcggggatccattctcattgtacctgagatcaagataattccacactttggctaacattcaaatctctctctgctgccacaatgttaaatctcaattgtcaactggtaaggtgaccctctgtgcatgctggtggggattaacttgctaagattcactggagtggaaagacctatgtaccataggtggcaccatgaccctagactgtagggaaaggggaaagtgagctgagcaccagcattcatcgctctcttcctcctgactaggcatgcaatgtgaaccatctgctacagtctctccactgtaatggactgaactgtgagccaagtgagccccttctcccttaggtggtttgtgtcagggtgttttatggaaacttcaggaaaagtgactaaaacacatggctatacttttaactccagaaaaaccccaagtattgtaggattcaggcaaatactgcacagggacatatcagaagtagaagtgagacaaggccatcttccccaagtatgctggggatgagggcaccacaatgggggaagaaatagctgataattgggtatgttcttataatgagaaaaagaaaacataaagcttaaaaaaaactgtcctttaaaaattaaaagtaaatctaggcagtggtagtgcatgcctttaatcccagcacttgagaggttgaggcaggcagatctccatgagttcaaggccaacaagttctaggacagccagagctgttacacaaagaaagcttgtctcaaaaaaaaaaacaaaaaaaaaaacaaaaaaaaaaacaaataaataaataaataaaagtgcaaataggaagtagagggaacaaaaatgtggagagacggtgtgttgaggaaggaaatacctacagagttctactacccagacaatcaaaatctgatattccatctccattcctgtttctactcttttattttgacgttttattttctaatcagatttgagacttaaatacctagaacattactttctttccaccctctgaggatcaggcatcgtatccctgaaactgaacatgtgcacacacacaaacttggaaatatctacattatgttgttctcttctttccccccgaggcagacagcactatcaaatttatttcccatctttgttttgagtgcttagatgttattttggattgttcaagtgttttatgatcccggaatctgcctttcccttcgctttttgtcccttccctgcatgaataaagcaggctctgactgatttccctagacacctccttcggttcctatctgatgttcttgcctgccttttccagctctccctctctcttcttatcccttttctctggcaatctaggctctgagagaatcatagaatgttaaggaacagcctaaagagaagataaatgtcccaagaaaatttcatggcctaattagtacaccccgaaattaaaaacacagcaagtttttataagcccacattcaccctcaatgaggactgaaagaaaataataattaaaacaaggctttccagaagcaccatccccctggctttaaatgggctaaataaggcaggaagactaaaacccaaatgcagggatgcaccagaccccaagatgagaatgtaaccaaatgccacttcctcacacagctcatacaaaaagacttgattttcagctcaccaattcctgtttggaagagtgtgtattgccacacagattattccattttcaaaaatctccactgccctacaaaacagcagaagggaaattgctggcagggggtgggctgtaagaccccagatgcctgacccttttagctgctttaagtggcttgcctgtttcctttctgcatcttcttgcccctcccactgttgtgactgttgtctctgctttgcaaggacatgtcactttaagtacccacttgctccccccttcttaattggcctgcagtaaaaatacaaattgcaccactgtacttttattattagccatttgatgggccaaaaaatgcctcctaactactgcctagagggtattaatcagacctgctgactcctaagcacccactttataccttgactccgagatgaggccagtaggtagtaatcatggccccttcccaagggatcatttagctggtcactgcctctccatcaagaaaggcacagcctaaaggtgtggtggctgacctgcatgatctaagtacacagccccaactcctccgttgcccattagctttaatgccagttgttctttatggacatggaaagtctgcctccttctctaggtactagggcaccgagtgaatgtcttgcatcttaaagcaccagctaagcttcataatcttctctgccagctcacggcttggcaagtacagcctccttccttgaagcaaacccccctggggaaactggcagcagagaagagggtgggggaatgaggttgactgagttagggcagaggcctcaggggtactgtctgccctgctgtttccaacccctgaatcccactgtacatttcagccctcactcagatcctatactgaagctctgctggtgttgaaaaggtgatgggggaagtggaagatttctgcttcacaaagcttgattcctcttattaaactcaccacaaactgtctgcggtcagctatctcacgaatccacatcatcgccatgtgtgttctgaaacactggaatggaggacacaggcacaaactgtttcaatggaataagaagcaatgaaatattcaaataaagtcacaaagtcaccatggtccaatctctgccttcattactcattcagtaagttctttatacacagtggccatcctggataccagacactgcctcatttctcgctgaccttactagggcatgccacagataggcttggaatataccacagaactttcgttttcgtactcaattaccaagtcagagcaactcctatgattctgtctcaaggtctgttctctcctcagatattcttacctctagtttctgtttatatatgttcatgatttctgacccttaggagaccacaccaagttttaaaagggcatttcagctccaaagagagacttcagctatcatatatgcaatgagtaatcatccacttagaagaacttccagaatgatctttgttttcaggtgttacagtggttttcattgccatcaacgaagagtagaaatccctgagcaatgccttgttctcctacattccaggtccttgcagatcagtccacatatgttcaacacactggagattacatgctatgttcctaaggcggtggttcttaacctatgggttgtgacccctttggtggggtcacatagcagctatcctgtatatcagatattgacattatgattcataacataatgaaatagtagcaaaataccagttaggaggtagcaactaaataattttacggttgggtcagcacaacatgagggattgtattaaagggtcgcagtatcagaaaggttgagaaccactgctctaaagaaaattacatctcaataagcccatagaacagaggccctaacaaaacgcatgaaacagcgatgaaaattacaaaaggaatgaggaacagtgagcaagaaagaacaaagctgcttcttaacaatagcataaagaaaatgacatcagctgctgcctagcatgtgggaggtcctgggttttgtcacgggggaggggggagaaaatttgagaggaagagaaatggaagaagggaagaagtggggggaggagaaaccagagaagtaaaagcaagagtcaggaagcattcccatgggaaagaagagaggaaaaaaaaaaaataaggaatagactcttactaaatgtggtggtttgaatgagaatggccctcataggctcaaagatttgaatacttggagggagagggactatttgattaggaggtgtggccttcttggacaaaatgtgtcactgaggggttgggctttgaagttttaaaaagcccattccaagctgagagcctctttctgcctgctgcctgcagatctggatgtagacctctcagctactgctccagcaccacatcggcctgcatgccaccatgctccccaccacaatcataatggactaagccagtcctaaataaatgcattactttgtaaaagttgctgtggtcatggtgtctcttcacagcaataaaacagtgactaagaccaaaagcaagggagatcccactggacccaggtaagttagtgactaacagcatgtattagacagtttaccacttacaaaaccactctagagtaggcacagtaggcatctgttcccttataattaccctacatctcacacagacctggatagatggacagttagctaggtggctaggtaaaataactaaggacctttggggtacactctctaggacatcctcatactcatagggatggcatcaagggaaaggaagctctaccaggaaatcagtaaagacaaaagacagaatgagagcaggacgtggaccttcctggatgctatcctgggaggtctcccctgtgacttcagtgaaggccaccgctcctctcacaggggcaaaccccgtggaatgattccttcttacaatctaggtaacaaaatgcagcttgtacactacgctcttccagtcctgtggtggtggtgactggaaattgcaaccgcaagctcctgagtcatgactcctgcctgtcctgtcccacaccttcacactgagtcctcctagacttcccttacatcatccccactgagtgttccattagtttctcgtgaggatcctgacttacacagacaagcgtttggggtttgtgaagagaagcgaatatttggattcatgaaattgtttgttctaccattttcaattcatgtttgcaaacctttagcacaggaagaaaacagaagcagcctattgcattcattccccaacatctagggcagaaatagatccataaagattgtgttctactatttgtaatagccagaaactagaagcagcctagatgcccctccactgaaaaatagatagagaaaatgtggtacatttacacaatggagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaaaggattaccagcctacaatccgcactaccagagaagctaataaacaaggaggaccctaagagagacatacatggtcccctggagaaggggaaaggttcaagattccctgagcaaattgggagctcgggaagaggggggagggagctaggagaatgagaaggggagaagagcgtgtgcaggacacaagggagcagaaaggttgagtcaggagaagaatggaagataacaagaatggagaaaccataatagagggatacattttagatttacagagaaatcaggcactagggaaatgtctggagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagcagacacccacaactaatcactgaactaaactggaatccagatgcagagaaggatgagtgaagagcaaaggggtccagaccaggctggtgaaacccacagaaacagctgacctgaacagtggtaagctcttgctccccagactgatagctggtatacctatagcatgggactgatccagaccccaagaacatgggtttcagtgagggaacctcggaaatctacgggacctcctgtagtagttcagtacttatccctagcataggtgtggactttgggagctcattccatatagaggaatactccctgagccaagacacatgggggtgggcctaggccctatcccaaaggatatgatagactctgatgacaccttatggaaggcctcaccatccagagtgagcagaaaggatatgtgataggtagagttttagttgttgggggtgggggtggtaggggaggacaggggggagaagggaactgggattgtcatgtaaaacaatcttgtttctaattcaaataaaaaaatctgaaaaaaacaaataaataaataaataaaaacaaaaaataaaaaaagattatgttctagaaacttccatttaaaacaataaaacaggcaggggttcaaaaaaaagttatgctagcagatctaacagctcctcatccatgctaagcaagcaatcgcactatattcacagcttgcttcactattttaaggctgaagacccatcttggtctataacctgtttgtgtacaaacacaagtgtccttggccctcctacaactgtgatcttcagctagtccaaatgtaggtcagagtccaatttctggattaacaacacatccaaagtcgaacatgaattcagaacaaattatccaagtaaaatgcttctccccaaagtccacgtgtattaattacttttgctttcagggactggaagagaggccagtgtagggaatgaacggtttatttggattcaccgtttccagggatttcagtccattatgtggggaaggcttgtggtggaagcaactctgcccatggtggtgggagtgtgatctgcatttgttcatgtgcctcaccaggagcaccgtaactgtcaaaggcctgtccctggtaacctgccctcaccagccaggcccccacatcctaaggctccaacccccaaactggcatcacaagctggggaatggatattcaagtcatgggccttcaagtgcatttcagattcaagccgtgacccccttgtcaaccttcctttaatacagttcctcaagttgtggtgatccccaaccataaaactaactttgatggtatttcttaactgtagttttgctactgttatgaatcataaggtaaatatttttggagacagatgtttgtcaaaggtgtcatgatccaggttgaaagccactgccctagacaaataagacactgtttgctccacccatttcgaatgatcaatgttgttcagacctcagaggagagatgtcaactttctattcacaagaagtttctcttataaggcaagtatcccagcgtgggcattcccacaccatgtcacctgacctctgtgaactcccaaacaaagaatggtcagacccaatcataaaaggaattcagccagccagattcagccatcctcgtaacccaccccaactcttagaggtgtaactttggaggaagttcacaccagctacttgacatgtctttttatattgtctgttacaggaaatttttttcttgacctgattttgtaatcactttgcttagcaagcaccatatttggaagtcttgggctttctattccacggaagctcctgaaaatagagatattcttcttagtcacatacagcaaatgtctcgtttctacctctaaatagtctaggttaattgcttcacttaataactcgcagcagtgaatcctacagcctaatttaatatcactctaggaaaaaaggaatccctttctgtaaaattgggcttccaggttagaccagaggagaaaggcaatacgtgttaacatttgcctattccccagatagatgtggtcttggctaatggtctccacagtgaaagaagggcacatctcactctcccattcaggaaaccaactcaacatgtgtgtgtcaccgggaggaagtcagctctgtaaggcgaagtgagagaagcttgtatctctgtatataaatcacgtctctttgcagtgacaagtcgtgtccaggcaaagcttattacaaattcagtttgaaatctcaagaaggaataggagagaaataacaacagctttatggagccatcctcaggaaatgacttgaactcatcccaattttaaagttccctctatacaacaagcagctaaaaccccattttgtgggggaactgcccgtacagggaaggtgtggcgaagccatctgctgctttaaactgatagtttccagccttgttttcctggtccagctatgaaattgcactaaccacagagacaggctgcttggccaggaagctgtgtgtgccagatacaagtgaatttaagcccgcatgtattgaagctgcaagcttactttgcaatttatgtgcaagtggtttttggatttattgatctggaccgagtgcaagtcctataggggaagtatgacagatttcatctgtctgacagccaagtctaattgtgttttcagtctgaaatgaccaaagacaaaagtgcacatgtctcaggtcttcactctggtgccatatggagtattagatacagggctgtggtcactgtaagtgttcgttttaataactagacacacactgaatcctgagcagggcacgcaggagaggtgagtttttaatgcaaatgtgaattaataggccatctgatcctgcctgaatgtgggtgggccattttaaagagtgtctttttatagacatgattgggggaatttaaaagatgtgtcatatattactgattcatctgcaccgtgaaacatccaagccaaaagtcaagtacttcccacaatggctgtcactaaaattatatccaatacttctgggaaagctagcatgataaaaaaaaatcaaagagcatcttctagaatcttactacctagttttgaagattaacagtgcccaagagaatatgagctataatttctccctgcagccatctctctctgtctctgggtatctatgtctccctctgtctccatctcactcatcctcatgcacacacataacgcatgtgtgcacataacatgagtaaactcaccaacacacacactgttttatagaggccattatctgactatagacagtggacattaatgcatatgttgggagaatgtcatctcatgtcaacatgagctgggttctccagagggtcaggcaagactgagtgtggatttaccagtcttttccagatgatttcagactctttcccttccctttagtgacaccacaacaccccacaagccctccttcctctctaccccctctcctggcttcttccccctaagtgtgcacgtgatgtaaaggagtgtgaacaccttagataacttctctaatcctatatttgtcatcttttaaaatggtactatcatagtagacagaaaatatggaggtttgctaagaaaattcaaatcattaatattaaaaacaaagtgtgctctgatgcctgtcacctgccttttttagactacgtcaacaaatcttacctgttcattgttacggcatctcccagagtcacatctgtgatgccaactccttttctactgttcattctattaacccagttatcacctgccaatctattattgttccatattcttccaagtcccaggacctggatttgctagttatgctccaagttcagcttattggttacttttctattgctgcaataaaacaccacagccagaagctacttacaaaaggaagattttatttgagggtacagttccagaaaataagagtccatcatggtgagcaggcagggcagcaaacgtcaagcatgacaacggcaggagcggaaattgagccctcatgtctcaaccacaagcactaaacaaggaaagagaattgaaagtagctaaggcttttaatcatcaaagccctgctgtgatgtacttcctccttcgaggctacaccacctcaccctccacaaacagcatccccaactggcaagcaagtatccaaatgctcaaggctatgggacatctcttactcaaacctcaacattcagtaccaatataacacttcactgtatcagcctgtccactctgccaggcagcctcttcctatctttctcttctactgagctgcgtcaccaccatcactacagccagttaggtgggacagccacatacttgcactactttcctttatcatccccaaggacactttaagttgatcttgtgtcttgttcctataggacaaatcaccacaaatttagtatcttcatataacccgaatgccttgtcttattgtgttgcaggtcagaagctggaaatgagtttcacagagctcatttgaaggagttggcaaggttatatcttctagaggagttttgtttccttggttttcagtcgcagcctctggggtctactgcattctccacctatggcctcctttctctatcctcagagcccgcagagccctccagctacctccagcttctctcccacttagtagcattcctgtaataatatgcacccagcagatgctacagaaaatctctctgtctagactcttagccttaatcactctgttctcaaaggagtctatggaataggatattaaaatctggggagaagtaggaatgaaaacattattttactttctacatcttccttgccaacctttttttttataatactgccccttatttttctatgcataccagccccactaatgcctacataaatcctcaaataaaccagttatttttgtcatacaacctttgttatcctggtccttcttcagttcatgcactcctaactatcatcaaggcaggccaagagctccagtcaaacatgaatactcatagcatcatatatttgctgtaagcccatgtcatggttttctattatatttgcatgattatttggttagtgtctgcctattcacccagactgagaaaacatagaaagaacattcctgatttttcccaacttcattctagaccataaagcacaaagttaacatttgatgattattttctcagtgatgaaatcagtcctgttgaccctgaactatggggggtaaacatggtaacatgtatagttactctacacaacacacacacacacacacacacacacacacacacacacacacaatttattagaatttacaatgagccataagttgtcttacttcatctgatcctattcacatattctatagagtaggaattcaatggccaactagtaatagaaagcacaaagctagtcaggaccttctttggtgcaccagaacatggacaaggaaaggctaaaggaaaaactcagaagaaaaaaacttaatgcagagtggagacattgccagattccatccacttaataaaaatgtagcacctgggtttattcatcccccaccagcccttcaacaaatttaagtgaagctaaccatccaatcaggttaatgccaacacttggaagtgaggaagtcaattctccttacaaggctgtggtacaatcagaacaaaaccaaaaagcagcagcagcagcagctggagagctgccagtcccccaagaaaagccaagagacttggctgagttcagcatatgcagcaatagaagtcggaggccaagagaacacgatcaagtctccacagagatgacccagcttcatctagaagaatcttctgagaaagcaaatagtgaagggatagaagaaccccagaagtatgttaaactgcagtggaagaaacacaggacaaatccagaagtccttgcagtttcaggaggacttagggtgagaatgtctgtgcatacccaatccccagccagaaaaggaaattaattccactcatcctgcagttacccatattgggatccctggaggttgtgggttctatccaagaaagaattcaatggtagacgggagaaattttggtgagaacaagcttattggaccaaagttttaaagtatactctgaaggcacaaagagaacatgaactagaggaaaaacaaaaacaaacaaacaaaaaatcctgcttttgtggcagagtgaggtgtattaggattggatctgtgtaccataagtctttcccattctggaggcaggggagtctttttgatgctggatagtcaaaccagccctgtcttggtgtgtggataatgaagactttgctcagtcttgatgctaaccacctgttaatcagcccaaaggtgtttaaccatcactatgggtgtaatcctactgctgggactttccattctgtgagggtcatatgccaacaggatgcagctgtaagccattagtgtctctgtggacacttgtatgactggaccaggatgtggtgtagcaacagaatccaagtgattgttttccctcagttgtttcctaacacccacattaatacaagacatcaccacgatgcaggtcaacccagctacccaatcacgtcttaacaaacagggaagccctacacaagcactagagaatttgtctagcatgtgagaattcccagattcatctctgaatagggtaaatctctgtagagaaaagtgtggtacttttttaaaggggcctaaacatttactccaggaatttgtctactttagagaaacaaccatggaagagatcaaataaagattgaaatttgaaggatgtatataatgtgtgtttggtctttcctctttaagcctttgaatacactgagttttgggagtgcctttgaatcgtgagcctgtttatgctaatgaacagacaggataggtagagagcctagagggattcagggtgggggttgaagaccagaagtatctaatattcctttcaccattagccccaccacatacctccagagatgagaaagaagttggatatttaattatgaaaactcttcaataacacaggccttgctttcctcctgtctctgaaatggtggaaatgtgtgcaactcacccctaatcctgtgggtgggagttaacttcagggttagaacaaattcaattatttgatgcccattggtgtcagagatctggagaattgcttagtgtcagaaaagacattgtatatttggtgtcagagagaatcagacagatgaggataaaatcggagatggaaggcaattgcattttttgatggggagaactagggtcattcaagaaaccggaaatgctactttcacacagggaaccctgcaggtgaaactggccagataggtcccaattgtcagcctgggatttggatacttctttatactttgagtttaaattaagatggtgccagcttttttcaacatttgagcttctcttatcacaaaggaaacttctagcaaagacagcaatagcaaatttataaaatgtatgtacatatcaagaaagaaagcaattatcttttgtttgcttcagattttcatttgttttattttctggagttgttttagacttgagacaggatctcacaacacagtccaggagttttgatcctccagcctcagcctcccaagtgtagaatcagcattctactaccacacagctgtaactttttgttgttcataaacacacatatgaacattggtaattagcatggatgtatacaatacttatgacatttacatacaacttcattggcttttcaccacatagccaatgtttgtctttagagctttcatgctaaagatcttaatcgtgacctcaataattttaaactaaagtgttaactccaggacactttcatgagcaccttatgttagcttttcttagcggagctgttggctgctatatgccgtgacattaataactttctcttccttctttctgtgtctgttgagacagggtctcaatatgtagtccttgatggcctggaacctgctatgaacttgtagcaatcctcctgtctcagccacaacattaacaattttgaaagaaatgaattgagattaggatccttcctacatgaaaaattactgtcaactcaactgaaacaaattctaagttcagcccttaatgcttattttcatgggcttaaaaggtgcatttttgcacagtaggacagctgatcattgtgttgtcaggaatagataagcactttattgatcaagatggaatcccaccaaaactgtataccatcaacatcgcgctcccacacagtggttgacctggtaaaaacaggccaattacttacagccttattaaacagggctgagtacaaagtgagtacacatatagtcttataaactgagtcatgctttggggaggggaggcagtaaggggatggatgataaaacacgagccctgaagccagcctgcctgagcaggagtgccagctgagaggttcaggatctcagtgtggacaagggaagtctctccacaaacatcctcttgtgtctaagccatacaggagcacttggcactgtgtaaattcaaaattgatttgttttatcatttcctcttgctgcagtgccacaaacagctgattttcttttgcagtctctaaaagaagcaggggaggcggttgtccccatgaacatccaatgattcatcctcgttcaagtgtaacccatgggagatgctgccaataacatgctttccttcttatcttcagttctcagcagacaacattttgtctatattttttacaaagagtcataaatttttcagttagtgtacaaataataacactgtgtaatttccatttggtctctgtccttggggttttgggagaggagaaggaaaacagggttgctttagttgacgttggcagtggggggttgtgatttctgcagcctactggggagtgcagggagaggttgggggaaggaacatgtgtgtagttgtaaatccttagatgcactgtcaaagcagcaggcttcaggtagccagaggactccactgattgtccccgtgacaaggccagagtgacaaggccagagcaggggactaggatggtcagcctcctgcaatcactaacagtgctctgatggacaatgcctggaaacatgaatccctgactctttctctgccccaacctctgtcaaattatttcaccaaaactgaggaaaaaataattttcaggattactgtatgatttggttactacttcaagaaaattgcctaatacggcatggtaggtacacaaagtgttatctctcaacattctagtgactgtccttgggtatgagactgactatctacagcaatcctgcaggactgtcatgcaagtgacaatcacaggtaataagctctcagcccaaatctgcttaaacataacttaattccaattatggccatcccaacagttcacaaaaagacatgtttgagctacaactggtatttgggagaacaagtgcaaatctctccatgtgtccagaatgaaattgggtcctattacttggtgacaatagtagggccagccattgccaattagtgagattctggccggagctctgcacagcccttctttaatttgaaggaaatagttggaggatgcaaatcaacattgttttctacaactccaccagtcccagatataggaactcaagtccccaacatgggccccttccctaacccacagcctgacccctggtggtcttttatctaagagaccaacattcactatgccacacaaggacaatattccctatatttctctccattccaaggcttggagtagcttctcttctttgctttgctcacctccctacccaccagtcaagagcccctttcccagggtctattccagtcattttcccttctcggatgaagaaaagcattcactctgaggcactctttgaagcaataaacagcttacttctttgtggaaaaataggcaattttcgagtaacctttggaagcatctaaataacccacacatatttatggctgagtgactcttcggattgaagaaactttcagcctgcgtttgcaaagatttccattaacgttttttgagcagcctctcatctcattttaaaacaaatggctagctagcagaagagaaatttggtttgtttgtttcaggctttctctctctctctctcctccttcagcttgccagtgatttgatgcatgcatgaagcagcagcagaagttcaaatggtaactctttgcccaaagagctccaggtcagaggctcatggtgtcataggtcagccttcttctctcattttaaaagaacctccacttcactttgtccacttgttccttcttgcagggataattcctcaaggaagtgagggggctccgggctttctcccacccccacaatgcctcaggaagtactttttaaaaggttctctctcaggagaaaatgttagatgctatatttatctccaactaatccatttctccctctactcctagattaaggaattaatggctgctacagctgctgtccttagcaattactgtaaattggttacagcctcaaaaaatatccactcatcaacaacagtgagaatccaggttctatgcagagcatcaggtacacagcctaagtaataaatcagtgtctcatagagtacaagatctacacagcctgagccctggggtttcaaccatggaggccagaggagataggtgataagggtggacatacatcatatgtacatacaacttctctcaaggcccacagtgaatcaaatattaaggaaattcccccctcattgatcagagtttgcaccacagcaagccctttaaggtcatttctcagtgtgctggctgttctaacgtctgctttaccctttgcagataggacacagtaaactctcagagttagcacgacttgtcctaccaggttcccttgcctcctgtactctggagatgacacattccatcccttagctcacacacatcctgtctcaaaatcttgccacaggccatttatatcacatctgcctatgatggttaggtattttcaaaagaccagaaccagaagaccatgttataggtagcatggataatataccatggattatcatttgtgataggaggctaagtagaatggccatgaacatactacagaaactgagaactcagcttctactccgtccaagaaactagaacatggggtaccaaccatgcagcccccatttgatgctaaaagcttaaattcttccagaagactagcagcaaaagcatggaaagcctgagtattctggagtctgatacccatggtcaatggctgtagcagtagattcgtaggaagagtggagtttgcatacattggatggatttctctgctttcacataattccatcacagaccccaaccttttggatgatactgtccacattcaggtgagtatgtctgcttcagtcactatgtcacctatcaattccctctagaaagactctcacaaacacagtgggagccaaaaattattaatgctggacacctatcactccaatcctatctataatcaaaactatctatcacactgtccaattctttacttggtacagtatggacctaaaatgtatctcagagtcacacactgatgggggatgtccttctatatgctatgaatatacacctgttgtactgtgtcatcgtgggtagctaagattttcagtgtgacaatctctttacctgtcacgtcagggtacatagtaaacaaaggctgaacatagatgagacttctccaggtagaagcctgtttggaaatttactttcagttagaccaggctgggaagcaacagagaaataaagccctgttgctccctgaggagaatctacccgtaacccgttttctttctctgtagttcacttagagtcaaacctaccacttagctgatgataacagctccttatagctttagccaaaatagcaataatctttctggttccagtttgcttgtttgacctcaccttaaaataattgctgagttggattttaaaggtctagaagaaaatcagataaaaagcatcaacagggctaatgcaatatctcaacatcactataacagtaaccacctccctatcttgaaagttcacctctagactccaaagacgccagggtgcagaggtcacagcatcctatacatggcttctaacgtaaggcagacaaccaaagctctgtctacagtcagcttgagcaacccaggttttcacttcctattacaccctgagatgtttctcttctttctctcctaccttccattacttgcttttcaatgctcaatactaattatggattttatttataaaaccgtttttgcaacatcctggggatgcagaggggaagggaggacaagaagctgaatgctgagaaagcctctaaggatgtatccattcattctttttaaaaagcgtgtttagaagtctgtgagcatgcaaggaactcaggtgtggtgatagtggtggtggtggtggtggtggtggtggtggtgtgtgtccacaggcctgtgaaggccagaggctaaaattggttgttgttcctcagcttccttccaccttgttttattgttagtggtgggtttgtttgatttttggttttgtttcattttgttttgagacagggtctcacatcagccaggagctcacaaagtaatctaggacagctgaccaataagatttagcatcctcctctctccactacctagctctggacacaagcatccagctttttaacatggattctaagggtcaaacttaggttctcgggcttaggaggaagttcactgactaagcttattgcccccactcagaacacagactttaaaggcacaaattaagagatgctccagtgttgaccagttgctctccatgagagatgctctggtgttggacagtgcactctccatgagagatgttccagtattggccagtcgctctccagcctcgatccctttgtctttatggtgccaatactgaacagagcagaggaacggtcacttcacaagcctgcctagcagaagcatcaccccaaaagcttgctgaatgtgtattccaggagcaaccacactgattaagttagagttgtccgcagagtcaacatgagaggaatttttaacatgatcctcaacaactgactagttggaagcagcatttgacagtacctctgctggctctttccaagcacatcattgtagaggtccccaccttggctgcacagggaagttgcctggggagcttcatacacaccacaatattccatccaatctggctaattcaggcagaagctacagggtggggagcaagtgtgtgcatgtgtgtcagcgtgtgtgtgtgtgtgtgtgtgtgtgtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttacaccccatccccatatccatccctatttacatctacagccatgaacaggaactgcaggaaagacaccatctttacatgataggccaggcacaagccacagttcttttttttttttatattttttttttttgatttgttagatttttaataagaacatggaaatcccaatcagcccttcaataaaattaaagtacagaaagtgaaattaaaagtattctacagtaaatgacttttattaaaaaaaaaaaaaaggccttgtgaacactcagaggccagagaaggatgtcatgtgttgcactgtcactctccaccttattcccatgaggccagggtctctcactgaacctggaactaaggggctagtcagcaagcccctaccctcctgtctccaacctccacagtgctggtggagtcatacccgggttttcatgtgagtgctgacatgcaaactcaggtcctcatgtttgtgcagcaagcactctttcccatggagccatcttcccagccccagtctgggaattttcactcccatccacactaccatccctatttacatctacagccatgaacaggaactgcaggaaagacaccatctttacatgataggccaggcacaagccacagttcttttttttttttatattttttttttttgatttgttagatttttaataagaacatggaaatcccaatcagcccttcaataaaattaaagtacagaaagtgaaattaaaagtattctacagtaaatgacttttattaaaaaaaaaaaaaaaaggtaactgtgaacatataaacaaggctgcagggcagtacacctggaaagagatacatttcccaatgtacctatgggccagtgaattccatcatttccaagtaaattcttaataaaaacgccactgagtaggaaagttttgctgaaaatattttcagacaaaactccaaaaaacaaaacctcttatattggaaaccaaacttcccaccccatttggagaggcaggcggagtcccaagggaacgctggtggtttgcaaacggctcctggagtcagcagtgtgcacgaaggggtagctccacagctcagacatgacacggtgctttcttggacaactgctccctcaagataaaactgagagggagtgggagagactaaaagaattctaataaaatgccaattcttttaaattacgctttggctgattttgtgctataagggacagctgatttctaaaaatcatatcttttcagagtttcattggaaggaagactagagcaacttgcctttcctcatagtccaggaaaacaactgttatttcaaaagttctaaaaatatctactttcatgaaatagtaactatttcactacaaacctatttttcactaaatacacacgtttcctaatcctggagtctcctgggaaaagctgtgggcttttcctgggtcccaaagactccagtgttcacagagagtatggggaatggctgcatccccacctcctgggatgggccaggtcagaagtcatgtgcggaaacacggccaggcttcccccaggcacatgaaatcatctttttaccagttatgatttcctccgcctccaaacacaaccccaatcagctaggcacaagaggaacagagaatgaaggtgtgcccacactcctggtttccatggtctcaaaccaggagaatgtgcaggaaagcccagcgatggtcaagcaacctggattcccaaaaggccactgaatgggaatgtaagccacagttcttaaatagattaaatgtcaaggtgctgatttacaagtctttgctagggttttaataagaaatgttcccctatgtatttgagcatttggttcctacctagtggttctttggagagattgtgaaacccttaagacacagggactagctagccaaagtaggctcctgaaggccagccttgaaggtagtgaactctgggcagaattcactgtcgccagttccagccagagctttccgctttctgcctgccaccatgacgtgcccacatccaactgttgctaccacagttggagcctctccaccatgccatctccacagtggtggaccattacctctgaagcatgagccaaagaaagccattcctcccttaaattgctctgtcaagcatttatcacaagcaaattatctaatgcagacatcttgtggattcccaatcaaaactgccataccaaagcttctagaagacctagaacaaataatccagattaattttgtttattaactttaaatttgtataagcctatttaaaatctgtgttccacattagttgcctgtgaagagaacttgcctagttggcatgcttgcttggtagatggaaggttgttctggatgttactagcctgtgtggcaggaatgcacaaaagaatggcctgctttgttctgggaacgaagaacagcctagatgtcacactgcagttggtagcaactcctgaattatgatgctgcttccatttggctcttcacttccgttcctatttgctatttattgttgcttcattcctttgtcttgtttgtgtgtgtgcattgactctccagacttgcaggttctcccctgaggaacctgactgagacaaaactcttactgcttcttctactttcaccctcagttactgcctcatagaagaaccacgcacatgtaccgtgatgctcctccaggcttcatccaggctgcattcccgcttgttgttttgttttgctttttagagacaagctttctttccctgtgcagtccaagctgcataaaattcacaatcctttgcctactcccagttttcaatatgactttcagggcatcaactccaagcaagaaatgaatggtaaaacaggaaagtggaagccatgcatgccctagagttgatccatggttgattctccactgcaggaaaattatactggaaggttgtacacacttcctagactggccaatttcctgaagaggtaagccattaaaacacttgaggagaacaaagtggaaaataatggactcttggggggggcaggggctattacatgtggcatgtgaatctgactgctgcctggaacaggatctctccatagcagcatccctcacatttcccactgggtgagtatttattgtggggctctcaggcactacaggaagttatcagcacccctcccctgtgtctactaaacaccaagaaagaagctcccccactgccacctagctgtgcagccagaaatgtctcctcaccatgctgcatgtcccttggagaggaaaagaaaattataccaggtgaagagctcttgctctggaacaaagtcctacataaaagacaatataaattggtaagagaaaatgaaaaaaattaaatcacaacctttcttcaagttaatttagtcatataacaaaataaggataattaagcacaaataatttttgaagcaagaacttaagctttttatttcctattaaaaataaacatgttccatgctgggcatagtgatatacacctgtaatcacagagctggaaaggcacagatgggaggatctcaatttgggtgctatcctgggctacacaaagagaccctcatatctggtgttttctttttggactgccaaccagctcccaaataaagacacagagacttattattaattacgaatactcggccttagcttaggcttgtcagctagctcttttaaattattttaacctgtttctattcatctacattttgcccagggacttttacctttcttttattctgtatgttctactttcctgcttcctctgtgtctggctggctggctcctggcatctccctggtgtctttttttctttcttcctcaagcctaaattcctcctcctatttacttgccttgcctagaagtctgtaggagacaccataaccacacctgcttggggctggctacaggtgtgcctgaccaagcctgccagggagtggtcagggtggcatagggaaggtttaagagtgaggagcatgcctgttcttccttttcatcctctgtttgctgtacttactgctgccctgccggctggcaaggttgctctgtaagtaaggcttttccctaataaatacccttgtatttttacctgactccgtattggtaattcagctttttattagatcaattaggtgccttaggcaggcaagataaaacagcaacacatctttacataattaaacaaatgcaacacatctttgcatagttaaacaaatattccacaacatatcctatcttaacaaaaaaaatgttgattatcattttaaaatgttaacattaaaaaaaaaaccttttagaaagtcttcagctacccagaagaggaaagacagcaggacgtaggcaggaaaataaatgtgcaagctcaatctatattttttaattgccatttatgttaaattatgattttgctatatgaaagtttaaaactcaaaaatgtaaatgaaaaacaaaaagtgaaaattaaaatatatcataagaattaacattcaacatatgaagagtttatcaataattctataaaaatgtcaaacactgagactgtgactcataagtagccagaaatacacagaaaactcacaaaagaggacatccaggaaaagagtaggaatgagcaactaaaatctccagcctcgctagaaaattaatgttttaattaaacagttttacccataaaattattgtgatttgaataagaaaagattctgcactgatgtggataagaaggaaaaggcattcaagtattgcagacatttttataattaacacaatgataagacttaaatatattcactttgcataatctgtcctaaaaaatgatactaatttttttcaagagctcaaagatgtgcattatagcattaagtaaaataatgaaaaatcaagtatcacctaaatacccaataagtaagctgtgttgcagaagttacatggtagtgatgcaatgtagtgtcatgaggccatttaaaaattgtttaaaataacaagtacaggatcatattaaaagcattactgcaaccacacacatagatataaatagtatacatagatgatagatagattatagatttatgattaatgggtagcatatatatagatgatgtagatagacagatagatagatagatagatagatagatagatagatagatagatagatagatagatacatcttttaaaggcacttaataagtaccaaatgctgacagcagcctggttgagcaaaacttttcactccttatatttcataattctaaattacttatagtacacatgtattactttcaccatggaaaacataacctcctccaaaaatgattgttttccaaaagcacactctgtgtactgaggcattaaaatcagtgcacccactccagtcatgttttcttcaaattgagctactttcacaaaacattcagatcaaaaaatgttgattgcagccaaggaaagctaatctgctctaatctaagggtcatcaccctcttggccacacgaacacctggggaagatagttctggaacacccagaagaagcttaaagttaaagagaggatttttttctttattctttagccacatttttttttcactgcacacatcaaacaggctcttctccacatgtcaacagaaaatcccaaagagagaaaataacatcaagtcagttcatgtcctaaggtaacccatttttaaaagagaaaagagaattgaataatgaatgactacctaatatacccttggtatagattaatctgatcaataatatttattattactctattccctttatcatattcatccataagacataggagaaaagcaaaatatatgacagggacttaagtctgagttggaaattaggaagaagaaaaaggtagatgaattaaagaatcactgtttatcaacaattcaagtgaaatttgggctttacatgtatctatcttagatttgttttgtataggcttttgtgttaaaatacagaaagccatagaaggtcattacagagatatgtcaaagggccacaaaggtgagaagattcttagaatcccagtcccagattaaagtaaattacacaattaaaacagtaggagaggtcttcagccatcaaaaagaggattgttctccacccagaagcagtctcctggttcttaaggagaatactttttggactatcatatatgacttcatctatccctgtattatattccaagtcacagatttcacctagaacactcttgtgtctctctcaccattctattccatcagtcttgttatagatagataggggaaacatcagtactattccaggcagaaaatgctctagagagggagatagacacagaactatgtaacgagaactctttccaccagctgcctgagttctgctgccatgtttgggcccccaaataacacacagagatttatattagttacaatgctgctggccaatgactagatttcctatctgctagcttggtcttaattatcaaccaaataacaacctatctatatatttttataaagaattatctgatcaaggactctggcagcatgtgtcctctcttgccaggatcacatggtgactcatttactagatttcccagaatcctccttctctcctagtcccgcctaacttgcttccctattgaccaacagcactttatttatcaaccaataagacaaacatatatacagaaggacttcctccatcagaactaagtggtaaaacacacatggaggttaccaaaaagagaggcaagacttgacacctagttcaatataatatggtacccaggttttctgaatcaaaaagaaaaagagaaatgggatgcatggtccaacaatcataaaggaacttctgagttaaatggggcagaatattttctgtctgggctaactcagaaaagaaatccatagaggtttgtgttatttttattttttcattgagtgtgactgggagttatagagtagaggtcaggatgaaagaggagggagagccaggtagaaagggaagaaagacagcccctctaagctttgagtactaggttattttctttctctattcaagcatgttctcttggactggaaaatgctttgttaaactgatctgaggtcgtttccatcctcatgagaaatctgatgcagtatttcatcctaaacattataaagcttggcattaaaagcttcccaaagtctattttcccctggagtcaggtaccgtttgtcatttgctcacacattccttctggcagacggctttatgatgattcccatgggcagctgtgggctggagagcatccttcacacatgacttcccacagagtccagaggccaatgggcacaaagagaaagccaggtcctggtattgatgatggctcccatttagagcatgtgtatggtatcgtctcttcatactgcttacctgagtttatcacgtactatcaaaactcagaaactcatagcctcagactcaaaaacaagtttgtatttaaaatacccactcctccctgtgagtccaggtactatttttttttttttgagtgcttactgcagccaatggtcttcaaaaacactacctcttcactgctgtctctgcatggaagcagaaaggttgtgagcaatgattgtgagcagaatatcacccaaaatatggccatcatgtggtttaaatatatgtcccccataggctaatctgctggaatacttgccccccagctgagagtactctttaggaaaattgtggatcgtatgagagacagagctttgttggaagaagtgagtcactgtgaacattgagatttcatagccaggctcagctgactgttcactctcagtttcctcagtgtagatgtctcctgctctagttgccatgtcttccatgccatggtgaagaatgcatctacctctctggaactagaagccaaaactggtcctttctcccttatgttgcttctgttagagttattttatcatgcaacaggaaaagaaactaagataggtcattatgttttctgaaacaaaaactgatatttatgggctgaagtatgcattgcattcaatacaatggagatgaggaaagagccgtccttaaaatcagaatagaaaatccatgacattggtcactggagcagcacaatcacacggggaaaatcatgcttgaactttgatttccaaataatttttaatgtttgtaggggaagccgtagccacgcctttttaggggctggctacaggtgtgcctgaccaggcttgtgagggcgtggtcagagtgacgtagtgggactgtgtttttggtttcccacttctgacaccagatattgtgggaaattaccaatacagagtcaggtagaaatataagggtatttaatagggaaaagccttccttacagagcaacctagccatcaggcatggtagaggtctgtacagcaagaagcaaagagaaaccgaaaccgaaaacgcagtcccactactctgaccacaccctcacaagcctggtcaggcacacctgtagccagcccctaagaaggcgtggctacggctttccccgttattaaatttggaagacataaagacaaggggtgaatgctagaattacatatcttagctaattaagttggcaagccacctgtgtgctttgtaaatgtagtgtgtggtgtagaagagggatgtgcttgctctgccgcaaaattccccaacacactttcaacctgaaacataaaacaaatattgagtacaaacccttctgggagttgtgggaagtgaaaagaacatacatttttttctcactttgtgacaaggaagaatagtggtgggtgagtatagagagacctgaagactgaaatagcagctttctagtctgtggtcgaggctgtggtcagaatgtgtgctgcagaggcagaaggaactggaggctgggaaacacagagaaagcaacctctaaacacaactttccagctggtgtctgaatcggagatgaagtttctgttattatctattaatgctattgattaaaccaaatgcttttatgcatccaggatatagtttgcgtttaacatatttcttttaaataaagatttttctagaccttacagcttcccgctattgaatgtcaatttttttttctgttcaaagggcaaccatgatgtagaaagggctcccaatctgggcagcaaatagggattcctgggccactggaaaaggcctctgtgaacatgaaaaccacagctgcgcaacctctagtgccttttctcctcctgtgaatggcccaggagcagactctcacagtccacagctccaacagtttttggaaccccatagtcattgtttgggaattatctctagccattccaagtactataccaaaatacctgctactgagccattgatgggtacagaaatatacttccaatggttccagagattgaaaatccagatcaagacctcagcatctttgaggtgggtttctctctatctatgtccatgttagggcctccctgatgtgtaatcatagaacagaagggtataatccagtacaggcaggaccaatattttgacattgtggcacaataatgtcatctacaatgttcatgctccaggaaagcacaacagataacaaaataacacaacaaacttcataattttgtgtcaggctacatgcaaagctatcctgagccacagattggacacacctagatagtgcccccacactgcattataagggcatagatcccactgatgagggtagaaactttatggcctaatcacctcctaaaaggcttcttggcactatcatactgagtttgaatatgaatctggggacacatacatgtaagccacgagcaagcatgaaatctgggacaccttcataggcacagtattcttagatgaggagaaactctgtgccttggggcagtgggggtggggtaagaaaacacttctggataaaatcaacccctttccaaggagagacatttctctgaccaccaaaaacaagctccagaagaaagctgggaatgaaccatcatgctaggcaagattgtgagggaagagactagcattgctccacaccgcacacatcagggttatcttcacacacaggtagattttcttcatgttgagttcaaacagtggcccacagagaaaattctagacactatgccctgggactacttgtctttaaagtcataaatacagccagacagatggctcagcaataaaagtgcctgccacacagcctaacaatggaagtttaattcctgcacctacatgatggaaggagaaaactgactttgacaagttgtcctctgacccctgaacatacacacacacacacacacacacacacacacacacacacacacacacaaataaatgtaatgaagtaaaaaacacagagatcaatgggtataatcttcctcaaggacaaggtggtggttcttttcaaaagcctttgtaatacatatgtattattagatcaagcaagttcccaactaggaatgtgtgctaaaagaaaaataaaaaaatatataagggtgcacctagaaagatgttcaagaaaataaaaaatgaaagatgtccaacctacatttcttcccaatactaaaaaggtagaaacaaccgaaaaaatccagtattggggggtgaataaataaatgaatcttagtatattggtatgtttatcatttaaaactagtgtaacagaaaaacatttaatagaatggtatgttaactacaaggaaatagtacaaaatcatatgaaaacttgatttcatatggggactctaagaaatatacaagtaaggaaaattaagaaaatcaagttctttacttcttttttaatattctggagccattttaaaaatctgtgtgaagatgtatagtctgaaatttttaaaaaagttttacaactactacttttaagtttctaacaatgaaaacttcttcaatattaattatcagcatagatgtggggataacaaagaatgaacatggttgttcctacatatttttaaatttttattgtgttgaaatttaggcttaactcaactcaaaaactgtccctttaggttgatatcgaagctaattagaattgcattttctagtgagaaaagaaggagatgcttggctccttctctgcattctcttccacattgaaactctgattaagattatttcttctgtttactagactggatagattctgtagctctaactttctcctgaagtaaaggtgttaatttgcattaactctgattacccattcgaagactgtgccggttgcatctgctatgtactgtgcagtgaacgtttgattatctgaggagacaaagacagcacaggtaataaaaatccatggagactacctaaacttcatgttagccagaagtgtcagatgtttgccaacgttgttagcaaggaacaaagccgatttgagtttaagctcacaactcccttccatatgctcaagattatgctaagaagagagatgaccagccacaggggcagccctaggtaattcctagtcgggaaaattggtttctgattaatcaagatttggcagaattggaccgcagacacgcaactgtctcactgtaaacaccaaaccaaacaataacagcagcagcaacaaaaacctactattcactgggccagggagatggctcagtgggtagtgcctaccgtgaaagtatgaggctatgagttcaaccctacacccatataaaaaagccaggtgtcatagggcacacctctaatcccagagaggaagagacaggagggatatctggggcttgctacccagccagtctagctgagtcatttagcttcacattgagtgagagacctgcctcagagaaacaaaggcaagagcaattgaggaacacacctgatgttgacctctgacctttatacagtcatccacacatgtgcacacacaccttcgtagacacaaaaaagtttccctctgttgtgtaacatgcccaggggagctcattttactcatgtgtcacagtaacatgaaccccagtacccctacacacagagaatagacagtgaactcattttctgtcatattatccccccaaatcatctaataaaaatgtctagctatgtataatttatagtcattgcaattctgtataccagattgatttagattgaaaaattgcaatgagcctcaaactcaatgtcctatgattacaacgttttggaaatgcatattcttctatgacctttcttgagtctgtgcaagccacagaggttctttactatactcccatggactcacatacaaacagaccctaacggtgcccatgattggatttaacagatatttctgatacccctatacccacacttattgttttaaaattgaaattaagaaagctacgtcgggcttttcagaccttatgaaaataccatgtctctaaaactgccttttctttaaggaatgccataaattgactgataggcatgtccctacattcactttttaagattctttcaactccataagataacagtagatttaagtttgtaggtttgtgtgtgttttttttctcccacaacaaatatgaaaaagataagttgtaccaaaattcttaggcgttttaattgactaacagccagtagtaaggtaagaaagctccctgagcagatctaacatcagaggcatggcatggctgtaagctgcctctagtgcactggagcgaagattggtggcctcttctaggcttctcaactggaaatttttagtcctttttgcaaagtgataagactttctttacctagttcatagacaatgaatgtttctctcccagaaaaaaaatcccacctccatccaaaaggaagaaattaggaagaacagcagtcaatttactcgttgctggtcttcagcaatattaagttattgccaccaaattaaaagtcaaacctgagcagccatcctcagttactttgctgtttccaggctgaggagctagcctggtgggttaaaaagtgctagacacacaagcacaagtgatccccatcacccgcctcaaaatacagaggtggtagtactctgcagagacataaagagaatgatccagccctcatgggccagccagtctagctgagtcagggagctcaggggtcagtaagagagagagactctctctctctcaaaaggagataaaggatgacacccaatatccacctctggcctccacacacacacatgcatgcacatagaacacacacaaaggaagaggaggagtaaggggaggaggaggagctactcagaaggaaaagaagttgctgatgtaggtttcttgggctaaggatttgctttccagtgccggctttcttgctttaataataggacttttctcctagagtggtaaggaactatgactttcctctctgagtgtagctatttccatcaagcctgatacttgctttctttgtatcacatcagatgcaatgaagaagagccaatacaccacgatattgttcggagatttctggcattaatttgcaagttttccagtaatttctctccaggtttttttttaagacaaacatatgcctctaacctagaaacgacccagacagacttagtaagcctttccaggtctcataaaattaagcttcaatactgactgacccatcagggctccaaaatacccctgctattccccccccaaaaaaaaagcttccaagaagtaggattggagaataaataaataaataaccaaataaataaatagtcacctacctaaacatgaaggaaggagccatatatagaccccatacacttcaggctttcaataattgctaattttaaaggaagcacatcctagtggtgatgatagagaaaactgtgccttctgtgattaaaaactatgatgctaattcatgactcaaagctttcctgaattggcaatgttctttttctcagtctttatttttaacactttccatacaccgttacctcatttcaacttgttggaatagactcagacatggcgagtttcagctccaaaggaaacgtgcacatgtctcagagccagtctgaactcacggtccagttaaaggctgcttgtcacatacatgcaagtccctacatgtagaagcctcttcaaccttgttccaaaaattgacttccatttatcctccctccccatcacatgacaagggcgcagggatggatagctgtgtgtgctcttagggcaaacagcatctgtaaagtccttttagtgagggctctgaaaatgggacacagtttagtacaagagcacaaatcaaatgaaattcggcacttcttgaatctcacaggaaattgaaaattatcacttttttaaaaacttagtgattgaaacatgtttagaaggaaaaagaattgcagattcagctgttaacttagattaaatgttcacaggacctgtccctgttatagatctctacatgtcacatgtattttaaaccaacatatgagaccaaactgggccttttatcttgctatttttaaaaaaattcagaaaatgtccagaataaaggaaaagtattttcatatattctctacagtaagattccagaaatgacccttaaattccctttatgtagttgcattagctacaagaaacaagtgttgttgtttaggttgggtttggttttgggaacaaggtctcactggggcccaggctggcctggaactcactctatagctcaggctaggggctcaggctggcctcaagatcaccacatagctcaagctagctcctaactcccagacctgtaactcacattgagtgtactgacttagcttcccatgcacctgcgttacagacaagagcccactcctggcttggtttttctttacttgcagacataatctatccagatagcaacttttcactttacctcaagcctagactgacacactctaactgggactcttcccattccaccggtaaacttctctaaagacaagtcctaactatttactttgctgccctcccgctccaagaatgggaaaacctggctctacccccaccttcagccaatctcattaatgttccccgtgaatggtggtcactcaccctcaagactgcaccaagatgacctgccccttgaggcctgtcaagtccctgacacagctgatgaccttggactcccatccctggtgctatacaaagacatttttgtgttttctgagagcagttagcacaatgccatgtactattgctttttctccccaccaattaaaagaatgcagagtgtttcagtcctatttatctttatacccataccacctgcccagcctctagaatcacctatccaatgaggcatttcaatgggggaagtgaagcagacagcccaggctgctagtttcatggcaatcaacacaggtagatttagcctaatttttgttttcaaatcacagttctgaacacatttgtccatacattcttcatcctgggctaaatgaattctatctcagaccactgtataatccaacaaactcaaactccctttgtacctgaaggggagcctgagcagagattggtgtgtgttggcagaatgcagggacatttcggggacatatctattatccctgcctcttccctcttctccatgcattttcatctctttcccaagcactggcacctcctagccatctaatcaagacaaatctttcatgcggcaattaacatacagctcatcttcaaggggaagagaaaaacaaaggctgagacaattagctgactgtgccaaacagcatggttcaccccctccagcccctgcccgcccgatccctccctccccagcttcctccaaatgcctgcttttaagtattttcacaggaaggggaaacttcattcctgctgaaaggtaagagaaaagacagcctggaaaatggtttaattgaatttcgtatgaaaaatgcttaggactatttaagacaaacgttgggcttcttgctcactggaattgcattagtggagaaagaggacaagagacactgactaatctgtagctgtcaggttagggcagaatatagcattagcaggacacagacctgcagtacaaggagagacaaggcttcccaaagtgggcactgcagagcagagaggcacactgtacttgtaatgactcagaaggtggagaaggaactcaggactctcaaggctatgtgtgccttgattacattagcacagcccatagcattatgcagaacacgcactttgattgtattagttctgaattgtctgtaaaggccactgttttatttggctccccacaacacctgcctttcctacaacatcccctaccagcatactcaagcattagtggttgggttttctaaactcttttagccattgatggctgccagcagtcaaattaaattcaaagggtttagtatagctctgggttttagctatataatttactaagaatgcccaaagcacttgcaatctaattttcagttcagcaatgaataccatttcctaacaaaatctgcctgaaatttccttttgaggctctgggaaggaaaaataaaactgtgacacctgtgtgtcttccttctggcactgactcaaaaaaaaaaaaaaatgggggaaaaaggaatccaaacctaggaaaaaagatatacctcatgtgaatgtggtacaggaaaagaaatcaaagaatggcctggtttggatggccaaggcatctggctaacgaagacatctgcattcccttttttagacttagttttttcccccactttctaaatccaatactctatctgttacatccccactattaaccagcataggcctatccaaagctgtggttctctaaaattaagcaaaaccttgggaaaaaaacaaacaaacaaacaaacctgatttgaccattcctacatttttaatgataaacttagtctgctttccgtgggaaagaagactgttaacccctaatcgtggtgtaaatttcatttctgacattcagtcctccaaaataccatgacttacgatttcctcatgagttaacttcacactccttgaaaggaaataagagagtaacaaaagcatgcagttactttgcaaggtggcaatcctcgtacccaggaatcgaaagcagacagatgatgagtttgaggccaaggcaggccatataatgagactctgttcttaaaaggcaactttaagtctatagtttaacctgcggcattgactgctttcttccatgaaaaagatagccttctgaatggggcgccaatattatcaccttcaaggcttttggaatggggggaggagaagaacgtgagagacaaaggatggggaagagtgctatgaaaagctgtcttctgcacatgacaaggctgccacactcacactctcgcagtgagtgtcattatccacaaaagatggggctcccccaacatcccaccataaaccggagaagggcaaatgaggctccactctccctggggagctatggggagctaacagttcctggggaagacttctgtgatttgaccaccattatagttgccctgttccagaaaataaccccagcccatgctcatgagaacaaccctaattaaactcagtgtatcagaaagaaaaagaaaggcatgaaaacaggagggggctttctgggatgctcaaataataattaagaaaaaattgaagatggactcttaacatgagatttgcgaaggcacaagggatagttagaaaatgtttagagtcaccagtagggtctaaaaatatccaactccattaaagcttacttttggatttccccctctctcacactggcacacaggagttctgaattctggccatatggacaaagtagctgagggcaatgcagctgacagttgccaggtgaaagaaatgcatgtgccctctccctgtcacagaaacaggatgagccactgaaggaggctgtagcaatcaaatcatcaagctgaattaatttaattaataaacagcataatttaggaagccattagagaagtcagagatgttggctatctacccagagcagtggtaatcactcaccatcaagccagctaatgtaactctagaagtcagagcgtcaaaggataaactgaaaagagccaaattcctaatggctgtaatgatctaattctgtttgttgatctcacgcctatgattttccactcaacaagcccctttatatcttacaataaactgtatagtttagctggaagcttttttgtaggtttttaaagcccaccaatgtatcagccctgccatggaaaaccaaggccaggcacagaaacctctttctctcaggtcaccatcccacctcactccctctctgcctcatccactccttaagcagtctgtgaccagtgctccgaaggtgtgacagaaaaacatgacaatggcatcaaagtcaaagctaaccaattttgtagagtgtaaatgactctactctccaagtgcccactgaacccatctctacccacttgagttcctaacgagaaagcacatttgtttgtagagcagccgacagaaaattaatgtagtcagcctttcactttccaattaatttagtgaagctgtagttaagtaatccaactctatcaagtccagatacgaaaagatcagctgcagagagacctagtagatgtgggggaaggtaggcggcatttttattttgtttttaattacattaattagggatgctgcatgccatggtgcttgtgtggaggtcaaacaccatcttgaagcagttggttgactcatcccaccagagaggttccagggatcaaactcagaccatcagacttaacagaaagcacattcactcagtgagccatcctaccaaccctagcctgtatttgtaaatgatttctgtgccaggtactttagtaggcccttacccgttgtgtatttcaatttcatctctgtgggaaccccacaaggaagaaatgatatgtctattttacataagctctctttacataggaagtttaagtaacttctaaagaaccacagaataagaatgtgtcaatgctgggacagtatccaacgtctgactccttaaattaaaaatgaagatgaatgaataataaaaattacggtgcatggttattcatgggatgcatgtatttgcctgatggggttaattatcttttctttgtgtgtgttgtgtgtgttgaagaggtgggttggaacatgcatgcttccatgcacatacagaggttttccttgtatgtgttacagggacaggtgggtacatgcatgcctctgcacacacatgaagatgacagctttcaggggttggttctctccttccaccctgtttctgaggcacagtctctcttttctttctgggctgcatattcttggctagctggtccttaagcttccaatcagttttccagagtccactttccagctcactacagggatgatggcactgcagatgcatgccatcccagccagctttgtggctgtctacatgggcagggatatcaaactcagatcatccggtttacatggaaagtacctgaagatggtttccccagacatgcctgatggctctgacaatccagtataagttttgactttgttgttattttatgaccatcttcaatgtcaccattgaactcaacctgtatccattctttttgttaccttaacattttctttctttctttcttttcttttttcttttttttttttttttttttttggcacttgctctggagaccaggctggcctcaaactcacagcgatccgcctgcctctgcctcctgagtgctgagctacacattttcttttctacattcaaagatttaggcagggaagataataaagataaggacaacttgaaaaataatgatttgcaattaattttaaactaactctgaatatggtttgttccatcttacagacacacatcacatgcatttttgatgggaataacattacaaaggattaatgtccaataaaatccacacgatggatatatgtgcatcagacatctaaaaattctccagaaagcaattacactgagtgccatctaataataaatccacaaggacagccatgatccaggctgcattgcctaacagctctgcccccacctaactccacactgcaatctttgctagacgctctatgtatgagagaacagatgttctgctttgggttgagaaatcaacggttaccattcatatgttccaaaaattcaagggcctagtgctgctgttttgaggatgctaattaattccagcccttatgctccaatgttctcacagtttcaatcaattgcaatctcaaaggacctcagtccccactatctcctttgaaagcccatggaagaaaaactaggaaatgtatatttcactgacatagcagggagaagggaatcatccgatatgctctgagtctgtatattttcccatgttggcatcattgccatcctttctgttgtatcaacttgaacatgtaggcaaagtctaggtgacaaatacaattgaaacaatgcctagagatgcctttgggccattttcttgtgtctatttaccactcaaacagactaattttggaatcatgagtttgtttgtttgttttaacctctgaatgcatttatttagatgtttgatatctgagcatttttccctctgaaaatgataaagagctgagtcctgcccaccccatggcctgccagtccagcctgcagagggcgactccactgcctcggaaattccgaaataaatagaatcaagtgttagcgctcaatggcagggtggccccagccacctccagagcagcattatggggacagtctcaaggtgtcttctgatggatgggcactgtgcagtgtgtggctgtgcaaaactgcctacagtttgtccaggaagttgcccagtgctaggatgccctcctttaaacctttgcgcttgcgggtctcagtcaccacttagctgggacggctgctgttgtcgaacgggtccccgggcagaatctgccagtggtcgaacacacactgggggaaagcttggccaccagtgttggagcgtaggtcagctgtgaaaccaaaggactcgttgaccggaaggtaggccttgactacaaacatggggtgccagccacctgggactcttcaaacacgtgaccacgcttcctgttcaggacaccatagatgccacccacgacttgttcaggacactgaatctccaccaggtagataggctccatgaggcggggctgtgcgtcaacacactggcatacagacagcgataagctgtggggatgatctggccacctcctcggtggattgcatcagcatgtagggtcacatcatggacatcaagcgcacaccacgcatgttctcgcagagagcgccctccttagtggcccactggaagccagccaccacactgtccttgatttcattcaggtactgcacacccttggtgatgtcggtaagaatgttggggccagtgccatcaggcccaaagcgccagatcttgcgggcttcagcaacatcccactagtacttttcatctaggtagcgtgcgcgtgccttgagctcctgtcgagcagacacttcactcttgtcgatgtcctcggccaagccatcagggaaggcccaggcccttcatatgcaatcggttgtgcttgttgggcgatttggacaggcacagcacatttgactcctcgctcaccgtctcccggtatgagacaacagggtcagatttcttgatggggatgcacgtgtggtcctcctccaggtccttgaggcagatttccaggtgcagctcacctgctccagcaatgatgtgctccccagactcctcaatgatgcactgcaccatagggtcagatttagccaatcacttcagcccctccaccagtttgggcaagtcagctgggttcttggcctccacagccactctgacgacgggctgacgctgaccttcatcacacgcatgttatgtgagtgttcaaaggtggtgatagtccctgtcttcaccaggaactggtctacaccaaccagccccacaatgttcccacagggcacatcctcaattggctccacatgccggcccatcatcgggatggttctttggatgggcttcaggtgcaggtcctccttcttcccaggcgtatagttggggcccatgatgcggaccttgagtcctgtcgacactaccccggagaacacactatcaaaggcatagaagcggcctttgttggaggttggcaccatcttagaaatctacatcataaggggacccttaggatcgcagcttttaatgcccatggccgcctcatcatcaggtggcccctcgtagagcagctcacagcggtatttctgggccgtgacaggagaagggagctggatggttaccatctgcagcagggcatcccctgcgggcagccagcggagcatttaactgaccttcctgcaaatcatgagttttttaaagctattgctgaatcaatagcttcttctattgtttgtttgattttgaatctaatgatgcttgggcataataccaagcatgtcaagaaaacagttgatgggttcgaggcccaaagaacagggctggtaacatggctccatgagttaaaaaaaaaaaaatgtcaaaacagccaggcaatgggaagcattccagtattcccaccattggtgagttggagatggtggaatccctagggcttgcagaccgacctgtctgggttcagctaaagaccctgtctcaaataacatggatgggctggagagatggctgggtgagtaagagcacttgctgcttgcattgcagaggaccagagtttggctaccagcacccacgacggatagctcacagctaattgtgttgtgtgacactattcctggagagacttgaacacacatttactcacccctaaataggaaactagcaacaggtcaaagtaaggataccaccaaagtccaacttggtacaccaattagttttattggggttgcttacaggaataagggtaaagagtaatttacaggagtgggtaaagaggtgacccaaagacccaaagaggtgttacatcaacaaaggctgccacagcagaggtgacagctcaggaaagctggagatcactgcagaacttgcaggcagctccacagatcagagagtatattttccatgcagctcagttggtctgagtgtcctctcatccatccttactgcatagtatgagtgtgggtagacagaagcctggtgaatctggtcagtttcaggaactccctgaagctttcaagttgtttacttcccaggttttaacaagtttgcctcctgaatgaaatgctttgcctcttagtagagcatcctgaattttaatgagcttccctccaaatggaaagtgctaagaaaaattgctatacaacaggctgcaactaccgcttcatgggatctgaacgcctcttctggactccgtggggacccacatgcaagtgcaaataaagagggacacatacatacacagaaataaaaataaatttaaaaatatatgatggaggatagctgaagacaccaaagtcagcgcgagcacacacacacacacacacacacacacacacagagagagagaagagagagagagagagagagagagagagagagagagatgggctgctgctgaatagcaccagggcaggtgtgcccagagagagcctcagctgagtagtcagccagatctgactggaatccagggttttctgctgagaatggcctagcttggaaaatttcttaacctgggcacatttcttaatctgaggcaataatatcacctttcaaaatggtcagaatcaagtataatgtaatcaaaatgcatggcataaagtaaaagtatagaaattgaaccccaagtgtattgtccccttgactgagtgagtaaatacagaggaggactgttttgctttttgttgggggaacatgaggggcattcattttttatcttataagaatggggcgaggtagatgacttggtcagtaaaatgcttaccttgcagctaggagaacctgagtttcagatccccaaactcacactaaagcctgagcatagcacatttgcaatcccagccctgagaagacagagataggaagaaacctggggctcccctagcctactttgagagtttcaggcaaatgagaggaaccctgcccccatctcacaaagaaaatgaaagggggacagtgttcctgaggaatgacaatggagattttcctctggcctctgttcatgtgcatacatgtgcattcatgccagtgacacacataagcaagcacacatacatacacaaacattcaaaaaagaaaaatctagaaaggatctataaagggcttaagtaagagacgggtgacatgaataacagacattacaaacttagcattatgtctccctaaatccctcactgacattctaacccctaatgtgatagtatcaggagttggaaccaccggggaaaactattttatgaggatggggcccttgtgaatgaggttatgctctgagaagcagagaccagacagagaaagtgtgggcactcactctttctttctgctgtttcctgaagaggcaggtcactatctccctgtctctctatctctgtctctgtctcctatctttccttcccttactccctacctttccccaataaactttccatgtaaaaagaaagtgtgggctctcttttcaccatgtgagaatacagaaagtcagctacatgcattctagagaaagccccaccagaactttatactggacttctaccttccagaagtgtgggatataaatgttaattcttcaagccacccagtctgtgatacagtgttatggcagccctcaccaaggtccactggtactcatccctcccctaccactgtcatcatgctgtgccaaggaagggaacagttagggctagagtgggaagatccagtgtgttaaagagagtctgagaacttatgcccagtcggtgatgttttagggcccaaggttagggcccaggaaataaatgaaagcagaagagaagggggagagtaagaaagacagggaaagggaaagagggatagagagaggggcagggggagggagaggcagaaaaggagggggagatggaggagaatcattttctatttctctgtggttacttagggacacaaagatgaaaaatgtttgggtgtaagaatcactggctaggcttttaatccctttaatcccagctcttgggaggctgaagcaggctgatctctgtgagttcaaggccaggatccaaaactacacagagaaaccctgtctcaaaaaaccaaacaaacaaacaaaaaataaataaaaatcactggctagccagtagaatttgctgaaagaggcagaggcagcctgggctgcacatttgaaaaaaacttaccgatctcccaggaaccgctattaaaaatgtcaatgaagagatctcatcaatgggtatgagggctaagaattaagacatcactatacagagtaagggatatagtctaataaagcttgatttccacagataaaatccagttgccatgagacacacatactcagatgtggaaagtctttgcaggaaaagtttgaggccctgttggagcattaagagccaggagctgtggggttaatatcaacacacctttttgtgcatccgcagatggaagagtagtcacaggaatgattttcattataaatgcttattattgatcccagaaggaaaccagccaagcaagagcagagaacagtaagtgcttttccttcaccagaactaaatgtcaaaatctaggtccaaatagtggtaacgatcctttctgtgtgggcttagttgccactaacctcaagcaaactatttatatatatatatgatatgtgacaattgaaatagcatagatgatatatggagagcatacaaaaaaagttgggaaatttagagtttagtctataactgatggtcaaatagtgcagccagctgtgaattatactgttttctgatgggtggtagcaagaatacagaatccttagtggctcttccaagaacaagctgagtgaccttgagcaagtcctctaaacttgttgaacctcactctcctagtctgtaaggggaagaggcccatgaggtctgtttcaccctgagagttctaggtagaaggtgtccagtctcctgaagaactactgaaaacacattcccaccaacatgccaagggagttccatctccagggcttacaagaatccaaatgttgcctgagaccttctgtgatcaagaagctctgaaaagcctggtcaggcattctgtagtcatttgctgatgcagatttggatgcatctatcttaagcacgcccagatgtctgtaccactcggttgtgtggttaaaagttagtattagacctaaggaaatgcaagaaggaccctttctagtgctagaaccacaatgaagaatggccaatacagcagcttcacggagaatgtgacacactgtggctagcatcttgctgatggcacttcacattgagtttaataccccatgtttgtgcatgctctcatcaactggctgagcatgtgcgagcgcgcgcgtacatgcacgcgcatacacacacacacacacacacacacacacacacacacacacacaccacacttatatgttactaatgaggaatctacttggaaaacacaagtacacaagcaattccaaaataactttccacggtttcacacagtttaaggcagtaaatgacacgtatttagtagattgaaatgtattcattatcttccttcagcaaagtgaaccatcaattctacatgattagtgctctgtggcttctccagtgaaaggagaacatgatggatgaatagaaaggaagcgtgatctggaggatgctcacaccaggaaggggaattcatacaaacaaaggcactgaggtgggaaacctcagagcaaccaggataaaagcagctgaatcttgcaatttttctcacaggggtcaaccacctacaggtccctaatcactccatctctagctccctacagttaatctaatctcatcacaccaattactataaatacctccttggcccaaagtatatgtttctttcaccaggaatactcagaagtcatttcatgacaggactagctgctagacatcagtttggaggtcttaaggaccaacctgttcactgacatgggggaagaaatgaccttcccatttctgttcacatgcaaaaagaatagagagtctcaatcctcctcactatccacttaccctgagatgaattctcttcctttggcttatccaatcatttccatccaaacaaaagcaaggaaatgtgtcaagagcacaagaagcaaaaggtcaaagcattggaaatcccagtgggagacggtgaacagaaatacagacacatttgtatggagccgtatatcactcctctgctggccatattattaatattattagccttagtcatacatggtaccatgtccccataatgaactttctttgaaaatcatcaggactaaaagggtaaatagcttcagcctcgggtcatgatgagaaataaactcaggaccaaggccaaccagagacagattttaaaagccaatgcactcatgagttgcataaggacattttaatcagagatgcacagtgaccccagaagaccatagattttaaagtcctaatgcccagtgatgctacagtactgaaaattagctcacacctcacattttcagtgatgctggtgtagccaaacttgcattgctgcagtcacatagtaggacagcatgcaaatattcacagtacgatacacttgatattgacaataactatgttacaggcttgtgaatttgctatattaagcctttatggttgttttagagtgtaatcaataattctgttgtattttaaaagtttactatgaaactctaagctgaggtaaccctcttgtgtcttcagtggatcaagaggccaagttgaataattggccttggacatctaggcttgggtgctggtgctctgtgatgttcaagcaacactaaactcatgggatggcatgttagcccacagtatctctgccgtgaagctgtgcacaaaacaaaagagaaaatgttttctaacacactcagcaatgacctcgatcacaaccaagttagcctaaatcattatttcataccatttccaggggtcagagtactttaaaaccttgttctaaaagatctttttataaataaattactttcctttttcctttcaaggtttctgcttcaattagcttcggaaacactgtgggtctattgtttgcaagtttgaagttgggcccttcaccttccacattccacccttcgacaagctcctctcaactggcagtttctatttatatttcaacatattagtattacaaatttaaataaaattctccacttgtatcattaattagcatttggcaatgggcctgattaaatgcccttggcaacaaaatgatttaaatatcgaaaaggttatttttatcatgtattaaaaatgtctgttaggcaaccaacttaccctcctctgctcaggggccactgtggttcttaatactcctctccaggttgtattgggtaactgccagtcaatatggccagctctgccaaagactgaggaaagcttcttacaatgagggcagttcatttttttagaggcactcatatttacatatctatccacccctattccctcaccctcccatcctcccacgtcccctaccaagctcccccaacccatcccccaactcctcctcagggatagtgaggccctccacggggcaccttcaaagtccatcatatcatttgggggagggcctaggctctccttgctgtatctggactgcaatagtatccctccatagggaatgggctcccaaagtccatttgtgcaatagggataaacactggctccactgttagaggtcccatagactgtcttggccccctagctggcacccacattggttgggtccaatgctgtttcctcatctttatatctagggtctccatgctctcagtaggtcaggtcaacagtttctgcaggtttctccagcatcatcttggttcctttactcatccctactaatgagggcagtttagatgattctcttcttcctcttcttcttcctcttcttcatcatcatcatcatcatcatcatcatcatcatcatcttcgtctttatctccttttagtttaaataaataaaataatcctctactaatccaagctaagctatcacaaaataagattttcattcagttattgatattttacagaactataaacaaatatctatttagccagatttcatggggctcctctgtgaaagggaagggctgaatctgaactgtgccagatgtagaaaatccctgctgtgtaattctgaactttcattcataggacttttgggtacacacctggctttctagcaagtggcctagtgcctagaaactgtaaagacttgccaagcatgggttgaagaagggggtgatgaatacccatccactctatactgaagagagggccagcatacaataagggagccagacaagggcctctgattggagagcttgatgctcttcagatgacctgagttcagttccagacacccatgctgggctgcttacaaccacctatatctgcaactctagggctcgctcagttgttccgacctctatggcacccacacatacatggcttacattcacacagacacatacacataaataaaattaaatcttaaaaaactaagcaagaaagatggcaatccttgtttgcaattctaattgaatatgtagttatgttatcaaaaataaataatatggaggggaaatattgggagaaaacagtgcaaaaacatttagaaaatcatatttttctcatttatgaggtgttctgggtaaatgaaatataggaaaggagtagaggttgaagaaaaaagaaaataaaagaaatgtgttcataattaacataaggaaatattatacttaaataattcttaccactgagtcatctatcagatgtttaagagcattattgcatgaaattaataaaaaaaatctatttactgtgattttgccagacttagtgttttgtgttttcctgacacatcaggggagttagaaaattgtcccatgatgactaatggtttggtcattagaataaagatttcaatgttaaaaatggaaagttttatttaataaagatttttgaatgtcttcttgacatagaagtaaatatttgtggagcaaagaaattcaagctaaagaaaaatagggagttggatgttcatgtgtctgggaaaccctcaaaaaagagaagctgggcctagtggagcgcacctttaatcccattactcaggaggcagaagtaggcagatctctgtgagtttgaggctggcctggtctacagagccagtttcaggacatccagggttacacagagaaaccctgtctcaaaaaattgagaaaaaggaagggaggaaaagagggagggaggcaggaagggaaactggaaacctctcagacaagatgagaaactacacaggtgatgcatgagcctctagctctagagagagggtaattagaaagcacccaccatctttgatcataataagcattttacccaattttttggcaaaaaagagaaaacccacgtcttgaaagaaatcagagcagacctaaaatatactgtttataaaaacatccattagtcaaacactaacaaacagaagatggctagttttcaaatacaactcaccagtgaaaaaggtcggctttaggacaagttacataggattgaaattgtcctctgaacatcaatgttagctttcctatgctccccggaacattccgttgccatcattttagagaatacacattgctttgactgggtacagagtcttaattttcttctttcctttccttggtgctactaaaaagcaaacagccaaggtaaggattgccaccctttgccccggtgggttaagggcaaacatcagtcaggactaggtgactcagtcaatgaagtttgtgctgagcaagcacgaggacctgagtttgtatccccaagacccacagggaaggctaactggggcaggcagagggaagaggaactcagtggccaacccgtctagccaattagtgagctttgggttcactaagagaacctgcctccaaacagcaaggtgaaagtaataggggaagacacctctggctccacacatatacacatacaactcactcacacatacaacacacacacacacacacacacacacacacacacaataaaataaagtcctttttaagaaaagaaaagcatggagagatggctcagccattaaaagttcttgcaactcttccagggaacaggagtttagttcccagcacccagcccaaatggcttataaaagcctgtatctctagctccagggtatccaacatcctcttctagcctctgcaggcacccctaacacttgtatactcatacacagatacacacatttgcataagtaacaaaataatacaaattaattaaagtgacaagcaagtggatggatttgaatacacttacactgtaggagaagggaaattgtggattaagaaaaaaaccaatcttcatggggtcccctgtgtggcagatgttgtactaaggatattacatgtattatctctcttaatccatacatccctgaaaattggtatatttataagaatattatttctatttcagagataaaagaattgaaaatcaagaggatttaccagttttcacaaatctgtcaattagtgcaagtaggagctgaacataggtcagttggagcaaaagcagctatgatcctcctcctagcccatgcaatatccgtgatgagaggggattccagtaccagacatgtactcattgtgggcttcaaatatatacccatgtttatgtgacctttctataagcactaccaacctgtaccctggtaataactgtcacacctgagggtcatgacccttgtgggtacttttcaactaactcttgtgaagtgaatattgcctctattatgagtactggtcttaagtcagtcttatgatctttactaccacaaccaccatcaggaccaaattgtatctttttcttctctgcaggttctactgcaatgccttgcagataactgaactgaaaagtaatgacctgaactgaattgtcaggagttacaaaactaggtagctgagtcctcattgtctttcacacaaatagttactgagcctcaagtttgtgcttggtggtattatgattacatcctagtgacattattgtgttatttcatgtttttccaatatctttctattttaggacttgggtgaggttgtttttgtttttgttattattgacaagacagagtcacactcagtagcacaggctggcctgcagctcatcatgtaactcaggctggctttgaactcagtattcctcctgtcttgccttcccaagtgttgagattatagtggtagccactataactggatcagtatcttttaaatagaaaataaaatcctatttcttgttacatcatagtagatacctataaacatagacacaatagaattttataccttgaaacattgctatttggagagaaaagtagtaaccacaaacataggtagtccttccttctagtggtgacttcctcattagggaggtggaaaaagagcattttatcccagaatcctttcaatcatgaaggttcgattctcgaagtggggaggccttgctagtggggagaagagattggggatctgaaacttcaagtcatcttgtgatttcactccctttcctgctcaggactcctcctgctttaggtaaaggttctgagaaccactgccccgagtcatttaatctacagattcctgatcctgtccttcttctccatgcagctattgccaagtggccattctggtagttaagatatgcagatccttggggatataattaaggagccactgagatgcttccatcaaagcacagctcatcctcggcagccaactgctgtttgtgcgggttaaatgcttaacagtcctttcatgtcccagagtcaatctgtgtttaaaggatggaggtgagtgggcaggacggggcagtttatggtctctgcctcctcgtttattatcacactgatgtttcacgggcactacctcaactgatggaaaccaagggccacatatcaccccagttattgggatgaagggtaaaatacattctttgttcactttttataaaagtatttaaaataatcatggcaataaatctgattttaaaaaaataccccaaaatagaattggcttcctcaagagcaaaattactatgggtttggctccccagagcagttgtgggcatttttccaatgtacagttttcctatgtacaaatattcctttttagacatttcatcagtctatgaatattcttagttctgaggtcagcttatagaaccgtgtcagtctgcaaactctgcctgcagcctgcatacctgctcttgatttcacatggggaatagtgggttatcaccagggtgagttcagctctgttctgctccctgacataaggccataaccctctaaaatacttcagcataaagatggcccaggaaaataccattcattcaaatcatgctttctctctgtcccacctgaacttcaacacaattaaaatgtatgatgtgctcattgtgttcctatagggtcagtgtaagtagtcataaaaagtatggcttaaaggcagactgggtaggatggttcagaggcagaacctgtgcttagcatgcacaaggccctggatttacctctcagcaccaagaaacaaaaggaaacacacacacacacacacacacacacacacacacacacacacacacacactatatagtgacagaggcaggtaaacactcaggcagatggagtagcaaaactgcaagtttcaaagaaaccctgaagaatattttaaataccagaaatcaggccgcaagcatcacacaaggacaaaaacagcaagtagcttttttctttaaaaaaaaaaaaaaatccatcgagaagacatgacaagttttgacattgagtaaaaaatgacataaatgtgacaacctcagacccttaccacagaaaacttgaagcagaaccctgtgccagagagacagatggaatgcatcattccaccccagcatcctaaaatacatggggcttttgcacaccatccctctgaaccatgagagtaacatcatttaacacagccattaaatgcaagagccataacatgcataacaaccatgtgtaggtgatagcagcctgccagaaaaacacccaggacatctcagactctgctggcagactgaacaaagacagagctgtacaagcctcccacacagagctgaaaaactgagtgatccacctaaagcaattgaggaaagatgacaagcgccaacttaacatcgttcagtaagctcacggtcaggaataactcagctgagaatggcaatctctgtgcccacagattgagcataggcaaaaagtacagatggaggggtacagaagacaatgggggaggcctaagtgatcggtttcagaacaagacatgcctcttctaggggtctccaaaatagagcatttttgctgaaatgaaatgttatctgtgaacaagccatcccagcccaagacagcatgaactaacaaagcctgaaggccagtgaggccacctcctcaccctgctttattatctgtggccactgttgctatgacaacttttctgaggctttattggggacccagaaaatccccacaggcagcggttttgtctataggacatgaaggagctggtcagtttggtggaggttaaatggtcaggtcatctcacaagcttactttggaatcctccatccctagttttaaaaaattgtctgaaatattcacttaaattgtcccaaaagtacacagacacttctttattaaccttaatataataattccacagaaccccaaagactgacctttctgattcctagtctcgaaatgtaactttctcctgtcttaacatggacatcccaagtggaaagaggatttggttttttgggttttgtttgtttttttggttattgtggatgtttcaactacttggtattcaaccttatgagaagggggcctttggagcagaaaaccaaataaaacacagagatcagaaagtccctgtggcattatcacttcatggtcaaagacaaacagtcaaagtagaacagggagtgaagaatttctccttgttgccccattctgtcaagagccgtgccgactccccttagtgattatttattttccactttccctacgtggttctcataataattactaactttgtgagatgtcagaacatggccacttaagcaaagcaaagtgcctttcaacatttatgaagtgctgattctctataaatacaggagagcgctaatcaccggagtacccgttggcacggcagatcaatactgaagatgaacactcctctttcattgaaattcagaaggcaaaaaaatccatccatttgttatctttctgataaactagcatttctgtgacttgccgaataaaatttaagatcagagctatctcagagactcgaaaatatctaagaaaagaatcgtgggtcaacctggtctatgtcctctccttgtatagctctatatatagatatatgtgcacgaacacctttggagagagatagtggtagcaacactgtcactcaccttgtgatcgcttataaaataaaatcatccattgtgagtagcctgtagcattaaatagctgcgatgcgcatcacaaaatgcctggaagcgcagataagcttcaatggtgatctggtgaatattaagtgtaaattgtgtttctgctttaggggggacacttcctttccgggaagccagcggcacttataggagaccacaattcaggggggatgcttagtctggatccaaagcttctagaaggaccgaagatggatggtgaagctcatttgtccattcaaatcttgtcaagcttgcctatatccctagcaaaggccagatatctgcaagccacaaactaagggccacgccagtggaggttctgcctgtctttcaaacagattgaacaccagttccattttagcttctcacagctccaaagtggctcactggccctcctctcatcagatttggatatcttaatggatcaaggctctaactactgtccagaaggctctgattatacgtgtgtgatgtaggtctctataatataccatgtgatggctacttctaatggccaataccacacaatctagaacctgctgggaatagtctccctgaggaattgtctggattagggaggcctgtgcccacgcctgtcagaggttttctcaaatgggttcatggaggtgggaagacctatcctgaaataggcactgattcatgggctgggcccagggctgaaagaaaaggggacctcatgctgaacactggaatgcacacataaattcattgctctccattcttattgtggatgtaatgtgcatagcttcttcaagttaccactaccttcacttctcaatggtgaggggctgtggcctgaccatatgggaaaaagaaacacttttccctcaaattgtttgtgtcagagtattttatcatagtaaccgaaacaaagcctgggtaaactagatgggggggggcacactgattcaaactgtccatcctggagtcctctgtacctcaatttgcttgactgtaaaatggaggtcagtgtactggctttatgcatagcctgggaggatgaagtaaactgacagctctgagcacctcagcaacacctaaaatgaacagaccttgataacagctcaggttgaaccaaacacctgctaatgtccaatacttcaggagtttaggggcctctgattttacatgacttacatagtctgttcaaaaggacattcatccttccatattcccctccttaagaaaagtccaacctgccatacaataagctattaattgcataagtctttccaagatacttatcataattaatttcttaatccatctggacaaatattttttagagattgttaactccaacttgaaaaggaaatgctggagtctggaggcgcagatcagttggaaagtagcatatacaatgccctgagctcaactctcagcagcacatcaagctagacctagtgggtggcacatgcctctaagcactcaggaggtggaggctgtaggattagaagttcaaggccatctctagctacatactgagtttgaaactagactcagatacatggtgccctgtctgaaagaaaaagaaatggagaggaaagacaaagagggagagagggagagagccagaaagaaaagatgaaacaccaaccttccaatgtataacctaattagaaataataacaatagtaaatattgaccttttatggagtattcactgcctgctaggcatgttgttaagcacctgaaatcgctatttcatttaatctttagaaacatcacaaaaaaagtggttgctagcccttccagctcatagacaagagagggaaggactgactcacctaagatcatgcacgtagacatgtaggagaataacacttgcagctgtgacaaacacaccctgaatcttaacggctcgacaacagctttgctgcttgtgtgtcagcctgctgcaggagtgggacgatgacgaggctatgctacataatacatgagagggccaaagttccttcagtcttcttagacttcttccaagtcttcctccaactcctctcccttcatctgactgggggttcgggggtgggggagcaaggatctcacatgtgtttctattccaggcgccatggtagttaagactgtttctgggttcattccaagggccctatcatgtcatgtaccactgacatctcaaggatgggatggaatggagccatccttgacactctcagcgtcaagattcacggccaggaaacagcagagccgggacctgaacacccaggctcacgagaccttcgtctctcctactacactattcctatcttgcattagccttgcagatttccccgaagcaccctgccagctgccttctcaacagcttgttaagactctctcactccagctaaagttgtacttgtgaatttttttgaaaagtttttatatatacctagttgtatttaactatcttgacatggtttgctgatctccccaagaaaagttaaaagcactgtatgactcacactgagctacctccatcttcatctgctttccagcccataaatatggatcatgtctacccaagatgatgtctcttcaaagtctatatcagaaacagtactgctctatttaatttaaatttgtgactaccaagattgacttatgcttaatcatttttatgtatctattaattgcattcttatttttcaactaaggaaataagaggagaggtggatggctcatgtcatctgtaatgtgataaacatgagaaaaatgttaaaaatgatattcaaagtaatgtggtgccatagtcataaataattgataaaagagatatgcaaaattattctaaatctatgaaggtctatggaatgattaagcattaaaacagtcttggtcataaataaagacacacatagaagctaggcaaacactcaaggatgatgtaagtcttgaatctgactggttaattctgaatcttgggcaacacactgccaaaaatccattcagtaaagccatcatcaattcctaaccataaaggcttcacgctcagtgataaagatgaaaagcttattggcatcattattcccaatttccaaatattttcagctttctacttgcctaacaaaggtgagttcagttccctaccttccttgaaattagaatagtcacatatgacttgctggggcttatggaacatgagagaatgtaactattgttatgctcaggcagatttaagagcaagcatatgatatgctccaatctcattttcctttgataatggattttaaaaaatggctataaattctctgaggcttctcccatcaagaactagaaggtgttccctccccttttctgagctagcccacaggaagctttgacacctgactcacttggaacaatgttggcatgtactccaggccaggttagattccattaaagatgaaacagcagatgttgggggagagcctgctctcccagggagccctcatcacatgagtgaggcaaactagcgccaaacaattagctgccaacccatcaagtcactgaatatatgtgagtgctcagacacagcagttgcccagctaaatgcaagccaagctacaaaaatagttaataaatgaatggttattttcattgctattagaatagaaacttgtttgttacacaacaacagttaactgagatgtcagcctagtcaactaactatatatagagtgtatgtggcatccggtagcctgggtctcctagcccatgataactgtagtaagagcatggagaaataacccattgttaattaagacactgagagttatttttcatttcttctctctgtctctctgcctctgtctcttcctctgtgtgtgtgtacagacactgccagaaatcaaccttgctttttggagacagagactctctctggcccgaaacttcccaggctactcaggctggcactgagccccaagaatctcccagtctcttcttcctgagtacagacaaaccattgcgcctgttgttttacatgggtcctgggacttgaactcagctcctcatgcttacatgataggcagtttactgtctgagataacttctttttactacataaccttgtccttcctgacaaattcagaacttggcaccaagaagaatgctactgtaacaacagaaaactgaattgaaggttacataatggatagacaggaaattgctttcagaaacttcaatgttggcaacatttatttcactactacacagtatttggcaaaatgttcgcctgtgctatatactttgatgagaatgtcccccaatgctcatgtgttggaatcctggcccctgttggggtgtgctgctggaaaggtggaatccttagtgggcaaggcattgtggaaggtctttagctcattagggagtggccttgaatgtttctttgcaccttttggcataccataccagcagtggggtgattggttttattctgctgcacattctccaccatggtgtggcccaaataatagggccagctgtttgcagaccaaaacccctaaaactaagagtcatttctacactgtttatctctaatatcatatgactgaaagttgactcatggtctgtgaaaactcagaaggcagaaaacatgaaatagtgtgctattctaaggaaatgttgggaagatgacaaggaagtcctttagccaccctacaaaggacaatcagcatgattgaaacatagaaacagtgcttatgacatggctggctattaccaaaagcatattaccacacagcctatgagccattcctagcactaaagtgggagagggcgccacaccactgctgtgccatggcctgtggaggatgtacaccgccaatgtgagcataggaaatgctggaataagagaaggcactgggctttggaacggtaggaaatgggaccagatgccaaacattcagacttctcgccaatgaaggagatgctggtcgccttggtcctccagaaaaggagcttcctactggaagcctaagaagagcaggtttggagtttccttctcctctcataattcttttctttttaaggttttgcaatcttccaaaccttttgtgaaaattttgcaaaaccattgtgaaattccctctgcggttcctcactctggctcttgttttgtttaattagcaaagcaatgatcttcatccatacttggacttgaatggtccccccttcttatcttgccctgtcattctgcacgtgcaccatgccacccccagtgttcccttttgcactatcataacacatatattctcttattcttccacattcccacactcctccttaagaccatattttctttttttctattttttatttaaattaaaaacaagcttgttttacatgttaatccagttccctctccctcccctcctcccctgcccctcactagccccctatgtcatttcctttctgctccccagggaggatgaagccttccatggggggagtcttcaaagtctgtcacatcatttggagcagggcctaggccctccccatggtctcatggtctcctttctgatatcattaactatatacacactcattccaggggcataaatgcacatatatggaaattataagctaagaccctcatatgagggaaaatatgccacatttgtctctctgagcttgggttacctcccttaatattttatttatcagttccatacattttcctgaaattttcataacatcatttttctttatggctgaataaagtcccttcatgtctatgttccacatttttatcatccaatcatctgtttatagacatctaggatgattggatttccttcttctttacaatagagcagtaataaccacagatgtgtatctctgtggtaggatgaagtccttcggtccatgcccaggagtgacatagctgggtcatatggttacagcttttgtttgttgagaaatttccactgatttccatagtgactgctgttgtttgtatgcccccggcagtgaagtgttcctcctccccacatcagctgggaagtctgtgtgtgtgtgtgtgtgtgtgtgtgtgtgtgtgtgtgtgtgtgtgtgtgtgtgtttcatacaggcctctcgaggttataatccaatattctttatataagctaaaggatctaattatcttcctaccatcaaaatgggctctgaattcaacttcaaagacaaataaggtggagctgtgaactctggccagtttttcctgaaattgtgtcttaggttctgtttcttgcccagggtaaatgacactgatgaccatttcatctctgtgaagtagttgttggtcatgaactatatggcccacagttagctcctgagctgttcctgatggtgaccagagacaaaaaggctccactctgaatcttcctattccatgtcagtggcaactcttcaggaaacacagctcagaaagaaaaagagtcctgctacaattctctttatcaatatgcaagatgggtgcaatcaagcacacgcttaggggattatgtaactttgacttttagcattacttttattgggatttgagtacattttggggggaaacatgatttttgcaagacagcaggacagagaaaaactagttttaaaatgttttttatactgattcttcaagctttcccgatgtttttatagacctgacctccactcaacctttcttcctcctgtaactgcatccaccatacttaaagtgtgcaaaagaaggcttagatatcagcaggcactgcaggtgggggactgagatttgagtgcgattgataacaggcgtcagataaatctcaaccaagggaatgagtctgccccttcacaagctgcaggctcatacatgcccacatctgggattgatagatgtaagctgctgcttcatacacaccaaggtgacccctttcactcagcctgccatggcagtgattcctgaataaatgttcccagcagagaaagaagtgcaagaagtgattctagcaagccagactcattgtcgagccagcatctctgagctcgggtgactgcaccagagcccaggacttcatcagttacacttcaaacagcccaggacttcatcagtggaatttcatacaagcacggatttccccacagaagctctgctgattctcgtggaaaccagcatcccaatactaaagtcaggcaggcaactaataaagtaactactcctaaccccaaaaggcattaatcttggctcaagaaagggaaggggtcaagagtaaaacaacagggatggggatatagctcattaagtaaagtacctgctacagcatgaataactgattgccttccccagtacccatgtaaaatgccaggtgtagtgatgcagtacactgtaatcccagtgcctgggaggcataaataggtgcattcctggagttcactacctctttgcttaccctaatctgcagatcccagggaaagaccctatctcaaaaaaaaaaaaaagtaaaataatgatgatgaggctatcgcacgcatacacacacacacacacacacacacacacacacacacacacacacacacggtataaagcagagatgcccaagagaggacaagagtaacactccagaagaagtaagagcagaatgggcaatgctaaactatcgatcatttaactggagcagagttaaattagtgaaaatttgtggtgtttagaattgaaaagcttctgggtttttcccccaacaaaaacagacactcacagagaatcctaataatatgctttcttacagagtgtgtcctttgggttgaatcattctttttagtaagatctgtcagctgagagatgtggggttttctgatgctgcataattatcaacctgtgaatatatgattctgttatttatcatagcctttagaaatgtaaagctgaaataattttttggcactttgattcattccataggtatccttgaaatgtaaatatacagcccaatctatgccaccacctccaaactcaataatatagtaattccaagccatccacctttggagactctatgaacaaaagatattcccattatgactcctaaaacaaaactgtagctgacagtcaaaaggcctggaaggccataaaagggggagatggggtgctttagttcctaactgatgcagctactggcagttgacagagcttttaagaggtgggtcttgatagaagaagttaagccactggggatacatcattgaagaagtactgggaccccagcctccagagtacacagcaattccagtccccattttcttaaggactgagcaggcagtttgaatctcattcctttgagttcttcaagcactggtacttgcagcaagctaaccctagatctaaacagtatcgatgatttgagatgcaggcaagggtgttactacaccaggaagctcaagtcagtctgtctcagcaggttttcaaggatgcctgatgacgtggagttctattaagagcctagccctgggagcaaatcttctatgtgtatatcgcgtaggaatgtttatcaaaaccaaaatagatttcaacctatccttatgagaaaggtaatcactatttgccttctggatccagagaagggggtggagtaagctagtcacctcccctgaaaactcaggagctggcagagggctggaaaatgggaggagggaaggcagtaagataattagaaaatcaacacaaaactatactggtttgttagctgaggggctgtccttagcatctagatgttttaaggagattccaaattggcagcttctcatatgagagtgctgcaggaaagatgagaaactactaggccttttatttgcttacagtagaaacaattgaagagaggctaaggagggattcaataaagttcttgctgcacaagaacaaggacatgagttcaaatccccatcacctacataaaaagctggattaggctgacaaagaaggctccatagtgtttgctggccagccagcctaacctaatcaagcaagcccaggtcccagtaaaataccttgcctcaaaacagaggttggagaaacatttacttctggcttccacattcgtgtgcatacacacacacacacacacacacacacacacacacacacgcacgcatgcatgcgtgcgtgtgtgtgtgtgtgcgcgtgcacgcatgcatgcgtgcacgcgcacacacacacacacagagagagagagagagagagagagacagagagacagagagagaaagagggagagagagatcctaagggtaaaaaaacattcagtgtctctctctttctttctttctttctttctttctttctttctctctctcttctctctctctctctctctctctctcactgtgtgtgtgtgtgtgtgcgtgcatgcatgcatgcgtgcatgtgtgtgtgtgtgtgtgtgtgtgtgtgtgtgtgtgtgtgtgtgtgtaagagaagtcacacctgataatactgaatagattggagtaaaaataaagaaaatatctgggcatggtaatgcatgtctttaatccaagtattcaggatgcagaggcaggtagatctctacgagttcaaagtcagtctggtctacattgtcaattccaggctagtcagagctacaaagtataaaaacaaacaaagaagacaactccagataaacagtctatcttgcatttcataaagcatatgccttttaccgctggagggatttgaggtcaaggttatatgaaagtgtgaactatccctgcctctcctcaggatcacagctagaacatagaaggcttagcagagggacagcagagggaatgcttacagtattgctgtattatactacagcatgaattcttcactaccatctaagagggaggccttgatctgagtgcttagactccctaatggtttcaaagggcaaaaggaaattatttattttatgatattccagctgtcctataattgactacaacaatacatcagtttggacctgattataattctacctatcacatctgtatctagttgcataggaaggccaggtacacaatggaagagacctaagaccctaagtcaccacacacagggctattgtacgctaagcccctgaagtcttgcacataatttttgtataggtttgtggaattatcctggaaagaattacttggcctcttacccaaagctctaaaaaccactgctggcactaaaactgtggcactggacatttgtttggttaatcagctcttcaaatgcaaattctccttggaaagttagggtattttcacacctttctcagagtctcagtgagcctgctcagtgcctgctgagagggaaaggcttccactggcagcctcactctagctttatttccatggccctgggacaggtgaaaaagacactcacccttgtcagcagatgctggcaggggtcgtctgtggcccatctcagcagtgtgagacttcctcctcacagcagcctttctcaggtttcctttcagccctgagaagagagggtgccggaaaagccagggacagatcatgagctggagcacccaactgctgagttcaactagaacattccaaatagagcttgaaaaggaagtttgttttcatcaaattcctccctatgaaatgtgatgtttgacagtgactatagaaaaaaaattaactctccatcattttagatgattttgaccttttgatgtagattgttcaattgacaactttatctgtggatttataacgcaatattgaatactgcaattttactgaatccaatccattaaaacgtgtctcttttttcaaatatacattagcataaatttgcaaatagttctctattgggttaaactattttttactgtgaggttgtatatctacatcccaatttataggaatttttatttcataaaattatgacccttataagctaaataaaaaaaatctgacaattcaaatttttcaacattttcattattcataaaaatcccaaagcctagagctaatacaataatatgaattaacttatcagcttaatttccacttataggagtttttaaaggggctgcaaagatggctaagtgggtaagaacactcactgcacaagcataaggagctgatttcacatccccaacacccatataaaagtctgggtgtgcttgcacacacacacacacacacacacacacacacacacacacatgaaaccctaacactgtaggagggtggtgagaaaagaatcactgggacttgctggctgccagcctagctccaggctcagcaagtgaccctgtctagagggaataaggcaaaaggcaataacacatgacacgtgatgtcctcatctgatctctacacacacatagatggtgttagttgttatgccccaattaactaattaaagaaagacatgggcaataagaaaggataggtgccagagctatcctgagtctggaacactgtgggaacgttgctgtcttagtctgttttctgctgctgaaactggaaaagctatacagagctaaagttatttttcatagttctagaggctgtgagtttaagataaagacaccagtctctggtgtgggtctctgctgcatcctcgcatggcagaaggtagaaagatgaaagttatcaaaatcattccagaaagtcctttccatgacagctttagtccatacaggagcccttctgacccaagcccccatcaagctctcattcccatcactgtggcagtgaggtattaaggtcccaacacaggaatttagggtgacatattaaatctgagtctcatgaggcagctctctgggtaaagagcctggtcaccaaacctgatgacctgagacccacatggggagaaggagagaactgactcccacaagttgtcctctgacttccacatgtgcactgtggcacagacatgcttgccatagacacatacatgcctgcacatgaataaataaataaataacatttttaattaaaaatgaagaggttcacataattagaacattcttgcagagcaatgaaagatgtagagatgtgggtaccaacagaagatgggaggtcccccaaacacattctgattcttctttcagggttactaatgacctgtcctgcctgccagtatctgcctgtgaaaataactgtacaagagtgttaaaaactcccgttgcaaaaacttggctggttttatgtaaaattaacagttgtttattgtcttaaatgtttgtttatacagaatttttcaagttttttgactttatttataggaattctgccactctgaaaacactttattatctgcaaataaagagataactgtcttaaaatacgcatcccagtttgtctattaaacaaatcctagagaaaccactaggctcaccctcacagttaatggaggcccagtgttctggccacatggcgtagaagttcccactgtatgccttcctgcgtgcattccaaatactgcatcaactgtccctctactccttcagcaaatattaatttagaatgagctaggtcttccaattctatctcattcaactggctgatacacacatcagtcaaagagtatgttggattgttaaatatcaaggccatatttatgttaaatgggaaatgtgtctttaaatttctgaaaacggggcagaaagatgactcagcagttaatagcacttattgttcttgcaaagtacataaatgttcagttcctagcatccacactgggtcattcattcaaccgcttgtaaactccggctacaggtgcaccaacatgcacttttggcctctaagggcacctgcactcacgtgcacatgcccacacatagactcaaacataagcacataattaaaaataatataaatctttaaatttctggaagttctgaagcactttggctctctctctctctctctctctctctctctctctctctctctaatctttggatatgggtctctgcatcttttctaaccatctgaactgtgcccatcagtttgaaaagtgaccagtcaccctgaagttgaaatctctctggaccactcattgcctttggcttaaaacaaagaaagcctcattctgtaactatgtaaaatgatttttctaataaaaacaaaacacctatctatgtcaaaggaatattggaaggatgactagataatgccttccaagttgcttttaaacggtgctgtggaaatagaagacactgtcacaactgtcattttgttacttttttttttaatcgtggagaagctagtattacatttaaaaaaatcagaaaagtcgattttcttaaagcaaccatttggaggcctaaaaaatatctgtgctagatgagcctttttgttctaggttcctatccctgtgtttcccaccaagttcaagcccatgactcctgaattttctgtagccaaggacaatgagaagaaccaagatatgcaacggaaataaataaccagaaggcatcagaggaccaaggtgcagaagcctatcacaagagatatttgacagctcataattcaacctctttgctcttctagcagaagattcggcttaaagaattgaagcagccttccaaacattacacaggcagttagaaaacaagtgccatcatataaccaaatgagtgggaaaggcatgaaaaaagtcaccaacactgttccataatcagcctcatcagttccataacatgcctcacgttcaagttcatgaagaagggggcctaggtcctgggtccccacagcagaggatgacagtgactggatgccttctggcatgagtccaactctgtcccaatccatttctgttactgcaataaaaataccctgacaaaaagcagattgggggaggaaggggtctgttttagctcacaattcattgctacggggaattcacagcatcatagactctgtcacagcatcatgtgacagctggtcacattacagccacagctaatgacagagagagtatgttctctgagctgtgaaagatgtgagcaggacctattcactgtagagttattgagaggatggaaggagactatacagtgtttagcagaatggaatgataatcattgcttttaatgtccctagataagaaaattaaacaagaaagtacaaataaagcatttgtcaaatggcctggcatcataataagagctcaacaaatattgggaaatattattacagcacactctcacacaagcattcatgtaataagtatttgttaaatttatgaaactcttaccagttgcaggaactatgttctctggggcaaggctgtattcatggaactccacttgttcatggtcaaatagaggatgaagacatgcatccaaatcaatgtcctatgccaaaggtgggcaggtggagcctacatgccaactccattggtatttttatgactggcttttatagttttcaatgtttaaaagaaaaaataaaatgagaaagaatatttcatgccgtacacagtgtatatgaaacccaaattttagagtccataattaaatgttattggagcccagccaggcttcttcatttgcatattgcctgtgactgtttcaccccatgacagccaagtggaatggttgtagcaaagaacatatggacagcaaaatctgaagtgtttacgatctggttttttacataatagtctgcaaccctgttctgtttcttggtaaacattataatacagctgtgtcctgcaggctactatagaagttccaggtaaggggtaggagataggtaactgtgccttggaatataggggagacactgccaaggagctaagttataaagaatgaggagagctttatctgatggaaaaggagacccagaatctttacagagcaaagcagggtcaggaaaatagaagatgttcattgctttttcaaagtaaccctggcctaacaggctagcaagatcatcacatatattcctgatcttcaactgtctactaatctctgaggctttatctttaatgccagaacaattatcttctcccagaaaaaaaaaatcacatagaacttttgatccctctgaggttttttaagtttctgatggaaatgagacataatggccttgtttgaatatgttcctttctgtgtctgtgtccagtctcattagcatgtgtcacagaactaatctgtaagtgtgactggttctcactgcaggtcctaaaagcatgcgtggctaccaaggttaaggggcactgaggcatgcactccatcaataaaaaaccagctgaggaaagagtaaacaagacaaggacaggacttagcagaggctcaaaatgacactaggaagcatgagcagatagtgaaaagaggcaacacagatcattagaaggcacacttgaacatgcggggaaagcaaaaggcagatgcctcagtgccatcagtgatggaaccccttagcacagccttggattcacttgttggtagaaggccatgctcatagagttcagaggctgtaataaacttaagatcacttgacaaaactaaaaaacaccaaattcagttgtgggtcacagagacatacatgcaacacatactcacatgcatgctgatgtcttcttctctctaactaggaaggatcagctcggggtcaggtgacttcccaggacagctcaatcctttagctgccacaacaacacagcaatttaccccagttctgccaagtgcccccaaacagcattattcattctcccaggaaaggggccttctccatgaggaggtactatggtgatactcatgacgcttagctaagttagggtttctattgctgtgaagagacaccatggatacagagtcctttataaaggaaaacatttaattagagctggcttacaggttcagaggtttggttcattgtcgtcatgtggaaagcaaagcagcatgaaggcagacatggtgctggagaaggagatgggcaggtagtaggaaaataagtgatactggccctgggttgagcatctgaaacctcaaagcccacccacagtaacctactccagcttcctggataccctctaggcatgtctacaatggacagggaagtaaatggacgattcctcttgatagttcctatggtttgtgtcatttctattttgggggtagtacagttaaacaaatccgactttagcttctaaccatgagttcagaaagactgcacatgggaggaaaatgcaagtcacaaacagcccataatactcagagtattcctacgggctcctgactcagtccctttcatgcttgcctatgctttgctgaagatgaatgccatcatagagttctcctcagtgactctgcagtagatgttagtggacatcctaaaccaggtcttcagagaggcccagacttgccctcccagcagcaggagacaccagagtacttccctgggaggctgcattgcccaggaggacatgcatctcagccacctagcttgtgcttcattagccgtgctgggcatgcctgaactgcattctgaagcaagccaacatcccagcaacagccatattcgaatatcacctactgagtgaccctagaataaaagaaattgtatggtttggatggctgggatcaaaattgaatctgtactgcatatttatagtcctcccaccaatatccacaccataaatcaaactctagctctttgttgaaatgctttcaggtagcaagtaccttcacgttatgctcgtcaccccaaaacagtgtattttcttacatttcaagccaggagcagcaaaccattcaactaaataagggaacactcataatgcaacaaatgttctccacggtgcctaactcctataaaagctgaatgaaaatacatatccttgccctcaatagaaagaacgagcagaggctttgtttttcttttttaaagacagaggggcccacttataacctctctcacaatcacaatcgaaaaatgacctgctctttgtaaagaataaccacatgagctggggtgtagctcggtggtagagcaagcactcaccatgcaggaggcaccagctcccatctccagcaccaaaaagagaagtcaaatgaacaaaaactacaaaggaagccccttcaatcaaaataggacattgttattttcatatttatgcgtgtgtcaacagtattcagaagcttacacaataaataacatcgcctgccctaaggacctttaccatcaaaagtattgataaaacaaggaggaagcctgcagctgcagctgtgaagaaatgggagccagaggtgggaagcctcaggcagttgtgagctgccacaggtttgaggactctgaaaaaaaagctgttgtgatgagcaggataaagacagtggtgtagaagagaaaagaacagcaagcatttgttgccagtgtccccttccaacaaccttgagctgaggctgctgcaagccagtcaggtggtaagtgggtgtggtcccataggtgacactgagaggtgactgtgtgtggtttggagccaagtccttaatcacttatataatcgccaggttcctaggctataacatgggttaacaatagctatacccactcacctagactccctcacctccaaactgattaaatagaaaaatgaagacagtacagtgctgagataactctctctctctctctctctctctctctctctctctctctctgccattgtgtgtgtgttgtctgtgtgtctctgtatgtagggtgtttgtgtgagttcatatttgtatgaaggtacgtgcgtatatgctttgtacacacacatgtggaagctaaaggtcaacctgtggtatcattcatcaagaactaccctccttccctgtacaataaaaaaacttctagaggcatcaccatccctgacttcacgctctactatagagccatagtcctgaaaacagctgggtattggcacaaaaacagacaggtagaccaatggaatagaattgaaaaccctgatattaacccacacacccatgaacacctgatttttgacaaagaagctaaaattatacagtggaaaaaagaaagcatcttcaacaaatggtgctggcgtaactggatgctgtcatgtagaagattgcagatagatccatgtctatcaccatgcacaaaactcaaaacttaagtccaaatggatcaaagacctcaacataaatccagccacactaaatctcttagaaaaaaaaagttggaagtacccttgaacaatttggtgcaggagactgtttcctgaacataacaccagtagcacagatactgagattgacaattaataaatgggacctcctgaaactgagaagcttctgtaaggcaaaggacacggtcaacaagacaaaaacggcagcccacagactgggaaaagatattcaccaaccccacatctgacagaggcctgatttccaaaagaaaagaactcaagaagatagtcaccaaaacaccaaataatccaattaaaaagtggggtacagacctaaatagagaactctcaatagaggagtctaaaatggctgaaagacacttaaggaagtgttcaacatccttagccatcagggaaatgcaaatcaaaacaactctgagataccatcttactcctgtcagaatggctaaaatcaaaaacaccaatggcagtttatgctggagaagatatggagaaatgggatcactccactgctgttgtacagccactttggaaatcagtatggagattcctcaggaaaatgggaatcagtctacctcaagatccagcaattctactcttaggtatatacccaaaagaagcacattcatacaacaaggacatctattcaaccatgttcatagcaacattatttgtaatagccagaacctggaagccacctagatgcccctcaactgaagaatggatggagaaaatgtggtacatttacacaatagagtaccactcagcagacaaaaaacaatggaatcttgaaattctcgggcaaatggagggaactagaaaaaaacatcctgagtgaggtaacccaatcacaaaatgacaaacatgatatgtactcactcatatatggattttatacatgaagcaaaggattaccagcctacaatccacaccaccagaaaagctaggaaacaagaaggaccctaagagagacatacatggtcccctagagaagagaaaagggacaagctctcctgagcaaattgggatcatggggggaggggaaagggaactaggagaatgataatgggagatgaggagggatgaggaagacatgatgggacagggaggttgagttgggggaagaacggaagagagcaagataaaaccccctataatagaggtagacattataggtttaaagaaaaatcaggcactagggaaatatccagagatcgacaaggatgataccaactaacaatctaagtaatagtggagaggctaacttaaatgcccttctccaagaagctgatggaaacagaagcagacacccacagctaaacactgaactgaactctggaatccagttacagagagagagaagtgatgagcaaagggatcaagaccaggcaggagaaacccacagaaacagctgacctgaaaaagggggagctcatggaccccagcctgataactgggaaaccagcataggactgattcagaccccttgaacatgggtgtcagtgaggaggcctctgaaatctatggggcctctggtagtagatcagtgtttatccctaccttacgaatggactttggaagcccattccacaaagagggatattctctcagcctaggcacatggaagagggtctaggccctcctccaaatgatgacagactctgaagttccccccttggaaggcctcaccctccctggagagcagaaagtgtatgggatagggagttagtgaggggcaggggaggaggggagggagagggaactgggattgacatgtaaaacaatctcatttctaatttaaattaaaaaatttaaaaagaaccactcaccttcttttgtttgggggggttgtttgtttgttttggtttttgtttgtttgtttgtttgtttgtttttgaaacagggcatcattagcctagcacttactgagcagacaaagctggccgacaagcagggcccaggagtctgcctgttgtctccaggtccccagaactgagatgataagtacatgccacacctagcatttcaacatggtttcccgggactggatatatgtcttagcacatcattgactgggttatctcccaatcctctatttttcaaagttctgaataaatctaatctacaatctcttaaataaatattccttcctttatcttccaccaaagaagtggtagaatgtacggtgagtaagcctcataacacccaagtgtcttgaggtcagcacagcaaaagttatctgctaactctgggatcagtttgtttgtttgttttttcattcaaaacaaaaatgttggcctaaactatcttgggctaaatataaagatctgacacatccttaaataattctctggctctgagtttaaagccataggttgttaaataaatcacatttgttgccaaaaaatagactagtaccatatgggccttcttgctgtctgtaacctggattcggtgttgccataaatcatgttatgtctcctgagatacagctgacatcagattggagtgggtgtgtttgtctcattctctatggttgctacaagaaggggccagtgtctttcttacagttcagcaccaatcccaacaactctggatgctctttattctgtatgtcacatgactgacacttttattgggtaaggatgggtgtcatccacaatcatctatctttagagaaatacttcaaggcctagacttatgaaatgatactccaaagtttttctaagttggtgcctccaaaataaaagatgcaatgcttgcctgaacaataaaaatgccattagaattccatgagtcagcacagtaaaaaatatatatatatatatatatatatatatatatatatttcatatatatatatatgaaaaagtgtttatcgaagaaaatatctagctttgggtggtcctaaaatctgaggttgtagctctgagggatacggtgtggtctcactgccatcggggccacacttatgctcattagctaagtgctagataacatctcaccaccctagtgtttgccagcattttgaaatctgacaacacagggtgatatggaacaggtatatgagatttacctaaaccccacttgtgttaagcaatcaagctattcacagaagtctcatttgtagatcacacggatacacttaggcagcaatatacagaatccgcaataagtgattgctactgactgcttgagctgcaggtttaaagatggcctcatctccctttcctttgacaaccagagccccattgatcttagctcatttctacagaattcctaggcctttggttgaatgtgctcctcctctcacctgtgaattaaattaaatgttctgacagctaaagtcagtgtcccatccaagagaagacaaacccttcctgccccattgtgcttctaatactgagttttgctcagttttagtggctgaagagtgtttcagttttttatatgcaacacataaaataaaaaagtctcatactaagcttaatcattgtaccaagccagcgagaaagcatgacaccatgaaagagtcggtgtgtaagttaggaaatacgggactccatcctgctccgatactgactaagaccgagatgactcgccagtgaagcaaaagatgggaaattcacctgtaggaccattgtgagtattaaatgaagtaatcgagaccatgcaaataagagacatgattctgttatctacccaatatcacatgagatactttttgggggaagggagatgactgaatgcatatagatagatagatagatattattgctaataaaaagtcctaatatacatacaggttatattttatcattataaagtaaacattagggctaggaagatggttgagtaagagcacttgctgtgaatgcaagaggacttgagttcaaatttccagcacccacataaaagctagacattgccatacacacctgtatcctcaacactgagggttagagacaagaagatcccaggagctggctgccggtcagtctaagagaaatgtgtagctcccagttcagagaggtccagagaaatagaggaagaccccctgatgacctattctggcctctgtgtgtgcacacaggcatacacaatatgacatgaataatcaaatgttagaattcagggggtctctggggaaaaaaataaaatggtagttaccaggggctggtggaaatgggaaattaggagttactgtttagtaataaattttacttttatgaggtaaaacatggataatggggatagctgagaaattttaaaaatgcatcgagacaactgaactgtcataactaagctgggaattagttgttttctgattgttatgacaatatttgacagaagcgactgaagaaaggaagggttgcttttgactcacgggttatgggtacagtcccttgtggtgacagaagcaaggtggtaagaggcaactgatcacattgcatctgcagggaggaggcagaggcagatggatgctggtgctcagctcctagtctcctttttatcaagtctgggaccccaggccatggaatagtgaggtccacatttatggtgggcctttgcacctcagccaacccaatctagaactcactcacagagataccaagaagatttgtctcctgagtagttctagatcttgcctagttgtcaatcaatattaaatatcacaataactcttacattttatgcatcttggcacaatgaagaaaattgggactaaaagactgcacagttgtgtgttctgtgccctgttttagccaagtagatgaaaaggagatctacccatattccactctaaagagtcacacgctggcacagcactgtgcctagaagcagggatacctgtttctcatttgcacaaagtatttttatggaccagctgtgaacatgatcacaaatatcccatcaagatctcagagaattcctaaaggtattatcttcccttttcctccaaattaggaaacagagacttaaaaaaagaaaaaaactaatatgaattgtctaaggaattgaggcctaaaacaggtcttaaaacaaattggccaacgaaatgtctaactcacagtagcaatgtaagggcaaaggaattctcaaggaagtgttgagcagagaaacactggatgacaagacaaagatttcacttagtactgttcatttctagcacagttcctgttaaaggggtgatgttataccaaggatctactgcagggttgggagtatagctgaacccctgggttccaatcctaacaccatgaagaccaggtgtggtgccacaatcctgtaattccagcacttggaaggtggagacaagatgatgagaaggccagtgtcatctctggctacacagtgagtctgagccaacctaggctacatgggatgctatctcaaaagaaaagaaaaagaactttagaaaaggaggcctaactatagatacgacataataacttctaatctatccatcataatactctgaatataagaggtgaagcagacatatagctaaataagcccagtgaaggattaagaggaatgaggatagaaatggaaaacaaacatggttttctaactcatatctggaagctgatggaggattcagataaatgctctcaaaagaatttccaggaagcttagagaccagctagcctggcatgaggagcagaaaacaacacaatgccccttccaaaataaggtggaaaacaaggacaaacacccaaagctgtcctcttacttctacactcacaacacacacacacacacacacacacacacacacacacacacacacacaacacatgcacaggcacaacacaccgcaatcatactcaaatgttaaaaagaaaaaggacttctggtaaatctctctggcctgggacaggatggagcagacaactatagcatctacatcttgcagaagagactcaaggaatcatagcagataaaaccctaaaaaccaaataaatgaataccccatgacccactgatgaaagaaaatgatcaagcatttgggaaagatgagacaagggacaacaagtagtcagaagggacttgagcaaacaacaaaaaagcaaaatatgtgggctctgttaatacactctaactacagatgtgttggttttatttaaaagggtaaggtcagatggaatgggagaatctgagcctgggttccagaagtcgttgagtgaaccaacaaagcatctgtacaaatgaatatccactttcacactaggatgtggtccaggagtgggtctctaggaccacagcttgcagcatgtcagctcaaggccttctaccacctatccttgtcacatccctcccatctgtcaatctatcaaacaaggcgatcaagtccaaggcctgccagaactcaagggaagagaaaaacagatcccacatccgtgacagagtggccatgttttagaaaattatgtgggttagaaaatacaacccttgccgtttatcattgtttgtggtttatataacttagcaaatattcttgcattttggtcatgttgtgtcaaatttcctttttgttttaaaatcagagtctcgatattgtagatctatctgccctcaaactcacaaagatccacctgtcctctgcctcccaagtactgggattaaaaaccagtgccaccacacccagttcaaatttcattctttttaaagctgaataatattccatgatgtggatgtaacacatatatacatttgtctgtcagtgagtatttgagttagtcccatcatctggctatggtaaggaaagctaaaatgaatatagggaacaaatgtcttttctgagtccctgttttcaattcttccagaaacacactcagtagaagttgctttttatcgtattcaacaaatgagggaatggctaaataaagtataagcaccctggtagtgtcttctgtagaggactcaagagcgcccatgctgctacgaaccttccctattgctggcatcccaccagctcttgcctctgccatagctcatgttcccccctgatgtcttccccttgtttcctagactagagctctgtcaggagacagattgtgtcttcagccccagttcctcaatacctggcatgcaatatgagcttagtaagtgttgactgagtaaaaaatagatgagctaggaatagaacagccgtaaaccacctggtactaaacttgattcagatgttattggctgcctatcaagaatatggacctacactatcatttaaggaacacaaaaggaaaaatcttaaaatggctagaaaaatcttagaagacatacgggtacagctagcacaagaggacaccacagtgggctgtgttcttttcatatttaatagccatggatgtggtgtgtaagcttctggagaagcctagactcttggcgggggcagggcaggtgagttctcaagtatcccataggcagattgttctgtttctactcaatgactgtgactacaaatacacaggtgtgataataatcgtaaactacaggtgtgatagtaaataaacatctaacattcaaaaaccctggacctaccagcagttaaatatatgtagccaaaatatacctaatctacttttaagtgtcaaaaaaatgaacttgaatgtcaggaaaatctaaatctagtttggtctagatcgtccctcttctcacttaatctctcatccacttcaaaggcgggacagatgtcactgtcacttcctacaagaagctttctacaggactggggagatggctcttctaaagaaccagggcctgcaccccagcagccacaacaggaagctcacaatttcctgtaactcagctccaggagatccgatgccctagtctcatccacaggaccctgtgctcacctgaatatacccccacacacagtcagaactttaagataaaatcgtatattttaaaagaagcttccattccctaccagcctgtgagacacacccagtctctctctctctctgatggctccctagatgcctttttcaattttgtgcgactcttttgaggatgtaactctttgagggcaaatgttatatgcaacaaataccacctagcatatctccattgaatagcaatgcaataaatatttgccaaatgtctctacaaataaagctaaatttaaaaacttgaaacattatgtgcacatgattagcacatgatgctaatcctagcacttgaagggatggagaattttgtggttgaggacagcctggacaattctccgtctcaaaataagttaactaagttacatacacatcttgaaaaattgtgtatgtaaatatataagcatgtacatgtatatgtaaatacacacacacacacacacacacacacacacacacacactcaccactgctgtttgaagggttgcccctccagatttcccgtgttgacagtcaccaatgtggcaggactgagaaggaagccttataggagctgacaaagttgtgagaccagagcccttgtgggtatgatcagagcccttatgaaagggcttgtctccttctgtcttgtgatgacagggtctgttcctcttgttcttctaccttgtaccacgtgaatagggaagcccttacaagacacaagccccagcatcttgatagagaatttccaagcttctagaacagtgaggaaataaggttttatacttttttctatatcattacacatattcattttatgtgtggtgtatgtacacatgtgggcatgaccacgacatgatgcatgtgtggaggtcagaggataatctaccaaagttggttctctccttccatcatatgggtgccaaggatggaatccaagtcctcagacatggtggcaagcacctttccccacttactctctttccaaccccaattttctgattcataaattacccagtcatatgaattttatacaagacaaactgtccctggtcagatgtgtgctggtcaaggaagcctcactgtgactttgacagcatctgttactgaccatctacttgctctgcccaacgacctgtcatatctcacccattaactcagttgaactcactgtggttttccatgctcatatagttacttctgcatttcacatcctgtttctgaacctcagcaacatttatatttaagtcatgttttacagatatcaaaagccatcattatgtttttattttaaagataatccctcaagacttaagagtactttgttttcgtggttgtctgtgctagaattacaaagagcaatttctaaagtcaggagggtcaatagctgtattaagaaagtgcctctttttttaaattatgcttttaaaatgtaaatgcattagaaattagaacaaagtcccagctcaaatctaaattgcattcacctcagatatagtctatgtgggcattgtaagatgcccatgcctatgctagaacagacttctccaaggaaagagctgagcccgtggaacacttctaagccctgagctaaaagtgaacaggaagcaaaagaacatggcatgtgattgtcactcagcctctcctgtagctcacaccccagcaaattgtgacatgaagagcctcaatgtttcttccaatgaacccctcacagggcctttagactgcaaaatatcagcagccttggtacagtggtgaccatgtggtgagagacacacctttgtgaacactgccactgagcatggcaatgatttcagtacctttggtatcaagggcacaggcttcagtgccttccagtcatcacatgaagacccacagacactagaccaatgcctcttggctaggcccagggatgtaacataatcttacatcttcagtggctagagactgctgtggacatttaatagaggagatattattgaagtttacatagtgcagatgtttcttagagctgttgagactattttgctgaatttgaggtgactggacttgtttgagaacaatgaaaagggtatacagaaatactgttccattcgtgttgttacactgacacatttcaaggcaacactggcctataaaatgttgccaaaaaacctaaagtttcaattgaataaaatcatttcacttacaaaaaatgattccttctcagaaaacagaagatcaagcaatcatcattattcctgtttaaatgaagctatctggaccttccggtggctgctcagagcctggggactgagcctgctgaggcctggggactgtgcacagaagaactgtcccagcagatcagccctcacaaagacagccagcatcctagtcctgcctccacccacgggaagaggaaagccatcagagtattgaacctgcttgcaaccaccagaagagacccttggaccccgtacccagcagcagagggggagacactaccagcacccactggagaaagggatgggaaaacaacagtataagaacagagccagcttggtattggcacaagaatagacagatagaccaatggaatcgaattgaagacctagatattaacccacgcacctacgaacaccttatttttgacaaaggtgctaaatccatacaatggaaaaaagatagcatcttcaacaaatggtgctggcacaattggattcagacatgcagaaaattgcagatagatccatacctgtcaccatgcacgaaacttaagtgcaaatggatcaaagatctctccataaactcagccacactgaatcttctagaagagaaagtgggaacaacccttgaacaaattggcacaggagaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaacaaggacatatgttcaaccatgttcatagcagcattgtttgtaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggagctacgagaatgagaagggaagaaaaggaaggatgcagaggtcatgagggagcagcaaggttgaggcaggtgtagattagaagacaggctatgtgataggtagggcttttagttgcaaagagtgggagggggggaagggagggagaagggaactgggattgtcatgtgattcaatcttgtttgtaattccaataaaaaataaaagagagagggagccattataggttcaatgagagatctgacactaggcagattttcagagatctataaggatgacacctactgacaatctaggctgacgactactttatatgccatcctagagccctcatccagtagttgatggaagcagacacagacacccacagctatacactgaactgaactctggaaacaagttgcagacaaggaggattgatgaatagttgcagggggtggtagaggaggaagggagggagaagggaactgggattgtcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggatgcaatgttgtttctaattgcaactaaaaaaacttcatacacataaaataagtaattaaaaataaaaaataacagagccaacagcaaaaagatccacatgaaggcaccagagtggactctacaccagcaagacctgaacatcctatcacagatgaagcagaagagaatgaccattaaaacaactttatgaagataatagagaccctcaacaagataatgagaaaatcccttaaagaagtggaagaaaaacaaaaaaaattcaggaaatggaggaaaatacaaaacaaaaattgcaagaaataaacaaatctcttaaagaaagcaatgaaagtcaagaaaaaaacaaccaaacaaatgaaggaaacaatgcaaacagtgcaaggcttgaaagctgaaatagaaaaaataaaaaagacacagtctgagggaatagaaaagattaggaactatggatgcaagaataacctacagaataaaagagatggaagtgagaatctcaggcattaaagatacactgggagaaatagattcattgaccaaaaaaaagtcttaagtctaacaaatccctaacacaaaatatctaggaaatatgggacacagtgaaaaggtgaaaaaacacacctcaaaggcgcagaaaacatattcaacaaagtcatagaagaaaactttcccaacctaaagaaagacatgccaatgaaagtacaagaagcttacagaataccaaatagagtggaccaccaaaaataagtcccttcacaacataataatcaaagcaccaaacatacagaataaagaaagaatattaagagcagcaaaggaaaaaggccaagtaacatataaaggcagacctatcagaattacacctgatttctacatggaaactctgaaagccagaaggccctagatagatattctacaaacactaagagaccacaaatgccagcccaaactactatacccagcaaagctttcaatcactatagagcaagaaaacaagatatcccatgacaaaaccagatttaaacaatacatatccattaatccagccctatcgaaagtactagaaggaaaactctgacctgaggaagttaactacactcacaaaaacataggcaatagataatcccctttaccaaaagccaaaagaaaaagcaggataatccacacacaataccaacaacaacaacaaatccaaacaagcaattaacaatcaatggtccctaatctccctcaataataacggttttaactcacctataaaaagacacaagttaacagaatggttacaaagatagaattcatccttctgatgcacaaaagaaacacacctcaaattcaaagacaggtcacctcagagtaaacaggaaaagattttccaatcaaatggacccaagaaacaaactggtatagatatcctaaaagctaacaaattagacttcaaactaaaatcaatcaaaagagatgaagaaggtcagttcatattcatcacaggaaaaatctatcaagatgaagtctcaattgtgaatatctatgccccaaatacaaaggcacccatgctggtaaaagaaacattactaaaactaaagtcacacataaaatctcacacagttatagtgggagacttcaacaccccactctcatcaccagacaggaccactagacagaaacttaacaacgaaataaaagaactaacagaagttatgacccaattaggtttaacagacatatatatgacattcaatccaaacacaaaagaatatctcagcaccacctggaaccttctctaatatcaaccacatactcagcaacatagcaaacctcaacagatacaaaaaaaatggaataaactcctgtatcttatcaggccatcatgctttaaagttggaattcaacaacacaaatcacagaaaccctacaaaccaataaaaatcgaacaatgtgcaattgcaccattcctgggtcaaggaagaaataaacaaagaaattaaagacttccttgaattcaatgagaatgaagacacaacaacccaacttatgggacactttgaaagcagtactaagaggaaagttcatattacaaagtgcccacatgaagaatctggacaataatcacattagagaattaacagcacaactgaaagctctagaacaaaaagaagcaaactcaccccagaggggtagatgtcaggaaataatcaaattgagggctgaaatcaataaagtagaataaaggaaacaatacaaagaatcaatgtaatgaagagttggttcttcaagaaaatcagcaagatagacacacctttatctaaactaaccaaaaggcagagagagaacatgcaaattaacaaaatcagaagtcaaaagggggacataccaacagacactgaggaaatccagagaattttcaggccatactttgaaaacctgtactccacaaaattccaaaatttaaaggaaatggacaattttctggatagatatcacttaccaaaattagatcgagaacagataagcaatttaaacagacctataacccctaatgaaatagaagcagtcatcaaaagtcttccgaccacaaaaagcccagggccagatggcttcggtgcagaattcttccagcaattcaaagaagaactaatagcaaaactcctcaaattgttccacacaatagaaacagaaggttcattgccaaactctttttatgagcctgtaattaccttggtacccaagccaaacgaaaacacattaagacagagaactacaaaccaatatccctcatgaacattgatgcaaaaatactcaataaaatactggcaaatcaaatccaagaacacatcacaaaaatcatccaccacaatcaagtaggcttcatctccggcatgcaaagttggttcaccatatgaaaatctatcaatgtaatccaccatataaaaaaactgaaaaagaaaaaccacatgatcatctcactagatgctgaaaaagcattggacaaaatccaacaccccttcatgataaaggtcgtggggaaatcagggataacaggaacatacctgaacataataaaaaacaatatacagtaaaccaacagtcaacatcaaattaaatggagagagactcatcacaattcgtctacaatcatgaacaaggcaaggctgtccagtctctgcatatctcttcaatatggtacttgaagttctagctagagaaataagacaataaaaggagatcaaggggatacaaattggaaaggaaaaagtcaacctttcactgtttgcagatgatatgatagtttatataagtgacccgaaatactctaccagggaactcctacagctcataaaaacctttagcaaagtggcaggatacaagattaactcaaaaaaatcagtagccttactatatacagatgataaacgggctgagaaagaaattgaagaaacatcaccctttacaataaccataaacaacatataatatcttggggtaacactaacaaaataggtgaaagacctgtataacaaagactttgagtctgagtctttaaagaaaaatattaaaaaagataccagaaaatggaattatcttccatgctcttgtataggtaggatcaacatagttaaaatggcaatcctgccaaaagcaatatacagattcaatgcaatccccatcaaaatcccagcacaatttttcacagaccttgaaagaacaatactcaactttatatggaaaaacaaaagaactaggatagccaaaacaaccctgtacaataaaggaatgttcagaaacaccacatccctgaattcaagctctataatagagctattgtcctgaaaacagcttggtattggcacaaaaatagacaggtagaccaatggaatagaattgaaaaccctgatattaacccatactcctatgaacacctgatttttgataaagaagctaaaattatacattgtataaaagaaagcatcttcaacaaatggtgctggcataaatggatgctggcatgtagaagactacagttagatccatatcaatttccatgtacaaaacttaagtccaaatgaaccaaagacctcaacataaatccagccacactgaacctcttagaagagaaagtaggaggtacccttgaacaaattcgtgcaggagaccaattcctgaacataacatcagtagtacagacactgagattgacaattaataaatgggacctcctgaaactgagaagcttctgtaaggcaaagggcacagtcaacaagacagaatggcagcccacagatgagaaaagatagtcacaaatcctacacctaacagagggttgatttccaaaatatacaaagaattcaagaagctagtcaccaaaacaccaaataatacaattaaaaagtgggatacagacctaaatagagaagcctcaatagaggaatctaaaatggctaaaagatccttaagtgctcaacatcctgagccatcagggaaatgcaaatcaaaacaattctgagatgccatcttgtttctgtcagaatagctaaaataaaaaacaccaataacaatttatgctggagaggatgtggagaaaagggaacactcccccactgctggtgggagtgcaaactcatacagtcactttggaaatcagtatggctatttgtcaggaaaatgggattcagtctacctcaagacccagcaatttcactcttaggcatatacccaaaggatacacactcatacaacaaggatatctgattaactatgctcatagcagcattatttgtaatagccagaaccttgaagcagcctagatgcccctcaactgaagaatggatagagaaaatgtggtacatttgcacaatggaggactactcagaagaaaaaaaaacaatggaattttgaaattcgcaggcaaatggatggaaccagaagaaaccatcctgagtgacgtaaccaagtcacaaaaagacaaacatggtatgtactcacacatacacagattttaaacatgaagcaaagaattaccagcctacaatccacactatcagagaagctaggaaacaagaaggaccctaagagagacatacatggtcccttagagaaggggaaaggaacaagatctcctgagcaaattgggagaatggagtaaggggagagggagttaaaagaaagaaaagggggtaagaggaggggagaggaggacatgagggaagaggaagcctgtgtcaggggaaaaatagaggagagcaagaaaagagataccatcttagagggagccattataggtttaaagagaattctggcactagggaaatgtccagagatttacaaggttgaaaccaactaacaatctaagcaatagtggagagactaccttaaatgcccttctccaataatgagatttatgactaccttatatgccatcctagagctttcattcagtagctgattgaagcagaagcagtccccacagctaaacactgagccgaactcctggaatccagttgcagagagagaggagtgatgagcaaagggatcaagagcaggctggagaaaccacagaaacatctgaagtgaacaaggaggagttcatggaccccagactgataggtgggaaactagcataggactgacccagaccccctaaacatgggtgtcagaaggactgagcattctattagaggacccggcctctgttagtggatcagtatttatccctagtatacaaatggactttgggagcccactccacacaatagggatactctctcagcctagacacactggggagggcctaggccctgctccaaaggttatgacagactctgaaggtcccccatggaaggcctcaccctccctatggagcagaaaggggatgggaccgagggatggtgggggagcaggggaggaggggagggagaaggagctagaattgacatgtaaaacaagattgcttttaatttaaattaagaaaagaaaaaataaatcaggctatctgatttctttaaatgtagagttttaaatttaaaagttaaatgcataggagatagttcagttcaaaagtgcatgccttacatgcacaagtcctaagtgcctgcccagcatccagctaaaagctgaggagcctatacccacactttcatgtcagacttccttctgagcatctttttctcctaaagctaatgcttaaacctatattaaaatatctttaataaaatctttaacactgtttcattaaaaataaaggctaggtgtgggtgtgtacctatataatctcaagttgggaaggcagagacaggaagatccctaggaattactggccaacagtctagccaggttagtgagatgaggattcagtgagaacccttatatcaaaaagggataataataataataataataataataataataataataataataataatgttaaaaacaattaagaaaaatactcaacatcaacctcagacatccataagcatacaatacaagaaaataatgaaaaaaaatgagtacaagtgtttataaattcccattaccacctccaagatgaactagaggaagtggaaagattgtaagagtcagagaagatgggggacacaggagaacaaggccctctgaatcaactaggcaaggtgcagatgagctcacagagactggagcagcaagcacaaggctacatgggtccgtaccaggtcctctgaatatgtagctaacagctatatatggaaatcctgaatatgagaaggagtgggtctctgactcttgtgcctgctcttggaactcttttcctcctgctgggttgccgtgtccaactttgagatcatagtttttgcttcatcttattatatttagttttatcatgtttggttactatctcttaaaagcctgtttttttctaatgaaagaaagggggtggattaaggggaggggaagaggagaggaactgggaagattagagggggaagaaagtataatcatgatatattgtatgagaaaataatctattttctttttttaagatttatttatttattatgtatacagagttctgtctgcatgtatgcctgctggccaaaagaggtcaccagatttcattacagacggttgtgagccaccatgtgattgctgggaattgaactcaggacccctggaagagtcagtgctcttaacctctgagccatctctccagccccggagaaaataatttattttcaacaaaaacattttgtcataaatactttcaatcagtgggcaatggtagtgcacacctttaatcccagcacacaggaggcagaggcaggtggatctctgtgagtttaaggccagcctggattacaaagagagctctaggacagtcagagctgttacacagagaaaccctgtctggaaaaaaaaacaaaacaaaacaaaaagatacttccaaaccttttcttttgaaatataatgcagaagagtaaagatcctgcttcctaatacccctcctccattccatccccatgcctcaccccatcccatcgtcgatgtgtacaattttcaaatacaccacacatgtgtacataattaactacaaagcaagaatataaagacaagggatggacctattccaagggacaattttaaaataagaaatgaaaagagactgttctagtcttcttataaatgctataagctgtaacaaaccagtttaattcctccttaatgcaaggggaattaatcaagagtaaccaatcaaatgctttcagtatagaagaatattagccagctgtatctcactcctctatttggttaagtgtgagaaaatgataggagacggctgagagctggaaaccacagataagatagcatttcgtccttccagcgagccttccttcagaaactgggagaggagcctatgagagactcacgattgatctctgagcagtaagtagctggaagagccataatcctggccaagcctcaaggacaaggcacatctctgaacatggctttcgattccaagctaagaaatgcgagataggctacaggaaaagtattctaattggggcccacaggtgtttggttacaataaatagatccacccaaaaagtgagtgggaaagctacgctgttcttccttcatttccccggaagtttcttcggattttaaggatgactatggagctcggttttataatcgttaaagatatttaaataaggctctcaattgaaaagcaataatgtacagatggcggattatgcattcgggactagatttctaattaaacaaggagattaaatctattcctttatctccgcacttccctgaaatttaagcactattaatattaaaggaataaagacacacattagctccccagccctcagagcctgcatgaggcccagcaatttaccctagacttggaaagaggaaaggaaatctctcagacagcaaatcagggggtgcagagaacagggaaagagggactatcaaggtctcaggatgggaggcagtaggaacttgtggtaactgagaggcaaacagaggaactggaaaccaccagagtgggggatatgagaaggcagtagaactgagcccttcgtgtcacgtaattccagaaaatgaaagatttggaagtgatgggatacagaccagtcccggcaccctcttttgtcctcaacaaagcacaaaccagttaagatataaatatgaaacccagagccaggggagcacccttaatgtggcttggatcctggaccagcatgtagacaaactaatgaaatccaaatttacatctgcggattggctagttgttgctgctgttgttttttgtgtgtgtgtgggggggggggggtttggttggttggttggttggaactcacagagatctacctgcctctgcctcccaactgctgggattaaaagcatgagccaccaccaccaggatagtcttaatatattcagaacatcttattttcagctgtggtgtgtagtcagtaaaatgccaccactagggaaagtggggtaaaggctacaaacatagggctctgagtacaatttttgcaacttttccatgaatccaaaattactgaaaactaaaacacttattaaagcaaaatgttttcttctttttaatagacaatggatacttttattatttactcaggtttaggtcatggagactcgattccttttagtgtccaactgttgtatttataactcaaacttctaatgaagctgattttttcatgcttaaacctgttttcattttactttagaaatgatgccagctcatattttgaatgcctgtacctttcctcactgacaagtggaagagtgagggaagaagttacagtcaatgggaatagaccctataagactattcttttttttccattcatttgtttagctcataaataaagtcatgcacaattatgatacagaatacagtatgttcacaatggcatggcaaaattaaaccaattaacatgttatatcacacatattcatcatttttgttttgagtacactaaaagtatacgatctcacaacttttaaaatatagcatattgttatcaaccatatttatcatgctctcagtagaccttaagacatcacagagtccatgcctcttgtccaactgcagttttatatccttaaaccaatcatttccccattgttaaaagacccacattgaagcctaatagccacaactctgctctctgttcccataagttcatcatttctaggttacacataaaactgaaattgtgtgatatttgtcttccagtgtgtcacttttttttggcaagcatataactttactaggcacactccatttaaaaaaaaacaaacaaacaaacaacaacaacaaaaaagtaaaaaacaaaatcccagaaaacagcacagttctgttactcttgtgatacttggcaccatttatttttttaaattagcttctcaatcatcatctgggaggaaaccattctgagcaacatcattaaaaacagctctgataaagcatggtcaccactatgtatcatagagcaggtccacatatgcgtgagtacatatcatgtttgtctttttgtgattgggttaccttgctcagaatggtttcttcgagttccatccattttcctgcaaatttcaagattccattgtttttttctgctgagtaatactccattgtgtaaatgtaccacaatttctctatccattcttcagttgagggacatccaggctgcttccagtttctggctattacaaataaatgctgctatgaatatggttgaacatatgtccttgttatatgaatgtgcttctttagggtatatgcctaggagtggaattgctggaacttgtggtagactcattcccattttcttgaggagtcgtcattataatttccacagtggctgtacaagttggcactcctaccagcagtggaggagtgttcctctttctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttaagttttatgcaaggtgaaaggcttgggtctatctgtagtcttctacatgtttgcatccagttatgccagcaccatttgttgaagatgttctctttgttccagcataaatatttggactgtttggcaaaaatcaggtgtttatgggtgtgtgggttaatatcagggttttcaactctattccattggtctaccagtctatttttgtgccagtaccaagctgttttcaggactatagctctgtaatagagcttaaagttagggatggtgatgcctccagaagttcctctattgtacagggttgttttggctatcctgggtcttttgtttctcaatataaagttgagaattgttttttcaaggtctgtgaagaattgtgttgggatattgatagggattgcattgaatctgtagaatgcttttggtaagattgccatttttactatgttgatcctgcctatccacgagcatgggagatctttccattttctggtatcttctttaatttctttctttagagactcaaaattctaacactaaccacttttttggttagtgttactccaaggtattttatgttgtttctggcaattgtaaagggtgatgtttctctgatttctttctccaccaatgtgtcatctatatatagtagggctacagttttttttgatttaatcttttatcctgccactttgctgaaggtgtttatcagctgtaggagttcccttgttgagtttttcgggtcacttatgtagactatcatatcatctgcaaatagtgagagtttgagttcttcctttccgatttgtattcccttaaactccttttgttgtcttagcgctctagctagaacttcaaggacaatattgaagaggtatggagagaatggacagccttgccttgttcctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtaatgacccttctgcttctattgtgtggaatgctttgaggagaattggtattagctgtactttgaatttctggtagaattgtgcactgaagctatctggccctgggcttttttggttgggagacttaatttccatgagtttgtaggttttctgtagttcatgttgttgttgaattctaattttaaagcatggtggtctgataagacacagggggttatttcaagtttttttgtacctgttgaggtttgctatgttgccaagtatgtggtcgattttagagaaggttccatgtggtgctgagagaaggtaaattgttttgtatttgggtggaatattctatagaaatctgttaagtccaattgcgccataacttctattagatcttttgtttctttgttaagtttctgtctggtgttcctgtccagtggtgagagtgggttgttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatggtggtgagattatgtgtgggattctgtccctttttccttttggctgttggtaagttgggattatctattgcctatggttttctggttgtagttaccttccctaggttggaattttccttccaatactttctgtagggctggattggttgatatgtattgtttgaatctgcttttgtcatggaatatcttgttttctccaagtataatgattgaaagctttgctgggtatagtagtctgggctggcatccatggtctcttagtgtatgtataatatctatccaggatcttctggctttcagagtttccaaggaaaagtcaggtgtgattctgataggtttgcctttatatgtttcttgacctctttcctttgctgctcttaatattttctctttgttgtgtatgtttggtgttttaattgttatgtggcaaggtaacctttttttggttcagtctatttggtgttctgtaggcttcttgtattttcattggtatgtctttctttagtttgggaaagttttcttctatgattttgttgaacatgttttctgcgcctttgagttggatttcttcaccttcttctatacctattattcttaggtttggtcttttcacagtatcccatagttcctggatattttgtgatagggatttgttggacttaagactttctttggttggtgagtctatttctgctactgtgttttcaagccctgagattctctcttccatctcttgtattctgttggttatgcttacatttgtagttcctgatcatgtacccagcttttctatttccagcattccctcagattgtgctttcttcattgtctctatttcagttttagtccttaagagattgatattgattgacttgaagattgatatcttgtaatttttggttagttttttcttacatttctttaagggattttctcacgtcctctttgagcattgtgatgttcaggtcttactggtgaagagtgaacagcccccagccaatagtgctaaggttttctttattgagatacaccaatcaagctagaggagggagcttgaaccagcgccagtagccgggggagcagaagagagaaggccggggtctccacgtgcagcccttaagaaccttcccttatgtcacccaggacttcccttcacccgccctcatgggcgtgtcccggtacatctgacacctgtctgggttgcctggggcggggctagggtgtctccctacaattccccttttagtctaaaagaggattaaaacttaatagtgtaaaacatccaaaattaacaatcataaaggtgaaatacaagaagatacaataatctgctattgcacattctaactatgtctattccggctaagccctaaagtcatgtagaaagggtatctaacttgaacacctccttccagtcccaactctaaacaataagaaggtcattcttaactaggcttacactaccctaataaacaataatgggtttcaggggcgtagcatcttctaagttacttcctactgaaatgggacgatggtagccatgtggggtcctgtggggggaaaaatgctagtacagggaaagtctctaatgagttatgtctagtccatgttagatgagatttgcttgattgaagatctaggttgaaatcctcaacttgattgaagtcattactcgaggttctggttggagtgtcagtcgaaacggagtgagttgaatccagtgcagtcggggaggtgtagtccaattctttttccagagcatgcagggattgttgtcaggctggttcccattgactgtatgggactcaaacataagtgtcatcagagaaatgttcgcttgtacatgtatgtgtactgggaaaggcaatccttgaaaaacaacaattatgagagagtgtaggccttgaaagaaagagccaagaaaagacaaagatagtcctcttattctttatttattctgtattacagcaattggcttcttgatataacacagaaactttaaaattttgttaaataacatgcttggattttaggataggaaagccaaatccaagtctaaatccaacatcgatttaattgaatagggactagaaaatgaagagaaatagagttatttgagactacagctgtatattttaccgtatggcacgttccttttatttgatggttatagctacgttctttccttaagtatctacacatgtagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttccgtagtccagtgtctttccgcagctgtttgtccattgtctttggcattaagaaagtttagcgttaataaagcattatgcaatctatgtttgggggtttcgccttaccagcttgcctatggagcatctccttgagtgtcctgttggaccttacaacaactgcttgtcctgtagggttgtgtggtatacctgtgacatgcttaatgttataatatttgaagaactgttccatttttgtggagacatatgctggagcattgtcagtttttatctgcaccggtatacccataactgccatcacctccagtaggtgtgtaataatgnnnnnnnnnnnnnnnnnnnnnnnnnnnnnnnnnnnnnnnnnnnnnnnnnnnnnnnnnnnnnnnnnnnnnnnnnnnnnnnnnncctccgaaggcctttaggattacagcctgctggcagcagagtttggttataaaaggaacaaataggacagtttctcactatctccttggcttgttgccaagtgatggtggagaagtcctttaaatccttgctatttacatgatgctttttatgaaattctgaggcttctagcacggtgtcaatcaatagacgatcaatctcgtcattgccttgtgccagcgggcctggcagacccggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctctttttcttcctcagcagataatatttgtggactgtttaagtccttatcaccctttagtgccatttttaagtgctttaagtcatgtccttccacaccaataatcgtctgtaattaagaaatttctcctagtagcttttgaagactgttaagagtttgataacggtcccttctaatttgtaccttttgaggtctgattctttgtaagtctatcttatatcctaaatagttaatagaatctcctctttgtatcttttctggggcaatttgtaaatccccatctaggcagaacctccttcaacattttaaacatacgttccaaagtttccttattagaatccgataaaagaatatccatccatataatgataaacaagagattgtggatattttttaccaattatttccaaaggatgttgcacaaagtgttgacacaaagtgggactatttagcatcccctgaggtaaaaccttccattggtatctccgaactggctgtgagttattaagagttggcactgtaaatgcaaatttctctctatcgctttcttgtaatgacatagtgaaaaagcagtctttcaggccaattactatgttcagccatcctttaggtattaaggaaggcaatggcattccaggctgtagagagcccataagctgaattaccttatttatggctctcaggtctgtcagcattctccagttacctgacttcttcttgataacaaatacaggagaattccaagggctggtagattgctctatgtgaccagcctctagctgttcctgtactaacttttctagagtctctagcttttcagaggtcaaaggtcattgccctatccagaccagttcatctgtaagccatttcaatggcagggcctttggttcctctgaagtcctctgaaggtctatcatttgtatttagtgtctgtacagcctggatagttggtaaccattttttatggcatcttacccgatcctttctactatccagcgattttttagaattcgtatctgacactggagggatgttaatttgagtattccattgttgtaataaatcatgaccccataaatttataccaatatctgctacgtaaggatttagtcttcctttttgtccttccagtccaatatagaccaccgagttaacactccatcgaactctagatagagttccaatttgcctctttagggggccatttcttaggccaggatttctgggtgataatagttacatcagctccagtgtctacaagacctttaatagctctgccattaatttttatttctaactgaggccttttatcattaatagaaacttgccaaaatatgcgtttctcattttcaccagtcacatgtgattctttatcactattcaaattaccttctagagcagtatcattttccataataagcaaggaactatctattcgtcctgtgagagattgtcttccattgtcacagggaacaatcaaactgttctcgaggcgggggcctgctggaggtcccctttggagtttcccaacgttaataggttcccttgcatgtccctagtcgatctgcattcgttagtccagtgtttgcccttaccatatcacctacataacccagagggcaaatgacctgtcacgtggggaatcgttagaatttctctgtctacaatttctccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctgtaaggtgctcttccttcccaagtccttctgttgctatcttttctaatctcctgatgtctgttgaaacctctagggacagcttcttctgcccagattccagcatcttgtatgttacagtcaacttgggcagtatgtagaacccattcttctagtggagctgatctgatcttcagaggcaaaagtattcttttgcacattgggtttgcattgtcataagctaagctataaacaattggatgttggatcgttggatctgctacctgtatgtctactggtctggtcaatcggtctaagaaatccttaaatagttctgtttgtccctgttctattgtcgcataagcttctagtcattctcctgattcacaaaccttatcccatgcatttagtgttgctggcctgcataggtactgcatatggtcgtcatattcagcctgaatttgtggctcagcataaataccttctcctaggattttttggagggatgcatcaattccgtccctggtggttctaggagtctgctctcttccctaaataactcgggtggtgggtccggttgggtgccacgtgaagagtgaacagcctgcagccaatagtgctaaggttttctttattgagatacaccaatcaagtgagagggagggagctggaaccagcaccagtagctgggggagcagaagagagaaggccggggtctccacgtgcagcccttaaggaccttcccttatatcacccccgacttcccttcatcccaccctcatgggcctatcccagtacacctggtacctgtctaggttgcctggggcggggctagggtgtctccctacatactgtgtatggttcctggtctccagtggtatcatattgggttttctgttgttggatatgtttttaccttgtcctcttctcatcctttcttctggtgggtgtagcaagagtttcttgttctcctggtgggtgtgggaccaaggttctcttctggtagatgcaaacagatccaatactctgatgtcggtcctcttctcgtgaatggaggttccccgggtgttggcagtgttggggtgtgcagggtcctgggccggtggatggaggtgggctgcctctgggtgttcggtgtttggaacccatcgccgaactggtccagcatgcaggtcacttgcgtcagggtcccaaaatgtcttcttgattactaagaaagctcatattagaaaacagcttatcctgaatttgaaaaatgtatccattttatctcccctcacatagaccaatttgcctagtcatgactgtaggcaatgaagagcaactcacatcttaccatgaaatggagccagtaggctctcagctgccccaaccaaaggcagatgatggtgcatgcttatttatttatttatttatttatttatttatttatttattttgagacggaatctcatgtgttcaggctggtcctgaactcattaggtagccatggatgaccttgaacttctgccccccgcccttatttccagggtgatggaattactgctatgccctaccactcctaatcaggggccaacctaagatgtcattcctaaaaatgaagtgctctgtcagctgagcaatatgctttcttacagacaacataatctccaccattagcgtctttgggtctcccaaatgaaaggtgagggacagaagggctgagctatactactcaaaattagtaaagaccccatgttggtggtatcatgttactatttctgtagcgaaatgcctgatacaatcaatgatacaattacaggaaataccttgccccacattactgcaagtttcagtccataggcagttggctgcattatttgggactcacacaagcagaatattgtagctgcaggtacatggtggagcaaaacttgatagtggccagagatagaggcaaagagagagaggagtcaaggtcccaatatccccttcaagagcacacccccagtgacctaaattcctcccaccagaccctacccctaaggtgacaccaggagaccaagccttgagtacatgtgcctttgagggacacataaggcccaaacaataacaaacaataattaaccataaagcatacctttattatctatgtattaatttacttcaacagaattaatagttacagtacagattaacataacatattttgtgaaaaataattattttccaaagggaaaatacatgaaaaaaaagaaatggccttgatgtacaattttttcaagtctcttctttaacagaagccagctagagtctcatctgtgcttctgcattcaatctgtcaggatagcacaggtcatgttgccttgggaaacttctctagtatgctcataggaaaataaaaatgaagtggataaataatggcttagtattactataaaaacattttgacccatcagacaccagagattccaggaccacatcttaaaatctgccattctaacaaatgcccctctacatgcagaaactgcaaggtcaatgctgccctaagaggagccagcaaggccctataataaaagctagaagaaaggtgaatctgagatggaaagcctttgtctaaatatctatagagcagccaaacccctgccccaggacctctggttcagctgacacagttgagtgacaatttctttctccatgttagcaatttactaagaggctgagtcttacagtctctagacacaggaatactaagcagaactgaagaacattctctaaagcagaaaggcttctagtgggcttctagaatccagatagcctgatttgttaacaatcccttaatacacacgcatgcatacacacacacacacacacacacacacacacacacacacacacacacacacacacacacggcaaaatattaggtaacttttccctgaagaaactaaacaattcaagaaaaaaaacactgcattgatatccatcaatgaatagctcaaatcaattactgtaaattattgttccaatcttgacaagccttgtgcctacacacacagctttagctacagtcttatgtgctaatagttcagaataactcaactagacactctcaggaagaaaatgaaaggacaaaatgtgtgagaaaacaaagagaaaggaacattcattaaatgccatagtaagttaagaatagaaaaacagatatctaaaattgagagatagctttgagtaaggctttcagaaaatagatcagagaaaaatagattgaaagaatattacttagaaaatcaggaatttaatatataacatgaagaaaatataatcccagaaagaggaaacttacagatttgagaaatttttcaattttaatgaatacataagaaaagcttcatagaataaagagtttaggcttcaaggttgagagattttatattttaccaagaaaatacacaaatataggaaagggtagaacatacatataaaactccagaatgcaagaaaaaaaagaaaagatcctaaaagttccaaaaatacaaaagtagacacatgacaaagagattcaaactggcatcaatctgactaacaactctggaaaccatggcaatgaagcacagcctggacaatcctcggggaaaatgaatccacgcagaggtcatcactcagtattgagaagagagtacagacacatacagaaatgtaggctctaaaaaagattgcatcgcacataacctttcccaaactgcaacagaagaaacaagcctggctgaggacgaagctcagttggtaggtagaatacatgatgagcacaggcaacactctaggctccaccccagcataactgaaaaccagatgaggtggtgcacacccataatcccaggacaagaagatgaaggaaggagtgggatgaatgagagggatgatgtaatagggaacttagaagccaagcttcagatgacttcactgctggaagaaacctgaagcagagccatacaggtgagctgtccctgcattccctagtcacaaaaactgtaagagaaaaacaacaattgatacttttgtgctgctaaatgctaaggtgatttgttacaattaagcaaccaactcacaggtaatcgagaacataagaaacccaagataaagaaacctagagcatagccgtgcagtcctctcagagtacataacctagctatgagtgtgaagcctcccccaaaagcacaactgatatgtcttacctatttttatagtaggccaaagttgcgttattttacttcaaaatggatatgtgtttcattgtattcacaaaatacaattttacactaaagtgctaaaaaattatacaaagttaagcaaaaggagaagtagtcattattaaatctaagaggaaaatgtgttctagaaagtagatagcatatgtgcagatcaagtgtgaaaaatactttatatcatcttaggaacaaaaatagtgaacactgatttgccctcaaaattctgttgtttctgctggaaatgccagagataaagatgtatggtagaaagggtagaaagtttgcaatttaagaaggctgaaggatatcttttcttttatatttttccttccctttgttcttcacgtgtgtgtgtgtgtgtgtgtgtgtgtgtgtgtgtgtgtgtgttatttgtttatgtgcagatgcactcatccatttgtgggggtgtggaggccagaagactatgtcaggatgtcttccttcatcattctcagccttgtttttgagacagggtctcactgaacctgcagctagactagctgtccacagagccccgagaatacacgtctccacccctcaagctctaaaaaggcatacactatcacagccaggaaggactctttccacacactttgtcatcagctttgtctcagaaaacaatccgattaaaataaaacttgaactttaacaagatttatctaccacagggtaaaacagggtaaaataaatatgcaaaggcttcaatgaataaatcactcaacagaaactttacttctctaagtcaggagccaggagatgatatgaaaactagaaactgttaaatgaagttccctctgagagataggactgagatcagtcttctaatagcccttcctacaatttcaatcatctgccatgactaatctccattgtcaaggtgatgggagtcaccacatgcatacaccttcagaagtatctatgaaggtatttccacaaaggtttagctgagcagagaaaatgcaccctgaatgtgggtggcattgtcccaccagtggggatgcaggactggatgaaaaggagaaaacacgcagagcacttgttctgcttcctgactgtgatgctctgggactgactgccttatggtcctgccaccacacctccccagcagagagactcccccctcaagctgtaagacaagagaagttcttcctcctttaagttgcttcttgttggatctttggtcacagtcaggagaaaagtagctaacatacctgggaaatgctatcccaaaacttttagatgacatttcaaagtcaatgcaggggttgggaaaaggtgtttggctctgctccacctggaaacacacaggaggacttggctcttctgggaagtctgtggtctgcagatcatgaattctggctccttgtactctgcctctgcctccagtgccatctaaattcctaaagtaactttatttaccatgctgacttgcaaacatactgtcagacactagaaacagcagaaaatcatgaccattagagactaaagggcacagagcatagacacacccctcacgtccaggggtctcttctctcattgaggctgcagtccaaagagtggcaagagacagaaaatgtggttatgaagtgcctcacccacccagaggcatctttcagctctcagtgtccttttggagccagcacagatgggagactagatatctcaggacagtaactgagatgagtgaccatttcctacagagatccaacatgttttcaaagccaaagaaccacagctatccaaaccttacacagaatatctcgacaagacttgagtttcatgcttcaacagccaatgcttcaacagccaagcaggtacccccaaggctgcctgtcagaatacagatagctaacaaaaagacaagcaactctggatcaaagggtaaagacatgtcacttcctcatctctttgaaattgtcccaagacccaagacagatgtttgactccttcacatctaaagccaattaaccaaattgagttggctgagtttgaaagttggcagacaggtgacatttttaagaattctgccctagagctccccattgcattgacaccagctagtgaacaacaacacaaccctggggtgtgacaggcctttctgactgagagaaagaaagcccattttaaagcaatttcacatcctgtgggttgtgatgactttgagaacggatttcttttcttttctctctctcttttctttgacagggatcttacattgctgtcttccattatctaaggttctactatggcaatagtaaaacccataaactcccctagaatgagtttaacgtctctatgtccaacgtgaatgatcatcagttatacctggggaaatgaagcaagaaggaaagcagtgaatggggtacactggtcctcagccttgtccacaccaaagaattttctggttcaatggcatcatctctgttgaagatgtttatgtatacgaggaagatcaaagtcaaaccaaatttaagacaacacaaatggttaaagctcatcttgtttgtgtatcttctgggaaaaggtctctgagatggttaatctcagttgtcaacttgatggggtctagaatcaccacagaaaggcaaccaaggtatatgcttgagtgactatctacatgggtcaattgaggcaggaagacccacccaaagtgtaggtagcacttttccatgggactgggtcctaacttgaatacaaagaagagcaagctgagcaccaacaaccatcattctcctctgattccttattgcagatgcaatgtgacaagccatctacccattcctgccactgtgacttccctgccatgaaagactgtgtcatcttgaactataaatcaaaataaactctcctctcctcaagttgatttgatatcagagcaatgagaaaagtgactaacgtagcccaggctggcctggcactcactgtgaagccaagccaaggattactttcaactcctgatcctcttgtctccacctccacagagcttacaagaatgcaccactatagctgaaaagtcatatcataagttcagcagtctactgctgtatgtgtgtatttagaaacaccaagggaacagttaccatgaagtgttcacatatacaaagaactgtgtaatgcacaaataatctatctacataagttaagcaaattttgctattcacttgggaaaaatggaaagaattgtccatcaagaaaagctgcatgtttttacctgcagagcagagcagcatttgttcacagcaatgtttactgaagaagtgtgttctgagcactatcctaggctttagggaacatagcagtcctctgagtagctactgatactaaatgaaaatctgaaaaattaatggctcacaaaataacaatcaagggctagcgatgtagctagagtatagagttaagtattgggtgttgttcttaacactgggaggtggtatactgtaggggggaagggtccagctaaagaaacacaccctgagcagagccaaagaaacacactttggccctgcaaccagagccaaagaaatgcaccgtgacccaaaaagaaaaagaaaaattcaatctttcatgacaagttagcaaaaaatgtgagggttttttatcctcatccctatgtttggagcatggggaagctgacaataaacaaatcaagagagaaagaaagagagatacaggaactacacagtgataatggcatctatgaagtagaccatgggaatggaagagatgtagaggaaatcatgaatacaatcttttgtatgcagtggctgtagaagacttctctgattaggggccatttgagcagagtttgtggaggcaccaaacaaatgagccctggagataattaggagacagatcactgcagaacagcagggacacaggtcatgaggacagagagcactgcatgtggtcagggaatgacccaggaagccaatgtgtggtgcagaaacaaaagttcatttaagaaaaagccaaagatgttaagggccaatcctgcaagacttcaggccatgaagccaagacaaggacagaaagtttacaggaactgagattggaagccactggaaggatttttagtaggtcaacagcaaaattaacttgtgttttaataacacagggccagctaaacttccaggtgagatggaaggctagaggctatttctgtatgacccggtaaaaaacagtcaaatgccgtcaaatgagggagttcagttccctagcctttcccaaaggtaaggcagatgatagataaacagtccacaatcctcaggatatgcccattctcaggacatgcccacagtcctcataaatcccaaatacagtttggaaacattgtcattacactgacagccaactcaaaggcaaagagaaatcccatcttgtcaagctatatgactggagggggcagtcaccagcctactgttaaaagccgagctgtcccagggcctggaatcaaggaacaaccctgggaaagagaacctcagtttggcctgccacagccctttggtgagggaagcccagagagtcaagtgtggagaacagtgggactaatgctgaggagcagaaagatgtagaaatggtagaaggcagaagggtgtagagatggcaggagcagaagacatagagatgataggagcctgggctcaggctgggaactgcataagaagtgtgagtctgtggtatgttgacttaaaagttcttcagtgtatttcccagagtggaacagctggccgttatagtaactctattttcagctttgcaaggagcatccacatgattttatagtagctgcacaggatcacaccccatcaggggtaaataagggtttaccttccccacatcctccaaattaagacatatacaaaaagcaaaaatcgatgtccaaattacactagtttagaaaaattgagagcatttcctctaaaagatagaatgagataagggtgcccactctctccattcttattcagtgtagtgtttaaagtctttgttagagcaataaaaccaaaaaaaactttaaaaaggaaaggggatagaagtaagaaaggatggaagtagattatctgatccagagagatgactctcataggtaaaggggttttacacacaagcctggtgacttgagttcaatcctggcatttgaccgacatagacacaataataataataataataataataataataataataataataataataataatctaaatattaagaaagaattctttttaaaagagagaacaaattgtttattccagtttgcagatgtcataaccctatacttaaaagaccttgaagactccaccaaaaactcttacatcttttaaacactttcagaattcacaatacaaataaagtcaacacataaaatccatacttttgtttatgccaataatgaattcatagagaaggaaatcagggggaatcccttccacggtaaccttaaagaactaaaataacaaggaataggcctaattcaggaggtagaatactctgcaatggaatgtgtgagacactagagaacaaagctgaagaaaacaatcaaagatggaaagatctcctgtgctcacagaatagcaaaattaatattataaaaatgactctgttaccaaaagcaacccatagattcaatgcaatcaaaatcccagtggcattcctcacagagctagaaaaaaaatactaaacttcttatggatgcacaaaagacaatgcccctccccaccctacctcaccccaatccaccccactgcaaatagccaaagcaaccctgaacaaaaaaaaaaagagcaatatgggggcttcacactagtcagtctcaaattgtatcacagagccacagtggcagaaaccatggtcctgaataaaagcagacaagcagagcagaagaggctctcaagcccagactaaacccatacagttacaactacctaagttctgccaacaccgtcaacaacatgcttcaaagagaagagagcctctttaacaaatggcactgtgagaacggggcttgcaagtgtaaatggatggaactagatctataagtctcactccacacaaagatcagctcaaaacgcataagaggccttactgtagcactggaaactttgaaacttctggagacaaatgcaaagcaaacacctcaagagaaaacgtttctgaaatggactcttgtgcacagggaatagtcccaagaattgacaaatggcttagatgaagttaaaaggtttctgcaggctgggcctggaggcacacaccttaaataaattacagcactcagaagggagagagtggatgatctccacaagttcaagtctagattggtctacatagtgagctccaggacagccaagtctacatagagattctgttcaaaaacaaacaaacaaaattttctgctccaaagaggaagcaatcaccagtgtaaagatgggagacaaacctctctgggcatgtgtgtgagggtgttccagaaaagtttagctgaagtgggaccatccatccagaccatgggcggcaccattccatgtgctgaggtccaaagttgaataaatagataaagcaaatgccatgtccaaatctctcggtttcttgtctaggatgcaatgtgacagcagcctcacactgctgccactgcaccctccccaacatgaagcactgtgctctcagaccagaggcagacacccttcttccaggcatttgatttcaccaggtgttttgtcacagaaatggggaaagtgactaacacacataccgccatggattacctctgaaatgcttctgaacacttcttaacaacttcagtactttccctttctatgacctaatctggtccacattccaaaggtgaaatatgcagtcaaggcaattagtatgtcggtgggtagggggtgggtaccatttgatccaatgacatctataatgggggatgtcctctgtatgctgtgaatttatctttctcttattggttgtttcagccaatggacaggcaggatgtagccaaacaggaagtataggcaggagttccagactaggagaattccaggaaggggaacgcagacagtgagtcaccaggcagatgccaggtagctgccgatgaagaaagaggcctgggcatcaccagtaagccaaaaccacgtagagatacatagattaatagaaatgggtcaataattaagagagagctatccaacaagaagcctgagccatcagccaaacagtttataattaatataaatctctgtgtgtttatttgggtctaaacagctgcaggaccacgcagacaggaacatccatttacataactaggcaatgatgagtggatttccacttccctgtacagtcacatataacagaagtagctggactgaaactcatgggtcagaagtacaccacccctgtgaggtaaacagcttctttgaggacaagtgaatcaatctctcctcaggttggtactgagttcctaaaggagctcagtcctcctccatgtcagattgctttatttccttcaggttttacacatgcttgcccccgactgtacagtcagtacaggcagctcttcacagaatgtgagttctttccatgtagtgtttgctaagtggtggcacatataatcatttttatcatgtagagaaattccatgagggtctccctggactggccaaatccaaaaacacaagtctcctgtctatttctttatgccatgactgaaagtgagatgagccaattaaagaatacataataagccaattagttgttccttacttttcttaatgagtgtaaaatgtgtgtctgctcaaattacagctcatctgacaagattctttgctccgtgactactacgatttggcattgtttcatttttttaatatcaatggcatcagtcacaggagctgagcttctcctataagcttgtgcaagaaatgcactcatttttaaaaataatcactcaccccttgagcccaggtcctggctgtctttgcctctcttctgttgctgtgataacacactcttacaacagcaaattaaggggagtcttacttcacatctccaggtacagtacatcatggcacagacatcaaggcagcaggagcttgaagcagccagtcagttgcatccacaatcaggaagcagacaggaatgagaacatgctccgttcactttctccactttatatagttcagggtcccttgcccagggaatagtctaacccacagtttagatgggtcttcctgaatcagttaaagggatcaattaaatcctccagccacatgcccagagtttgccttaatctacataatccctcacaggtacactcagaggcccagctctcaggagatcctagattctgtcaagctgacagtgcactcatagccatcacaaagagtgtctacctgaatgctgcagcagcatgcctccacacaacacagctgagtccagcacatcctgaagatacgactctgctcggatgagtcaactgtcacctcagatggaagagctttgcaaaactcagttcccaagtttataacattattttggtgccatggtagattaattcatatattgtcattgggctttgtctacaaaagtcaagtgtaagcaatgagtaccacatggtaaaggagcacaattatagccatggataatgggggaaggggaacccttgagttactgtaagacagccagctgtgtatccaaaaggaacaacaagaaagaaaaaaagaatagagtcagaaaattttgtaactttgtcaacatttattttcaccaaacaactcattaaatcactataaaagtcaacgcatatggttggatatgacagtttaaattccagaaagagttataagtcaagttaaactcataatacataatatagtcagggtgtctcatccatgaattataacatttttattacgtcccaactgcaaattaccaacttgctccctgtcctgccaatctcttgattaaatgggggaactgttaggcactgtgaaaatatattatggtaaaagatgactccatcatttttctcagttatttctaagtccttatttaaagctttgtcactagagcagctggtccaaactgaactgtggatttaacaaaatgatagcagaatggatgaagtaagaagaaaaaaatgggtccaaaaggacctgtgtttattgtaaccttctccaatatttgtgtatcctcgatacttttggtatctgtttcaatctctttatttctgtctctttaaagttattcttactttgcaggtcttattcccatgagcctaccttaagggtattttattttgtgtcttacactgataatgggacaataacttatacccatcaagtttccccataaaacagtttaatgtcttgaaacagtgccaatacgtcagctaaagagagtgaatcaaatagacattattccacatttaccacgagccacactgtatcaggtccttcaagaacttactaaatcaccagtgtcctttaggaacttgaattctaaagttaatacatccattaatatttcaaaacatagactacatatatatatagattaaattcaataatttaccttttgtttatattttgtttcaatgtggtgtacttactttattctagagcaaacaaatacttaatcattacaggaaaacaattttaaataacaagaccctagccaggtggtagtgacacacacctttaattccaacactcaggaggcagaggcaggcagatctctgtgagtttgaggccagactggtctacaagagaagttccaggacagcctccaaagccagagagaaaaacaaaacaacaagaagaccctaaaagaaagctataatcacctccaataaaacataaacatacagaatgtaaacattatttctagttttcatgagtaattatgatttgctactcctattcttggcaaatgagataaagttactgtattagtagcagaaatgccatctttatccaggaacacaactgaatggatatgtctgattataaatttataaccaggtacaatcaaagacagaactagagatctatgaatcagaaagtcataggaaccatcatctaggtatggcattcatgaaagatgtgtaaacacaaacagcagaagtctagtgtttaaatagaagggaggaccagtaacatgtaaggcagatatgtctgacatgtagacaggaatgtctaataggcttttaataaaagcaatgaacagaaaccctctggatctccaggccatcccactactaaccctcaaacctttgttaaatcattgtgcagctcacgatgtcataaattagtgggacttagagaagggacattggatagtcacagattcagcaggaaatcatcattcagcaggtgcatccaaagggcctaagtgcagactggaaatcaaagcagagcctcactaggaactcagccaacaccgagtaccaaagcatgtcacttccctggatatccagaaatgatggggggggggatgctgaccttcacattggaatgaacactgacactaaattttgcttacataccaaagacaaatgaccctaagaaagctggaaatttcatagctggaatacaggctgcatgtctacaaagcacatacacacagagaaagagagaggaggggagggagacagggagagaggagagtgaaggctatgtgaaggaagattctaaagactgtatggtcactcagctgaatgaaactctgctattttgctaagctctcccaaggacagattatgtacttttcatgaagtgctagggactgaatttgaagtcaactgcttccaagtttcctatctgatcccatttaccagcttctgggacattccacctcctcgattccttcacccccatctttggagaatctgtggaactggtaacacataactgagggaagagtttggaagtccaggagagaatgtaactgacttgggataatttcattcacattattaccaagcagtgccctaacctacagccaaaagcgacctcaacaacacagcccccaattcacaagtgaaatcacagcagtgacatcaactgcaatctatagaccaagtgaggagagaccatcaggaatcccaagagctgagaacactaggtaacctcagctggacccaaggcaggaggaggaaaaagaaaaagaaagaaagggaggaaggaaggctggggttggggaagggggaagaaacccaatcaaacagagtgtctgggttccagatagtgacctaaagaagactcagggtacagaaatgaactggatttgagatttcgtttgctaggaaacagtgtggtgtcttgatgaggggctaccatgggaagaccgacattatcacagacagaccagcttttctctagctgggagatggaatgttgttagcatttttaacacagagaacacagagaaggttgccactgtaatccaagttcaaggtggtgagggatataaatgagtgggcccagcatatcttccacgtgaaattgactgtatttactaggcacctgagagcaatgacacaaaggaaggggaacttgagtaagtgcctgttcctattttattgtctaaaattccagggattaacaagattaataaatctcttagtggaggttagggggagacagggaatacatagagagctaagtgagacaaacagcttaactagaaaacaagtaaaccaaggattggcttcctgttgcttggaaaaacttgttacattctcagcatcttgaaacagcacaattgttaccctatgcttctgcaagtcagagtctgagatgagtttctcctgatgaagtgtcggtgtgttctttctggaagctcagggacaaccatcggcttttccacctataaccagtaaagagcacaagactatagagatcagttaggactgaactgggttgatcctaacagaaacttgaaaaataatgatttcaacatgaaggaatttttttctactcataccttttccaagggaggaaggtgaaggtctgcctcagtgcctcagttggtacccagccttttggagtccaccatcctcggcacataagcatctttcttcacatctagtcccgtgatcactaccagatggatgctgcttctctagcaccatccccacctccacatcctaggaagaaagaagaggactgggaaaaatgccaaaggggtctggggatgtggcttcgttgtagagtgcatgtctgacttgcacaaatctttggattcagtctccagcaccatataaaaccagtcttagtttcacatgcctatgatcctagcattcagaaggaagcaaaagatcagaagttcaaggtcatccttggcaacatagcaagtttcaggctttgaggccatcatacctcacataagactacatcaaaagaaaaagaaagaaagaaagaaagaaagaaagaaagaaagaaagaaagaaagaaaggaaggaaggaaggaaggaaggaaggaaggaaggaaggaaggaaggaagaaagaaatcccacatccttatgtgccaaggatggtgggctccaaaaggctgggtacccagctgaggcactgaggcagacctgcaccttcctcccttggaaaacgtatgagtagaaaaaaatcccttcatgtagaaaggaagaaagaaagaaagaaagaaacccatcataaattatataaggctctatccaaagacagacagacagacagagacagaggccagaggcctcatctgtccttttttggcaagctcttacaaagcctgactctacctcttttgtttacatccagggcctgcaaccttgacctgtggtgatgctgagctgtgggtgaaggtacttgggtctgagatggatcagccagctgacagagtctgtcagatctataaaaggatttcctccatggcaagagagagctttcaagtggaagtcaatcactgcttcaaatcaagcattgagaaagaaaaaaaggaggagagagagatttcccagtggaaaacacttttgtgatattagatattacttatgggataccaggaactatttcctagtgacatgggcatctattttatcctggagacttacaggtgttttcattgcaatcaaatggattgggatgccatgtgacttatagcaagaatatggtcaggacacctttttagaatattgggtttctaacttctttggggggggttcaagacagagtttctttgtgtagctttggagcctatcctggcactcgctctggagactaggctggcctcgaactcacagagatccccctgcctctgcctcccaagtgctgggattaaaggcatgcaccaccaacaccccacctctaacttcttataaccactttggagagcgttcctggaataatctagaggttccagtataagaatgagaaaagatagtcagttatgaaaaaatcataaaaagccagaggtagtggcccatgcctttaatcccagcactcgggaggcagaggcaggcagatctctgtgagtttgaggtcagcctgactacaaagtgagttccaggacaggctccaaagctacacagagaaatcctgtctccgaaaataaataaataaataaataaataaataaagatactgaaatattcccagaactgtgttaaccactgagaattgtttacgaatgccatctctcactcaaatgctaagcttaagccagtgttattcatggtgagtcaaattccagacatgacttccaaatggtaaatccaaaacaagggtagaagaaatctaaggatcttcgagagtcttcccatatgaggaaaagttatcatcccaaatattcaggaaatagtgaaagagaggttatgcaggtatgttgatgcgtgggagacatgaagctggacagatataggagacctgggaaaggggaacagtataaagaaatggacattatttatgaataaaactcttaaaacactgcattctacctgtgtagaaattattgaaaacagcattttttgggctgactgagcaagaatttattcagcaaatctcctgactcatgaaaacccaatcgtcaaattatttaacttgcttataactttacagagcaaaagttctctgcggacttaaggtggcacatcctggcttatgaatgtcccgccctgctctgcctgcagctacttctccctcccccttcatccagccaccttcctcctcccagtctacccccaaatcccaactcggccatttgtttgtccaggaacctgcattatgaccctgcagagctcatgggtacttgcccagaatgaatatattcaagtggctccctccaatactcctcttgtcaagagacacgtaatttatgaaaaggaatttttcagagctttagatatagtctgtgccgtattcaatttaattcagtaaatatttattgagtgtccacctagaattgtgctatgtcctatgtggaaaataaaagaaatatataacacaggctctggccaaagggtcggcaatgttcttgggaataaaagctgaatgctgatatgattacaggatgcaaaacagcacagagcaaagcaatagaattatgtaaccagaaccaaaatatgagggagagtcaacattacatttggcaagaccaagaaggatagagccacagggaataatttatgggggagatggaacttgagactatccctgagagatatgtgggttgggccggatgctgcagccaacaagggcacttctggccgtggaaagaatgtgagtgaaatcagagagcgggcaaagtaatcgtgatatgttatgaagaaatgtgagaagccactctggatggagagaatacataatgaccacagaaagactggaagctgtaatctccccatatccttgcttggtgttctatcattgtcggagaattcaatcactgggagccagcatgagatgtggagaacatgggctctctctcagttgcttttctcacagctttgacaaaaccccagcacttcgaagaagagatgatttctctccactcctagttgaaggtgcagtcctccatgacagggaaggaacagcaagcagtgctggaggtggctggtcccgtcatatgcagtcgggaatcagacagcatgcatgttggccctcagcacaactttctcctctgtattaggtctggtactccaacctatggaatgagtccacacaaatggtgagtcttctcggctcagttaaccctttctggaagcactcacatagacttaccagatggtgtgtacccatggtgattctaagtcccatcaagatcataacagacttgaagtgtgttgctggaggttctcttgtcccaccaggtcccgccaccgattcagctccaaataagcacacaaaacttctattaattattaaactgttgaccagtagctagggcttctaattggctagctctgtcttaattattaacccatttctattattaacccatctctatactggagaagggtctggagctgttactcctttttggtctacatcgagtctctctctgcctccatttcccagaatttctctcgtctcctagtcctgcctatcttcctgcctctatggccaaacagtgttttattcatcaaccaataagagaagcatatatgcataaggatacaccccatcagaagtgagaaagcacgattcttcctcctgtcctacctcagcagaaccttgttgcttaggcatctccttcacagatgttcaaaaaaaaggagggagaaccgatgttgacaatttaggactgctatgaaaatcagagttctaaacaggatgtgctttgtgcctacaaataggtagaatcctttgccagtcttgttcattatttgttgaatctctactatgggttaaaaaacaacagcaacggggttcagcactaagaaaatgaaaccaaaaatatgcagtgtttcctccaaagacatcagcaggtatatcttaaaacaagcaacaagtcagtgacatggctcagcaggtcaaggtgtttaccatccagcctgatgttctgagattgatctctgggacccactaaaagttgaaggaaagaaaggactactgcaagttgtcctctgatgtccacacaaatggtggggcactcaaacactaattaattaatttcaaatttaaaaaaaagcaatgttttggagttacaaatacttaaaactgaagcttgttcccaccaattacaagttgcatcactttgggggaacaagtaattctgtatctcagtttcatcaattgtgtcactggtttggcaacattgacctttagtctagtttgaagattcaataccactctatcaagaaaccaacatggtacctgacacctggaagctttcaataagtgttgtttgaattatagtgggcagtggacagaaaacatagtctgataagaaagagcaaatcactgggagtcagaggaatttgtgcactgaggcaaacatggactagaattttttgaagtaggcacaaattggaatattcgtagaagagggaacaatgtgaaaaggtacagaaatatgaaagaaatggtatgctctatagcatgcaggtaatttggtattgctggactataaagttcaaggcagagagcccaggagatgaaagtgaccaaattatgaagacttgcaaagccaaaggaaggtgttggaaaacacccatcaggcaatggggtatcactgataaacattgagtggtggagtaagtgaggcagctgtggagattgaaaattcccctatggtaaggagacaggaagcatttagggaaacactgaaaacactcacatggcacagggagacagagaaggtggaatgatccctggagacctttaaaagttgattgcaacagaattcggttttgactgatgccagaaaaggttgactgtttttaaagaatgcctcttctctccttgcagtgcacttgctgagactgagaacacagatgtaaaacaagtttggagtaaggatgatgcctcctgcttaggatatgatgaattaactagaggtgtctgtggcctatcgaaatggagaacaaacgtggttcagcaacacacttggagaactgggaagtctgaagaggtggacttgggaggcattggcctatatggatgaagactggtcataagaatggatccatccaggataaaggagaagatgagacaactctcaagtcatgtcattccttactggcccaagaatattaaactcaaactctttaaataaaaacacaaatctcagattcagagaatgtttaaatatgcccaaggtcaaagaaacacattttctggcgagtcttttctctccatggtagaagctggatgtgtgtgaaagaaatgagagggaccacatagagagcagatcttggatactgaggggctacacagaggatgacaattataaacacactgtctctaggaaaacagttcatttacaaagtagatttgacagctcaagttgcttcttggcggagcagtcttgcctgccccccacgcgacctggtgagcttcgattatagcctcgatgctggtgcaaccgcagagaccccctaaaaggggagtgatgaatgaggtcctgtcaggcttcattccctgggtggccttgaatctctgctgttatctgttaccctgccagtgctgacagtgatgaacacaaggcaggcagctaacgacaccccgattcattacccagaaagaagagagagcagaaataaagagtaggtgaccaccatgcaaaagcttcccacatcagtgctgtcttcctcctgcagctttgaatggagaagaagtgatggagcccctttgtctcatgcaaggactccaatgatactcagaatagagttctcaatgaagccaactgggaaggccaaataccagcctcagctgggtaaagttcttcacaagacttatgaatacaagagatatttagcaacattttaaactcactattattgtagcaaaaccaaaaatgaaaggcacataaaaatcatcaacctgtacagccttcccaacctaaattgttatttattttaggggagtgcactgtctctccctaagactgtattagatttatggcaccacactagcaaatggttaaataggcttagccattgcttccaattataggcattttgttgttaaagtggtatttggttcttccctaaaaagatcaagatttttgtttcaacacattttttttctaactagtaaagaatgaaggcttctacttcattgtctcttttttcttattaatgggacttctcatgatgcctaaagacatgaaacatgtccaacaaatgcatcttgaatttaatgcccaaaaaagacaagtttgtctgcctaatccaatccatcttaacccagaatgtcaatcagagaactggttcttcaaggcatcaagaatttatcactctctgtctctctgtctctctctgtgtctctctctctgtctctctctctgtctctctctgtctctctctctctgtctctctctctctctctctctctctctctctctctctctctctctctcctgtctgtctctatttgtatgtgtctgagtacactcgtctttgtctacatctgtgtctatacatgaaggcaggactttgtggtgtatatagctaagcaagggcttcctccaggaacatgtttttaacagaaagaaagttccacagtcaaatggatttgaagaaacctgtgttaatcaagtctagcaggtacctttcacaccatattttctgggaatctttaacatactaatgtacattttgatgttcctaaagcaaatataatccatgatattttaaatctgttttcttgttacacacaatacctttgtgcaatatgtatttatcctgctgttacaaaaaaccccacaatttgggaacaggtagtctggatgaatcccacattctcattcgcttattgcagcaataaaatcaggtgatcaccaagatatggtctaagtatgtggcagaccaagacagtctgagggtacaatgagtgctaaagaaaacaggggtggagtggggctgaagatgtgcctcagtgagtattgtgcttgcctattatgtaggaagacctgagttcaatcctcagtaccacataaaaccagaggtgatatgtgtgcctgtcatcttaccacttgggcggtagaagaaaaaggaaaataagctcaggggtcacctccactacatagctggttcaaggacaacctcagctacctaaacagggtgtgggaaacaagaaagagtaacataagagagccaagagagtaaaagtgcttgcttgcaaaacttgccctccaacctccaaacctgctcctgcctatgcacaagtttgaacacacacactctcgaacatacatatacacacaccatacataaatatatacatacacacaaataataataaataaacattttaaaaggggagaacagagggaggaagaggaagcaggattatatactatgaacaagatacattatttatacacatgtgttaaaatgtccaagaattaattcctttaaaattaataaaaacatggtgttagctcccaaagaatgcaaaaagagagcctacagacatcctttcatacattctgacttctgccgctatttgcagtgttctttgttgaaaagaaagcagcgggagttaaagacgatactgaaggaagaaaggtagttttcttagatttgggaaaagggcagcggaggtagtaaatacatggatttttatccttgcttcttgctgaaggccaaattgctgttctaagaacagtagcacaagacatcactatttctttgagagagtgttctgaattttccttttacatacgtatgaatggaagttggtcagacgttcagaacacttaaaaactactgagtaattttcttaagtgcctaatgcaagagtgagcacaaaaggataattcgctccagtgccctaagacatgcaagcaccgtacgtttcctgttatgtaagaggagggcacatcagtggccttttctgtctcagctatttggcatttcctattaaaacaagtcactagctacattcaaaatagctgaagaaaggtgatccaaaaacctagacttgagctgaacaagaagagatgagaaccatctacctttctctatcagcattaattgcttaagctgcaaagcaagagaaaacgttggacaaattaaaaccataccaaaattccaacactttaagtagggtgtttaagtcaaaagcagtgtggaactgcaaaaaaaaaaaaaatggtaatgtagatgtgaactttctgcctcttcctcgtcaacaagcaaatggtgttcaggtgggaagaactgaccatctaagaactaacctaatatctgaacgagatacaaccatcgtcatgaattaggaaaggacattaatattgtcctgctgtcttctcaataggaagtcagccctggaaagaaaaatctcaccagtattttctttctgtgtgctccaagaaatcaaagtcagtcgtggtgcttccaaatgaagtgcaaagaaacctgcatccatttttccctctcattgccaatggcaggttattcagctctggcggcgtcaaagaatttagcagagggaggagaaatataattctgtggcttctggcagaatgaagtttatccttccacagattctgtaataagttctttctttcctacttcccacgaccaaattgtgtctcctactttttctgcaaaggcgctcatttctgactaacaaatacgaatgattccattgcttggccatctattggtgacaaatacactccttcatttctcaggcccctgagagctcgaggattgatgggcatgagggaagagctgggaccaagaattcaaggaagagattcgtgttattggtcttttattcaagttaatcacaggggaatagtattttaagacttcatggacatgcccaaaatttctccagagacacagatcaatagatcagaataatcaagaaaagccaacaagtcttctaaacactacttgagtgttttacttgagtaagcaaaaggcaaatggaattatcccaacctcgtgaagtaagggagaaatcagatctctggggaagtgcctccagtttggagctgaaaataaaacagaaggtgacattttaattccagtctccggcctggacacagggatgtgggcggcacttgtttgtaacatgatttagttaatgaactgcttccccaaataccaccgaattccctgtccgttcacgataatacactctatgtgagggtacagggtctgatgcttttgcagatagcctctctcttcactttccactcaaactcagtgaaaatgaaggcagcctgattgctctgagggcatgttgggccccagtgatgcttaagtattagcctgggaactctgagccttcctctcatcagcaaactagagatagatacctgccacggtgtcctgaatgagaataaaatttcaaaatcgttcatgtgaagcctacgtcaatttcagtaaatgaatcacacgaggtaggatatgagtaatgaatgaactttgagtgcccagcaacgttttccaaaatggctcttttgcgatgttaatgataaggcagaacgctggggctcctgtttgggatgcaccgccccttcaacagtcttgtctgccctgacagctcctttggagctcgcgttctttcacagaactgtcttcggcttcatgtgctcctctagccttttcaccctcttcctccgctatccactcatctcttcctcgattcctctttgttcctctcaaccgccctccagccccttttcttctctgataaggcagccacttatgcatccccggatacttctaggatagggagcccctgaagctgcccaagaaaaacaaaacaagcccccacccccgctccagaaagtgtacaaatccgagctggaacaaagtgattctttaactcacattcaaaagaattttcctcagcccacgctgcgtgtgctgtattgttaacttgtatcaaaggggttcatatctcaggaatcacaggaaactttcaaacatgattgatggctagtcaaaagaacatccttggcgcgataagccgcggagagggaatgtgctgagccggttcaggatcggcctggctgtgcctttcaaattcctttcatcgcaatggcgaccataagctctgcagggtgagaacaagccgggactttttgtggaattttcctaaccgctgatatgtaatccatacagccagaggtagcagcgagaggataaaagatttaaagaaaatggagacacatggactgattttatttttttttaagcaacttggaaagaaaaaagggggggtgagaacagcaaggtttatgttaacccattgggagtgcattggaatttctttgatgaaggattgagattgctttaaagcactttattgaagcaaaatgtaagtatagtgaccagaactcagggtgactgggtcactcatctgcttctccctcacccaaattctgcaggctaccaaattgttaaaatgctgcactagattttccttttgaataggaagctgtataattagtagaaactctccctcttcctcttcctccctctctctctctctctctctctctctctctctctctcctcttcctctctcttctctctctttctctccttttctccctcttctccgtgtgtgtgtgtgtgtgtgtgtgtgtgtgtgtgtgtgtgtgtgtgtgtgtagtcaagctaccgatgtgaagatacagagtatcttaaggatacagaacttaaaagagacagttcttacttcccattgtgtagactcctgaatagagcttgggtcatcaggttgggtggcaaacacccttaccctctgactgatcccattgaccaagaggaagggggcatgtgcacatatatgcccaatgaaacatgaaaatggttgctaaaatatcaataccctattaaacacatccttccttgccatgaatcagatttaaagtggcatttcaaaagctggaacaaagcagatgacatctatgaaaagacaaagcaatgtttgttagtttccactgcaaagagactcaaatatgtcttaggaagcaagaagacagtcttagctggggaggagagaacaaaaaatttgcctggaattgagagtctaaagcttcccttacacagttcaggtatcatgaaagagcttgaacaaaaaataaagtttaataaaatggaggccagaaagacagctcaatggttaagagaactggctgctcatccagaggacccagaatcgattcccagcatccacagggtggctcacaaccatctgtaactccagtcccagggaatctgatgccctcctctggcctctgaggaaacttcacacactgggtgcatctatacacatacatgtgggcaaaacatccaaacaaataaataaataaatgtagcagttggtcgcccacatcctgattatgctttcatgttctacctcccctttattgcacacaaagttaacaggtatatgtgcacaaacaaaagtaaatacataaaattttagaattagatcagagaaccctaccatcatctgtcactgcggccgcaattagggtgtgcttataattatgcttttccatccatgttggctgtgaccataaagtaataacgatgattttaaaaaaaatactgctcatttatttaaacagtgctggttttcaaagatagtcatgcagctgctcttagattttgatgtctttgaggcttgtgttttgcatctgaaagcagtaccaagggaagaccccccccctccccaagtggttcaaacaatcacacagcagtgttgtatggcatcacagaagttagcttttacctcccagggaacattttggaaggatgatgttaattggggagtgtggagttcaagagcagtaattcagaaatcaatcatccttccccccagtgaagctgggacactgatggagcagcagagctggcccctgctgtgaactgaaacactctctccagagggatggaagaggttctagaacctcacagggacaggaaaaactgaaacccacagattctcaagacctctcccaaggccttaaaagcaaaaaacagtaaacaactgtcaacaagagaggagtctccaagggagactgtcctgcaggagactgtcatcagtcaagttgcctacacatcatggcggggctaactctaggaattcaactttggtgagttatcacccatgctgccatgctggtgtaggcttcccagtgagttagctgctggtctaagacgtcaaacccaggttgtcagactcggtgacaagcctttctacatgccaaggcatctctctggccctgaagctgccttttaggaagtaattcctctgcccatactcctccaaataaccccagtgagctcactggttccacaaactgaacttgggtagaattctgagcttgatgtgttcctttggtttgttcaaatctaggcagagaaagttcacagaacaatccctcactgccctcaggagcacatgctaagaaatgtatcagtctggtgcaactcactaatggagaattctcagtaagaaatacaaaggcaagtgcagtggacattccagaccaccaacactcctgaaaacaactagttaagtcattgtattaacatttgtcctgataaagaaatataaatatagtatatgcttgatgttagcaaacagacacctaccttaacacatcacagactttatgctaacagcctaggtggtttcttcagggaaatcaataatgctaaacttggcaatgatgacacccactgtctccacagaacagagactagtttaagaggacacaaagaaacttcagtaccctaaatgaataactgtctttccaaagacgactctttctttgcttctgtaaggaagctggctggggcagaaccataaacaggcatcaaagcagccagcaacatcagtgtcacaatgaggaattccagcttgtcctatagcatatgggccagttccctatgttttattacaagcctttaccatttgctggaaatcctcagagatggctgctcccgtgactttttttaaaatggcattttttattgtttctgtgggaaaacaaatatagtttccccataaaccatgaggaagggttgtttttttttcctacttgccagcttctagaaaatcagtcaattaccttaacctttttcaaaaacagaaaggaacttagcataaaatgttgaacttctgctctcagagaaaacccataatccaaagtaagtagacagttcgtgaatgagatgagctacagcatgatccaaggtccaagtgggggacgtccttgaggccatcacaggatagactcggaaatatcacatgtgccttcagagcagtgggtgagtcatcagatcctggaaaaggcatgggatcagcaccagggataggctgattctctgtcagagctggccaacttctcggataaactaacatggtgcttgcacttcggcctcaactggtgtgctaatgccctgagaagggaaaaggggtggggtgaactgacatttgttgagcttctatcctgtgctaaagactttctgtcacaatggtccactgtgagaagaatcgttgcctccttttctatgcatgaatcaactggagactcagatgttaagtcatttatccatagccagagaacgtgcaagtgcccacacaagattcagaccctgacctctttagtgtctacagctagatggtgtgtgtgtgtgtgtgtgtgtgtgtgttcatgtttgggcaggggtgtgtgtgtgtgtgtgtgtgtgtgtgtgtgtgtgtgtgtgccttggccaccctctgctgccattactcatgtgccatacactttgtcctctgagacagtctctggctggcctagaacccactaagtaggtttggccggctagccagcaagccctgggaatcctccctcttctctgcctcccagcactgagatttcaggtgcctgccaaccaactcgtttttctaacacgggtcaaactgcaatcttcatgcttataaggcaagctccttaccaactgagctatcatcccaggtcctgaaagctaaatgcttttaacacccctaagctgagtatgagagacagacggcttccaaggtggtctgtctgtgctctgcactcgcttaatgtacgctatgaaaattcaattgtcataatcagaatgagactcaagagatgcactgctattgggttcctttgtgtgaaagttcattgaaatgtattgaaacacggaaagaacctatcacgtgatataccttgtgttgatacaagcatggaatcatcaaaactgttcttccccatctgtctcctcgacaccctgcccccaccaagaccacttactaacaaccccacaacaatgatcaagtatttactctataagaacaagtgctggtcctcagatgggatgtggcatttaaacaggtgaaaactatctaagagtgtgaacccggtaacgatagggcagtgtccatctcctgacttccagctcccctctctgctgtttgactcactttccacagccttccactagaaagctatatagcagccatttttcagtgtcaggcactcattaaataaaacataaactctatactccatgtggctccgaagaaaacacagtgtgcaaacagcactcagaggcccttgttctcaattctgtttctcccatcagcagcctggttcagaaccccataactcgtccctcccacgagtgacatggctgcagagtgagttttttagagaaatagataacaacatcccttgaaagaaacaagggaggcatttcagcaaacagggtccatagtactgtggctgtcagacccacacgccacctctcaggacttgtcttcctctggcgttgctccaactatgctgcttgaggtctgtgatagacaacggttctccagcacttctcaggtagacgatgcccaggatcttctctgcacttgattcatgaagaactggaagggtagcagtactaaaggactttcccctcggttaataaaagaatttgagattgcatggaaaagctcagctgattgcagaggctctgggctgtaatgagacttgtgaggtttctctgcctttaggccaggcctttcctaaacaacctggctgagactataacctattttaaggtcctcttaggaaaagtttttaactcttttctcctgcacaggaatagagagaggtatggagggcaatccatttccatctccaatcaggatgtgtgtgatacagcatagctggtcaacaaaactacattccacggcaatagctaaactagtctcttagaccattcgtaatgaaagtgcttttctgtaaatcacctatttatgagacctgaactaagcaaatccagccaatcatttccttcatcaggatcataccatggctcctttatatcataagccatctcacgtaggaagatgggagaaagaaacccaaacttaatatagtctgtggctcattccctcacttcctccaggactgtatagaaatgtcattccctcatgaaaccttccattataaccccaatcaaaatgacagcacacacaagcacgcacgcacgcacatgcacatgcacacttatacacacatgcacacatacacactcatacacacacacttgtacatacttgctcacacacaaggtcatacaaacacacactcacacatacatgctcatatacacacatgcacatgcatgcacatacaaacacactcatacatgctcacacacacacaagctctctctctctctctctctctctctctctctctctctgtctctctctttctctctctctagggttttgtagtatagcttgggtaggtgatgccatcagaagctcctcccaggctgaacttctttaatttttcttttctctgagtacttaccattgtaaaatggttttgttgtctattttcccaacaaactgtaacctccatgaaagaaaatgctttggtcctcttttttttttattttgtattcctatctattaaaacataacctgatacacatcaggtacttatacatgactgttgggaggaccaaatgaacacacagcttcgtgcaaggtatggagcctcatgttagctaataaatgattgctattccccggcaggatgtacactgatgaatatgcaacaggtattcccatttagagtatcagttctccatctctttaaaagtctggagtgtccagcactcaggaaacagaggcaggtggatccctgtgagttcaagaccagccttgactaaaaagggaagtccagaacagctagagctattacatagagaaatcctgtctcaaaaaaaaaaaaaaaaaaaaaaaaaaagaggagagtctggaatgtaatccttggagtctgggtgctagactgagatgcaccttctctcaaccccaaagtgaggcaaaaagacagggcgtctggcttcctgctttgggcttcagccaaaccatccctttccttctctctcttatgcattcaggttactaagaaagaaattgtttcactgataaaagcatagatactccagccagaccttgaggttgaaaacagtgaaagaaaatagggtgaagtgtaagtgaacacgggctccattcattccataagtacttatagggcattcattgtgtgtctgctcatgccagtcactgggaaggcatagggaagcacaccatggccaaacccaaaatcaccaacttcccagtaataattataataaccttgggaaatgtatgaaatctgagcaaactgaagaagagtgtgtccttccagaagcgccactgagtcttgaggactatgggttagatgaagcctcgggagactaaccttcacttgatggtttaaaataataccgtggcttcttgggactctgccctcaataataaaatatgacacttgaaagtcaactgatttgtgaagtccctcccaaatgccacactgaatccagattcattgacttaacctgcactgtggtttgtcatctaccactccaaaattcatgctgaactttaattgccttgttaaagggatcagttagatggggctttaagagttgatgaaagtcctgtggtctctgcctttatgtgtggaatgaagactgttatccagaaacaaactcagcttctctctctctctctctctctctctctctctctctctctctcccccacgcttcttcattgccagcaagtgttcctcctctcaggtgccagcatcatccaaggtactatcagaaggtggagcctttgcctttacaaaacactaaatctaccactgcctgccttgatcttgaacttcccttcccagcctccagagccattagaaatcagtatctgtccacaaattatcctgcctcgtgcatctgttacaggagtacaaaatagacaaagacctcttacagacaggtgaaaccagcagtttcaagtaatgaattgctgaataaggatgctcggtccattcatctgaccgttaacgttgtatatggcacagtgatcgtcagtaggctctaaggaaaagtcatttgaattgattggtgttctcttccacatatgagagatttttgttgcattgtccaaattcaacttcaagagttccattatagctatggttgatatcagaagcaaggtaatcttgaaataagttgtggatttcaagctttattgctcatcattgccatcatgtttgctttgcattgaaaacaaatctccacatttaacatattgaagaagaaaacaggatgcttagttctggcaaatttggaaccaggacagatttcaagacattttcctcctccatgctttcaaatcataactaacatgtcagccagaaatttgttcgctgtcatcagctactgaagcatcagaagttaacagtgtagcacaatgacagtgagggggatcctgaaggcttgcagaactcctgtgtggagcttttaagttatatgtaattttcattgtactcaaggtgcctaagaatttagtttctgcccagagaggttaaaggaaatgacatcggggggctacagagatggatcagagatcaaaagcactttctcttgttgaggaagaaggttcagttcacagaacccacctgactactcggttctgtaactccagctccaggggatctgatgccctcttctggcctccatgagcattgcaagcattggtacacaacaagcatatacacacatacaattttttcaatttaaagaaaatgactttacataaaaaaagaatcaagttatagaaatacttctgaaactggttactgaaaggtccttcattttaagaggaaacaaggaggaaagcataaatagatatgcttcaagtatgtcatgtgctctggtttgggtttttgtcattctgtgggatagattctctgggcttttggatagatggcagaagtgcttagatttattaagtgatggcagcaatacctagaggaatggagacaggataggtcttaggatctggtcagtgagccatcaaaatgaggcagagccacacgacttattatctagcattaggaaaaagtaaactactaattcatgctataatatggtgaaaaacatatccttagcaaaagatgccagtcacaaaaggccagacatcaatcagttacattttattaaaggcccagtaaaagcaagtctatagagatagatggtgtattcagcattatccagggcagagagaagctaatgaatatgagaggtgagatgacgaaaatgtaaaagtaggtattggttgtagtaatggttttttgtgaccatgaatgaaccagaatccacttgctaagtaccaaacgtttgtgcctcaaagtttgaatattgaagtcctaacctcagtgggatgctactcagaggtaggaatttcaagagactgtagatgaagacgaggttcccacaagacgatgactgtccttttaagtaaaggaagcgatgaggactcccatcccgctgtgagggcatactgcaagaaggctgccacccaaaagcctgaattgtgccctcactaagatcccaggctcatctgggcctactggtgcaggactgtaatctcagctaccaagaaactgaggcaggaggacccaagttcaaggcctgtctgggctatgaagtaaggtgaaagctagcctgggcaactcagtgacaccctatcttgaaataaaaatgtaaaaagcactgtgatctaaaaagcttgatggtagagcacttagggaataggctaacagctctggcttctacagccaatgatgaaaaagacaaaagaggggggaaaggaaagaaagaagggagagagggaggaagggagggagggaaggagaaagggaaaaagggagggacagagagggggaaagagggaggaagggaggaagggagggagggaggaaggaaggaaggaaggaaggaaggaaggaaggaaggaaggaagatacaaagaaccatatctgtcagcaccatgacctttgaaaaataaatatctacaacttctagtcctgagtctacggtacttaactatgacaatctaacctgacccaaataccaccgagctggacatttttaaatagatgaaatatatggtatgtgatttatatcctgagaaagctataattatagtactaaaaaatactgctgctactacctatcagatttgttgtaaagataacactggagaagggggatttggcttatctttgtcacatgctcttacagcactgttgccttgttaatcccaaggctctgtatcatagcagtttcattttcaaggaagtagacaaaataatgttgaaggaaaaaaaacacataatgcttatgaaagttcccatttaaaaaaaaatcctatatgatatcagccatgtaattatgtttaagttctcctcaaacaaggcattttctttcttttttttttttaggaattttaataatttttttattaaattattaatattttcacatgtactttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccaggttctggctattacaaacaatgctgctatgaacatggttgaacatatgtccttgttgtatggacaagcagtatttgggtatatacccaagagaggaatggctggatcttgaggtagattgattcccatttttctgagcaaccgccatactgctttccaaagtggtcttacatgttcacactcccaccagcaatggaggagtgttccttcttctccgcatcctctccagcataggttgtcattggtatttttgattttagccattctgacaggtgtgaggtggtatctcagagttgttttgagttgcatttctctgatggccaaggattttgagcactttcttaagtgtctttcagccatttcagattcctctgttgaaaaatctctgtttagttctgcaccccactttttaatttcattgtatggtgttttggtggctagcttcttgagctccttgtatattttggaaatcagtctgtcagatgtggggctggtgaagattttttcccattctgtgggtggtcgttttgtcttactgactgtgtcctttgccttacagaagcttctcagtttcaggaggtcccatttattgattgcagacctcagtgtctgtgcttctggcatgatgttcaggaatcgttctcctgtgccaatttgttcaagggttgttcaaacaaggcattttcaatgccaccttataaatccaaaaagatccaagaccttaagaaagtcgtcaaaacaagagtttgtcatcacgcaatggtcgctttcagttgtcctgtgtgacaaatatagagtgttccacgggggaccgtgcacctcagggctcccagtctccctagaactccttctccatctccatggcaggagtcacttgagccagacctctaactaactcccagtttgatacgttggtctaaaaacattctactaaagcaagcatttcccaagatttgttttggaaataggagataacagtgtaaggagtcatggccaggcatacatgaggagggaaagtcccggacaacaaatgtaatgttgatcccattctgaggtccttgtttccctggcactggggcatatctcagtgaacatgctgtcttgtgtttcacctaacaactgctgttagaatgttagtgacagatgagaaagccattcaatcaagactgtcaaatgtctaactagatggagttgaaaaacaaaggaagggaacggaactgctaaatataacgcattcagacatcaaatcattgcaccttctttgttaaagtggaatgcgcagataaagggttctctgtgattctccactgataactccatcaggacccctcattgactgctggttttcaactctatgtagagctgatgaagctgacatccagcatctgcaccagctcactgcagaccgaaggaaggactctggctttctaaaattaaaaaaggaaacatcatttgatttcctgaaaacttttaaaaggctcttctgcaaaaaacagctagataaatctgaagtctaaaaagcaaactgggaagctgaacaggtgcctttggtcccatcagtcagttgcaaaggtagatagatctctgagttcaagcacaacccactctggtctactgagtgagtgtcaggccaggctatgtggtgaaactctgtcaagaaaaaaagagcagagggcaaaagagtaaaatgtttgcaccaagaaaatattttaaaagtcttttaaactaatatgaaaagatgatccaacaagaaaataagctaagggctgagcatggtggctcatacctgtgattccggcactcaagaaggtttaagttcaaggccagcctgggatacctaatgagttccaggatagaattacatagtaagactttatctcaaaaaacaaaaaataaagataaaacaattttataattcattgaaaaatgaatacaaatagccaaaaaagactgacagtaagattacccatagtaataatcagagaaatacaaataaaatcactagttatgtttttcaccagacaagaagttgacatttgaaaatgccatgcaccaaggtttttgagagtcatcagtgatggctgagagcattacaacattcactcctcaccacctgttcaaacaaacactgttctatctgaccagcgtttctatgactctaaacacctactcatttagaaaagctacagcatacacaagtgtttgttgcaatattatataaaacggggattattaaatacaacactagctattcaagaggtgagatattatatagtaaataaaaggaatgaatgctcattgtatattgcatgattttgttcaaatttacaacattaagtgcaacataagacttcatgttagaaaacaatagcatacattttataaaatgaatgtatatatgtatgctagcacaaagaaatcaatcatttgggataatataaaccaaacttagagtgtgaataccgttgaaaactaggtcagcgaaagagcaagatttagataaaataccagatatgatgattcacacctacaatcccagtacttcggagactgagacagaaggataaccagttcaaggccagttggggacacttggtgagactctgtctcaaaatctaaaagagatttagatggagttgaaggggatttgcaatcttcctgaaatataaaatatttcagtttttggaaaaaacatagagctttcattacatttaatgtaaagataatgactatagctaaggactatattatattcttaaagaatgagagtagatgttaaatgtcctcaccaacaaagccggtggctatatgacatgatagacacaacccctccacaaatcatacatgcttcaaaatgccatgttcttcaagataaatgcatacatgtaactgtacaagtccatttttaaaatagaaaaatacttaaatgttttaaacagagtatgtgttcaacagaattgccttcccaaatgttcgagtggactgggtgcatagttcagtggtagaggacttgcttatcatgcacacagtcctaggttcaactcccagcaccagagggggtaatgaatgctgggtcatgtgtatatttggttatttttgtataaacatatttgtggatataagtgtgttttccaaatcctgcaaaagtgactgttacagcttgttattaacagtcatgggagagacaagcccaaccttaaggatgtctgatttcagagaggtaaatgtactccagacataaaagcattttctgtccttagagggccagcccactaactaatacactgttagatgaaacatcaggctaaaaatctttattaagctgtaggctcaccttggaaatcagagagagtggacctttgaagaaatgagtacagccaggagatttttgtgattaaacattaccacataatttgtcttaacacttttcctttttaaaatgtcaagataattatatgttaaatattatcttaataagccctagaaattcaggttttaattatgcaaacttaggaaatgtaagctcttagcctcacacctcttgcctctggccccatggaattgtgggggctataccaaatccttcattacctggttacaggctagtggacagcgtgacattttgcttggaaatgatataggataatataagggaaaataactgtgccttttccattgtgcttttcctggaaggccataaataagtaaaattgtgctccccttgatttatgtttataactgtgattatgatgatttatttcgggttgagtgctgacagtgtgccgagtgctacaccaggctcataagaagaaatggttatgccccagaggctaacataccaagacaaacacttcggccataaaacacaccactaagagatgcttactctcagcagagcgaggcttctctgagcttatatgtaggtggagaaattttcctccatctcggggaaggagcttaatgcactctgaaagtcttcgaggctgattcctataaagatttcagacaaggatagagaaacataaaacagtgttctgggagcacggtgaaggtggtgggcaatggaggatccccggcaagcaagcagtcaggtactgggttacatgctgcaattctaggattgcctttcaaggtaaacatctgaatccaaggtagataaaacgtgctgctttctgtatgacaacccttttaagggttaaacccttttaagaataatgtaggatgagaacatttaacaatgtaaaccagtatttcaaaacacatattttccagagaacttgcttgggagggtattattagtttgacaaaaacaaaaatacatttgtggacaattgagtttgaaaagtattgttaaaagggtctcgatagggaacttagtattgataattaactaaattgacgccatcaaattgccttccaaatagctatgtttgtacacagacaagcgctgccctcagccttactcagagaagcagctgtttaaaatgaatggtggtaaattaagagattcagggctgcccaagatgctcagaataagtgacagttgtgggtttagccaaagacgagacattcacaccactccctctaaggctcggggaacgctgcaaaaggcgagggaagcttgtaagagctgaaagatggggtgaagggctacaaatgtcaccctctgaagtgatacagtcattaacaatcatcagctcacagcaactgtgggcccatacaaggccaaccctatcaacaatcagtcatggaaagggaaagggctcacaaggtcctatgctgtagtgtccagttattagatattggcagattctaggagagaagtcactgtctttagctgtgtgctcatttgctgatcacaacaggctccaacaaatagttcccattttcacaaggacagctctgaataaacccagtaggtcacagcctcagttacttctctgttgctgtgaagagacaccacaccatggtaaccaatttaagaaggtgtttaattgaagacttgcttaccctttcaaagggtgagtccatgaccatcatgatgaggatcacggcaggaggcaggcaggtgagacactggagcagcagcagaagagtttatatctgatccacaaattggaaatcgagagtgagaggctgggcctggcatgaacacttggaatttcaaagccagtgacacacctcctccaacaaagccatacctcctgatccatcctaaagcagttccaccaaatagggggccaagcatttaaacccatgagcctatggaggtcattcccatttaaatcaccacaatgacaaaacaaactcaatagacaaggacatgagctagaactttgtggggagggaaggatggaaaagggtggtaagaagatggaagagcatggaggtagggatgagagcagccaacacatgtaaaatgtgtgaaattatctaataacaatagataataataaaaaaaaacagaaggagttccaatgcagggattgtgagacccattaagtgggccataaaatttgccatcctctaagtttaactaaagagcagttctagtaggcacttcacaggacttttctaggatactcacactggaaatcaccaagttgattgacaagaggatgaacagaacttccatggtggtttgaagagttgtttccccaatgtaaccctcgcatcaaaaggctggatggaccctgccgtttccaccagctgagcaccgcaccccctcaccttctaagcatggttagaaggaacaggaaagcaaactaacgtcaaataaatgagtctacacaaatgcagtgcccagtttcctagaaagtccccagtgacccctgttgcttggtttttctgccctggggcattttcctcccacaataaatacaactaaagtgtgggcctcacagagtgtgctgcaaggctaggtcacgaaccacattacagcttgtaccttgctgtgttggatggcttgttctggggaaagccagctgccatgttgtgagactcacagagggatgcgtgccgtaatgaatgcggtacctacagatgctccagcgagtcttcctggaagcattgagtccagtcttcagatgactacagctcagccaacatcgtgactgcaaccccagacactgagccagggccacccataaatgctccaaaattcctgactcacaaaaacaaagtaagatggttttaagccatgttagaagacattgtccagactttgaagatccccatggacggcctcacactccctggggaacagaaagtggatggcatagagagttggtgggggcaggagaggagggaagggcgagggaactgggattgacatgtaaaacaagattgtttctaatttaaattaaaaaaggaagaagaatttgttcataggtctcatgagagcagcatgattcaaagagactatgaaataagtgacaaggtagacatatgtgagtaactgagcataggagagagagaaactgagctttgaacttggggaggtgggcagaagagacgggagagaaaagatagtaatatgtgaaattatttttgcctggagaacaattgtgttggttggtttcccatcactctaacaaaatacctgagataattaatttgtaatgaaaaaaggggctcacggttttggaggcccctgtccatggtggattggccttgtcactttaagcctatagtgaggcagaaattacaccatggtggtagtatgtggctgagtaaaatcactccatggtaagagaggaaagagaggatgactgaaattacagtcttacagtcccctcaaaggcacaccaccctatgacctcaagtcctccctctgggttacatctttcaaaggttccaccctcttcctgtagcaccaccctgaggatcaaacctttaacacattggtctttaggggactatccagactgaagcacaagtcccattaagaccatttgggaaacgtgcatgaatacaactgaatatgaatgtctggatggacatgtaaaccataagaaaataaattaagtcctttgggaccgtagatctgaccccaaagcagaggtgcataaatgtgctccaatctacttttgtaatattttcatttgtgttgacaatctttaaagaattctatacaaggaaggtggaattattttctctcattacaccaaatccagaaatagctcatgaccaatgatccattacagctgccaatagaaataaatgtactcgaaactttgcaacaggctcaatatgcacacagtcttacccagggaaatgcacgtagcagtaatcagtattcctctccaggctcggacctggtggataattacaattaagcttcaatggattagctgccagaaggacagtacagagtgaaaggtatgttacagcactactttttcttttgcaacaaatttgggcatgcaggttgttcttggttttgtttttgttcttcccctcctccacaaaaaaaaaaaaaaaaggtatttccaattaatttagaagcacatcaaaatgactgcgggttgtgctgggtggcaggatgaatgaggttcccagtgactctctccactatgttagcaatacaagggtcactcacattacttccagagcctctagtttacatttctcaattaggagataatcagtgtgtcattatgagtaaaaattgttggaatgaccttttgactgtctattttaaccagcaaatctgcagggagggtttgatggaatgcatgacaggagaacaaggcaagttatactggtgataaataaggacaattatcacacttattatctgataaataatttattgtgatttgccattaatccatctcacactgcctcctggatgaaaacacaccccgaagagtgacttcttcagcgtttcctgtgacatgtcagaaactcttgtctgcaaagcacaaaggaggcatttacctggaatagaaagagctgtcattgcacacttgatcattttaatcaatgcagataaattatgcccctcataaatggtagatcagtacttctcactgactttaaaagggaagtcttcaagaagccagctgaaggacaagccatagcccaacacttaggagtctgctctgtttcagatcctgtcatcaattcttgctaaaagccatcagtctacacattttagtcaacatctgaagcttaatcctaagtacagacaatatatcatcttacaataagataattaaattctttacagaactccagagattcagctggtgaggactggttggatttgtaaaactgattgtgaatgttagagcaccatgatgaatgctgcttcttttaactctggatcgtcctcataggcatgtgtgaagcatgttcagctctgcgctggatgagtgaagtagacaggccctttggacacgctagtcatacttccgatttcaactgctgatttcttgaatgatatcagcaatactgttttctcttttgtacactcaagaagagacaccatctctcttttttataacctttgttctctttcaacagtagagtttaaggaaaatagtttgactttctactgtgtgttatgctaaagagatacttcttactctattttgttgtctggcttgtttttctcttgccatctgtggtcactgttttgcttttctgtactcaggtgagctaccaataagcctgctctcatttcatgggctcccaggaacactttgagggcagaaatccgtgtattgctatcagaaaacacaagctgaaattgcctgttgtggtcttccctgcaagtgaaaaacacttctaaagcactgttgaggatgtgattatacaacagtgcaagcaatgtgacttcctcagagctagggaactcttccttacaacttcccaaattcctccgctacaacagaaacccctttaaagttgcttttaggatgtggaggtcaacttgtctcctttattcccacagacaggataatgttagtgagggaaaggtactgcagtgtctccaccaccagtacttcctcagaaacatggagtcaggaaatggcttgttgaccagtgttcccactcagtttgcctgtcggctcttgtcactgtgattaatacctagccaaagcaacttcgagaaaggtatttttaagctcatgttttcagaggtatattagggctctctagaagaactgaaccaatgggatggatgaaagatgtgttccatctatttatattcaaatatcagcagcttcctcacacctgagaggctgagaaccctttatgtgtttgaatgggtactcatcagtcagagtagccctacaggtggctggctcacactggggaagtcaaccaacatcctagttgcttctcagtcccacaaggttgggtactcagcagtcccaatctggagctgaaaagccagcagagttgctggctcttagtccacagtggaagcctggagacactggtcctgacatgagcaaaggaagcaagcagcagcagcagcagcagcaccagtaactgggtaaaccaaccaggctgcaggaggaaaggccaagcaagcaaaaagcaaggaagagccttccttctgctacacttttttgtctgggctgctagcagaaggtgcctcccacaatcaggatgggtcttcccacatcaataaggcaaccaagacagtccttccatggagacctgctactcaggtgatactaatttgtggcaagtagacattaaaaccaaccatagctagggatttcaatcacttagttctgtggtcactgtaagccagtggtaaagcaaagtgtaatagcagagaatgggtaacagaacacagatactcacctcacagtggccaggaaatggagatggacagaagggactctcttccaactaggccccacctcctaacaacccattcagctatgaattcatcaatgaattagttcactgagtggttgcagcctttgtgagccaatcaccacacaacgacggaaccaccagatgagggcccagttttcaacacataagccttttggaggccgtttcaaatgccaaacacactactcacagtctgaaagtcttttatccactgtcaggtggtgagccaggatcagtatcatagcccacagccagcacatcactgggagaccccagctccacacatcttatggagcacagctacagcatggaaagtgtcctctgtggcaatgtaattttaaatgatggggagggtcctaaaataagttcgattttcctacaaaccatctctaatacatcatatgtaaggacatcttagtgaagaatcagaggaactggtccaagaaagctcataaaatcagggcatctggaagtctgtgacaatgtaccattgaatattttaatgtcatcatcatgagaattcagaaagagaaaaaatacctcttctgactttctcctgtgtccttccataccacatgtatctgtgactatggtttggtcagaacacacaaatatcgtcctaaaatgagaaagaagcaaactttcacatgcatttcttacagatatgctcctctttttcaaagataattccctttgaatctcattatccagccctcgccttccagaagctccatgggattcagttaaggagtcctggattaacaaggtttcactgaatgcaaaaggacaagccttcgccttgaagcaaatccaggatggcccttctgccaagataggaccctccagtacaccccagcaagaatgagcttacaactcatagaattccagataccctgctgtgggggctgggggctcaccacttagcacctgtggtttggatctaagcaaacagaaaactagaagagaggacaaatcaccagtaaatttcttaggcgtcgatccacaaatacgaggagccaagggaaataaccaggaaggccttgaagtgatgctcccagaaagggaattatgagctggttggcatcagggaagctgttgggataaatcaagtgagtgaaacgtcaatactgaggaatgcaatctgtgaagagaggacaaaggggtgggaaaggagggcttgcgccatagatcaagaagagcgggactcgcaaggaaatacagatggatgataaaggaagtggcagcattgacgctttatgagctaaggtagaagaaatatatgaaataaaggggaattagcaccaggtgtcctccatgcaccactaaatcaggatgaactcactgataaattaccatacggggaaaaaacagataccatgtccccataaataaataaaatgtatcatgcagtataaatctcaatgcccatgttgctccccctgctgctccctctgaaatggcctgaggttcctggagttcctctccatcttttcctccttctgactctcaaataagtgtggtggctaagacccctgtttaactacttgctgttgagtgaatgactgatagtcttggtttgggtccctcgggtcccaaaggcagactctaacctctctggggtttaaatataaataaataaacaaacaaacaagccaaacatagctaaatgctaagtgacaggatcacaaaactctgctacttgagatttcaattactgggacattgtttaagggataataaaaagaagcaaactgcaggtcatccggggatttttagagcagtgtcgctcttagtgccctgtttcataaagtggaaagggcagctagaggtgaggtaatttgggcctgctcacaactcataaggaaaaaccaatcaggaatcttgaggtgaagggcacttgggagcatgacctgattccatttgctatgcctgacttgtgcaacttctcatagatacacaaaataggaaaagggtgaagccgtaagagggaattctaccctgaaagttaaaactcacgagggacaaatcagtggcacaaaattacactgtgaaatgtcattctccaaagggcttaaacaagaagtgtgataaatgttattactctgcagtgccataagggtgttgaggactcaatcactgctccgattttgcccaacaagtgcaagaaggcagttataggaaaacagaccctgctccaaagagctttcaaggccaaaggctgtcgaggagaagcaaaatgggaaagccactaatatggccatcaaatgcacatataacttgggttcttcacagcctggtggcctctgggtttaaaagtaccataaggtcagggtgagcaaagaacaaataaagttgaaggtcagaaaggtcctgaggaatgcagaccaggaccaaaggaaaagcagcccacggcaatccttaagactggcttcgttaaagaggctcagcctacacttgcaagaacccggtaaagtcctccaagatccggcaagtatgtctaagcctggagaacagctgcactgctaatctgggatacagatcaaagactatccaaatagctagaaaacaacacccagggtggggggaactgtgattatagaaactttacaaagactgtgtgtgcctgtgtgtgcctgtgtgtgtgtgtgtgtgtgtgtgtgtgtgtgtttgtgcacgtgcactcatgtaagtgtccagtactgtcaagagacagactttagtgagtggaagtgttatttcagcattttttttcatatctatgttttcaacctgggagtgggttagtgtcagggtatacgacccaagtatgatcaaggtttcccaagttagctacccgcaggaggttttccaagaatgggcataaactaagggaaagctctctgtataccattaaggagaaggaagaaagactcaaaactccagaaaggctttgcatcccgaactctccttggtacttgatcacctagctatgaacaaggctcttcccaaggctctcaatgaatcagagctatcaccaagggtgaggcagaagagctggactcagactgggagtcctcaacagggatgcaaaagtccactctcacgtggctgtataacacactagtgtatttttaaaaagaaagatatgggataatatttatagtatggcctcattttcattttaaaaagcatacgctgtaaattcatatattttatgagcatagaaaatatttgaaacaatatagcaaaatcctgaactctttattcaaatgagagctaggactaggaggaggacttttatttttgcttgattcacttctgtgttttttataataactgtgttgtttttataactttcttaataactcccttattttatgactttcgtattctcagaattcaaccttgggactccctcacagccttttacagttgcttgttaaaataacatttgtctgttcagcctccgtgaaatctcttaaggtcaaaaatctaccctctttgtgaaacagagaatgactgggttgatgattggggttaaggaagcaaaaaaaaaaaaatgagaaagaaaaagaaacaggacatctatatataacgcctgagccttgcctggatcttgaaccaacgaaaactatgttttattgtggctgtaggacattattaagataattgacagattttggtgtcaatagatttaataatatcattaatttaatttgctgattttgataattgcactatggctatgtaagaaaataacataatgtttataatacttagagtgtttgggcataaagggatatgtatgtttcttaatcaggtcagaaaataacatttaaatatagatgcacaaacaagaagaaagaggatgcaaataggattaaatttagtgtggaaattatgccagaattgtttggtctgttcttgcaatttgtctgtttaagtctgacattatcccaagataaagttctgggaaatcagagaaacaagaaggcaggaaagtacccaggctacctcctcattcaccactgtctctaaaggaagcaatccgtctctattttgtttgtttagctggtttcatttatttgcaaagttttatcttgttaataaaacctgatatatattcaaaaagttgagttctgaacaatattttgtgtatggtatatgtattcatagggtgtgtgtgtatatgtatgtgtgaatgtgtgtgtatgtgtgtgtgtatgtgtgtgtgaatgtgtgtgtgtgttggggtgcatgtgtgtctatgtacatgtggaagctagcggttaacatcgggttttgttcctcaatctttcttcacaatttttattgagacaaggtctctcactaggacctggactcgccaattcaactagactggctggccagccagcaagccccaggaatgcacgtgtgtccaccttcccggcactgggaccctgggtgctcacctcactgctgcaaccagctgttttgagtgggtgcagaggatccaaacctcatggtgtggcaatcacttttgtgtgtgtggggggggggttgtttgtttgtttttcttttctgagacagggtttttgtgtgtagccctggctgtcctggatatctctctctctctctctctctctctctctctctctctctctctctctctgtgtgtgtgtgtgtgtgtgtgtagaccaggctgacctcaaactgaaagatccacctgtctctgtttctcgagtactgggattaaaggcgtgtatcaccatgcccagccaagtcacatcctcagccccactcaaaattaagactaactaataaatatactcaaagatatttcattcacaactaaaccttaagagccagtataattaccctaacctcttagtggtgagaaggtttaggaattgtagatggtaaatctatgatcagaatagaagctgagtttactagttgctcattcagtatgattttttaagtcagaattttgtgatgcagttgttctccttcagtggaaaattgcccctgggaaactacaagagttcatcaaaggcagagggtcagagtcttctgtcggctatggtgagacactggtcatattgctatgcaccccataaatcacaagtaataatatcctgaggcattctcttctgtattaaaagataagaactctgtttttgtttccagaaccattgctctcttccctgcttcacacggctcatgtaattcagaagatagacttcattcaaagaatgaaaaataggtgagtctgagtccccgtgcttccctccatcaattcagcaagctgcagaacgttatctgccttgtaagtagcccagctcctccaacaagatgaacctctttcctccaacagccttcttcctggggtctcaccaccaaccctgttaacaccaccaggagaaaagtttgtgttgctacaggaagcccaaatatgaactttatgtaggacaggcaggactcatttttgaagaacaaaacacatagcatatgtgaataatgggccttggcagtaaaataaggaaatatgctttgtgcagcctggcaaatgagggacctgctcaagtcattgcctaacaggaaatatgagtccagagtctttgtgtgcagatcctccagatttcccactccctgggtgggggcgggggataaagtgcacgatatctcaggccttcccacagatacattgatccatccacatccacattttagcaggattcagagtattatcatgtacattagtggagtctggcaaacactggctacaggaaatgatgcaatggtcagcccaggttgtgcctaagaaaagtgggaagaaaggatgcatacatgcaaacgctatcgagggcgagtaaaaccacaaagacagacgggcatctccagcaactcatccctccatcgaagctcatctcgtcttccctgagttttggatccataactggcattcaccccaactgaagagcagtggcttagcagcctaaaggctgtcatgtcaaaaggcattgaggagaaattaaaactaaagcttcagtgtgatgcagcagcccccactcttggttatacagccagagggaataaagtgagtgtgtcacggagatcctgcacccacaccttcaagcagcatcgatcacgacagccggtttataagattaaatgaagtatttgtcaatggatgaaacaacaaaaaaaaaagaaaacatggagtattcacacaacaaaatattattcagccatcacatgaaaaagaacctgttaactgagatagtgtggatgaacccagagatgcaggaagacaagcaggacatgggtgtgctagcggagagcaggatgggtttgaagagatggtcaagagtacaaattttcagttacaccagtagaatccatttagagggtctgttgtactacatagtgaactgtagttagccagaatggattgcattttgaaaagattttatttttaactatgtgtatatgtgcctgtgagtagaggggccagcagaagggggcatctgatctcctggagttgtaattacaagtggttgtgagtgctgaaaacctgagtcctctgcaaaggtagtacacagtctgagctgtctctccagccccatcccagtctttttaaacatggttttaattgacatgtagtgattgtgcatatttccgcagtgcggtatcactttcaatacatgaaaataatggggagtgatcagatcaaggtaactggcttatccattactttggctatttaccatttccttgtgttagaatatgtaaaagcctccctattccattaattgctgctaccaatagtgtcctactgatccagaatgtaagaaaccactccccatacccagctgtacctctgtgcccactcaccaccctttccccatctcttcttcccttgatccttcccaggatccagcaacaactattccattccctgtttctctgagatcagctttttagctcccttgtatgagagcatacagtgtcttcatcagcctaacttatctcactttgcctaatatcttcaagttccattcatgttgccacacataacagaatttcactcttttgtggatgaaaaaaataccattgggtattataacacaaattctttatccattcactcagtgatgggcatctaggtccgttccatttatgggttactatgaacggtaatgcaatgcacttgagagtgtaggtttctctttgcatacttacttcagttcctagtggtatacagtaggaagcttgttaaatcacctagacattctgtttttagtattttcagaaactaccactcttttttctataacagctaactcattaatattcccagtgtataggagctccctggaccctggaccctggaccccagcccagactgattattttcgtctttttgttcataaccattctaactagcatgagatatctcattgagtttttttatttgcttttctctgatgagtagggaagctaaacatttttccatggaattgttcatttgtttattttttgagaaatgtctgtttaggttattttcccattttctagtcctattatttggttctgttattcttgttatgcctttgatcaggttccttaaaggatctggaaatcagtcttatgccaaatgaatggcccgtgggtgtctccttctgttccataggctatcccttccctctgtagagtacttcctttgtagcacagacttccagtttgatggaatcctatttgttagttttctttggttgcctatgatttggggatcagagtctgaaaatgcttttcctaaaccaatattcagaagtgttttctagtaattacatagtttgggggtctcacatttaagtctttatcattttcctatgtaagatgagactcgtgtctgatgtagtttcttttttcttcatgtatgggtgtccaactacctcagcaccacttactgacaaggctgtccttccccccaagacatattcctgctggcactgccaaagattggttggagagaaatgaatgtgtaggcttattcctgggttctctggtctatcccatcagcctgtgtatcagggtttttgtcagaaccttgctgtttcactcataatgacttcacagtatgtttttaatatcaacattaaattataatgcttccagccttattctttttgtgtgggatttctttggctgttggagagacttttgtggtttgtgtatacattctccaaaattgctaagattgtgtattttttttcctttttaaatttaaattagaaacaagcttgttttacatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatatatatatatatatttcaaaacaacatatatacatgataagtgtattcaaattttccaaactaaagcaagaataagaaagtgttcaagtgtgaaatcattctttgcaagcttctgggctacacttcaagcctcacataactgcatatctatggtatacagaaccccagtctccacatctaactggactatagaatgagggggggattctgctttgcttttaccactttgcttctgttcaaacaaggtacccattcatgaagagctttccaaagtgcagaccatgatgcattttgaccacatcacaccaggctaccattgtgttccctttgcctgaaataccataggacgccccagaaatcagttaagtgaatgcttaaacttccaccaagtgaagtccctcctgttgtttccagcagaagctgcccacatcaccttgggacactacatcactgagaagttgtcatttccattgactggaaccatgtctgtcaaagtgctgccacatcccagtgggccctaggcaccaccgggagcgccactggaggcccacagctgagctgagcttctccatataaaggtataaaactgagcagacgaagctggtaactataggtataaaaactgcaatgatggagctgggaactaactataggtataaaaactgcatagacagagctgggaactataggtataaaaactgcaatgatggagctgagaactaactataggtataaaaactgcatagacagagctgggagctataggtataaaaactgcaatgatggagctgggaactatacagctctgtgagtaagagtgcttgctgtacaagcatgtgtgatgagtttgaaaccccagcatccacatgaaagtcagacgtggccacgtatgcttgtaacacaagcacttgggaagggaggagagacgggcaggagttcattggcccgccagcatggctggctgaaacaacaagcttcaggtatagtgagagattcagcctcaagagaaggatgagcaagttacaggaagacactgacatcctcctctgcgtgcgcacaaacaggtgcatacacctacacatatagatagaaacacacgcacacgcgcacacacacacacacacacacacacacacacacacacacacacacacacacacctttttagcctgaggaaaactgcatagattctgccataacacctcactgaactgtggtgaccctagtacttcagttttcattcccagttcgccttcagcctgagacctgaaaagagaccacaggcagggtggcatgccacccaggacaagaacccgaaagttgaaaggccaggcttgccatttacctcatttttctaccagagtgagatcttctcctgggattttctggatcctttgtgcaaataaaccttctagaagttctcttccctttccactcctctagttcggtgcttcagatagatgggaagggatatggtttagactcccgatgggagatcttcagctacctttacaattgagttcaaggctgtgtggtattctgtccatggagaatcacagattatccctgcaaggtggaccactgggcatagtgaccatgtttaaaggttacgtttccaattctgttccagaaagctcctccttcatctctttcccaactgaaacccacaagcagacattttatgtctaactggacttggaaaccaatgcaaagggttctcacgtttatggtccaatcttgtacttgaaaaagaagaaaggacacagagaccatggagcaggtcatgtcaaaacagaggcagagatgggagtcacagggccacaactaagaaccacagacaagagcagaaattgctcgctggccatgaactaacttgatctctgatctcttccatatacactactatttctggcaccttttccatcctggatggtcctccatacacacactaatcagacattggtctatcataaaggaggaggccacaacaggtctcagattcaactgtgtggcgggggtatcctcatctccctctatctagattgcagccccagctgctcatattcaaactcctctaaaatgtcatccatcttcccaggggtagttctgcagctaacaacaggagcacattaactccccaaagcctttggccagcccactcacccacctgcctcggaaggctcccattttgaagtggcaatgtgatccatcatgttctacagcccacacagcacagggggaaattaatgacactgactgtcattaatttcagaatgtcagaagcgactcaactagacagcagccttcacaacaatgttctggaaaggaacaccccatttttagtcttcagtcttcagtaagaaaagggaaagaggaaataggagagagagagagagagagagagagagagagagagagagagcagagagataatatacatacatatacacatatagataatgaagtgcaaaactgtttgcctaccaaccacagcaggaactatgctctaccagtccatgtaaaaactagagctgccctttccactcgttgcttaagcacttcccagacaccaaaggcaatgaacagagatgtgcttgatttagaatctcaacccagcccctgtggtttgcagatggggacttccaaagccaacccaatatgaaccgatagaacgcaaggacagaggaaggccctctggccatccatcacccactcccagaggctctgcttcatttcctgcccaccagacctcaagaatgaagactggtgtgctcgttctcacattgtctttctctctctctctctctctctctctctctctctctctctctcctgccacctccttttctctctctccctgcctgctcacccactcttcattcttgtttcaagatgagcccaggagtccatgtctccattacaaaacagctaatccccacacaggaaaagcggtgaggttaaagccagccagatctgcttagctgtgtgcactgcttgaggccatgcctatttccttcactgttcccatgaggaaaagacttctctatatttatttctcccgtccctggtccaactcagatttacacacccttaaacaatctacttcctaaatccaatttccttacatgaccatttacaaggaaacatgtaatgattttgaaacttggaccttggggagctgacattagggtttccaagtcatacccagaagaggagacaaagaaaggtgacaagatggacttccccttctcgatgtctcactttcacatatgggaattctttgtaggatgtctgtgcacatgaacgcacttgcacatgggtgcaaatggaggtcagaagtcaacctcaaatgtcatccatctctccctccaccactctctgtccctccacacataccccttttctctctctcagggtctttgactgatctggaatgctccaagtaagctaggctaactgaccagtgaatcacagggatttgctgcctcgacctcctcagcactaggaatacgtgtgcttgcaaccctgccttactttttaggattctggggatggaactagggtccccatgcttgcacaccaagcactcttatcaatcaaaccatttctcaaatgcagattcttcttaataagactagttttcattttaagaacaaacacaaaacaggcatcattttattataataggaaggcaaacattcctcatttgccaacttatgactattctgtctgtctttctgtctttctatctctctctctctctctctctctctctcacacacacacacacacacacacagagagagagagagagagagagagagagagagagagagagggtgccatttctgcttgccatgaaacaaaaaggactaacaaaggcctttgtgttcagtagtaaaaagccacagacaggtagaatgttgactgcttcctttctccctgttcttagaaccacaaactgccagagaacatgagtctctgaggtccagccctggtaacttgggtcgtgaggaaggaactcagaaaggctaatggcttcccttattattagagaggcaaagtttctaccagtttctcagaggttgcgggcacttgggatcgaaagaataaatgtttacaggagtcctttgttcacctatctgctcagttcactccaggaaagagttcagatagtttttctaggagacagcaaacaagcaatggtgctaaagaaaggtgaagaaagaatgcaagggtggaaccagcacattcaggtcttaaacttgcactccacaagtttgctccttactgccttgcagactcaagactaagactcttagaatttacattccctgtgcttttctggtctgttctaaattctgagtgatgaacaattttctacttagaactttaaataactaccgaggaggcaatgaggacttgcaggctatgggtttcttggtagatgatggcttgtacttatgtgaatctgccttgattttattaaaacctatttactcttctctcaagaccagcaccttcccatttaccactgactgaaagaaaccagaactgggttaaaacaaacagtgggccaaggagagggcctacaagaagcactgggtagccagtatcgtgcatggatggccttgtggatatacacaaatacctcagaaaagagtacttctccatctctaagatctgctcacaaaccagcagcaaccacctggctgggagtttgtccaaacaatggattcgtggtgttgtccagaccccataaatgaagataggcttcttagcatgacctctcattgatctttgtccatattaacacgtgatacataaactcactgatgtagatatttaaaatgcagaagtagaataattaaataattcctgggccattcagttcccatcattgtgaaggtatttcggttggctggttgtgttttgactggggttgaaactggcttggcatttgtttgtctgtttatattttagaggtgtctgttgccatcttcactgatctgcagtgagaaacatcaaatgagagttaaatgaagaaaaggtgattttggagccaatttgtttagtcatccttggcacacactgacagagatattcacccccagggggcataattgttcttgagaagtgactttgttgtagagaaaacttttgcttccagaggcacgagctacacagcacggcgcagaatagaaatatggcgattatccagttcatttacctgctttccacagcacacaaaccaatcctggtaacacagccataaaaatacaacccaaggtacctgaatcctccaggttaactgctaatgtggctcagataaactggatttcagccagcctcccacatcacactttgaagacttaaacatagaacaaaggggtgcgcgtgcgcacttgcgtgcgcgaacacatacacacacacacacacacacacacacacacacacacacacaggtgtgagcagggaggcaagtaacccctgtgtaatgacagcattgtgaccaaggatgacatcaggcttaggcaaagcctcaccaccccattttaaagtggttatcacatggaaggcagagtggcctgccaaaatacagacacagagatggtgtgaattccatgtggggagcagagacaggaatgtcagcagaacactccacctggctgggtagcaacacacgcaggactgcaggggagagtccaacaagaaagggaagggttttggcagggggttgtttttggttttgtttttttgccacatttgttcaaacaaggtatggcaggccagctggaagatatgtcagtcaaggagaaggctctctgctcagaggtgtttctgtcgcttggacatgacagctcctcaaaactaaatataaagggaaattacagctagatttcctggaggcatggagtctgctctgattgcaatttagaaagccagcagattacatagtatttgttcagtccctcctaagcaacaagggcctttctggtacattccatctactgcttattggaagggtgtagggggtggcttattggaagggtgtagggggtggcagtgccttcctgagcccctgtttagactctagggagctcagacattcctgacattgactgcgaatgtttgtacatattgacttttttttttaatttattccttgtgtctttcacaccatgcctcccaatcccaccccaaataaaaacaaaatcaaatttaacgggggaaagaaaaggaagaagggaacatctcattatggaagctgcagtatgacacagtgagtcacatgggaaacccttttatccacgtttttgcaggcatttaccgaaaagaatcgttggtctggttcaagacctctggtctctgctgcaccgtcgactttggatcctcaatgggactcttcctggacatcccattgctgccctgtgtcatggaaatcctgcagctccataggactggccctcccccatgctccagcagatcacagatggagtggatgttggggtgggccaactcatagccctggttctgagcctgggtagttgtggggttggtcaacctgccagctctcccctgtcttcgtcaacagggtgagctatccagcattgccctggctagttcactccttgtagccatgagcaaggaacagcaccagttctcctgctttcatgtcctcagggagaactatctcaaaaaaaaaaaaaaaaatgtgggggagagatggtctggtggttaagagcaccatctgctctttcagagaacccgagttcaattcccagcactcccatgacagctcacaactgtctatgaaactccggtactggagatccaataccctcttctggccttcacagacactaagatacacacgtgatgaacagacatgcatgcaggcaaaacactcataagcatagataaaaataaattaaattaagcagagtctaggaacccagataagtagtaaagtgcttcacaaggccctggcttcactcctcagcacacaaaaaataaacaaacaaatgatccaattggctgaaatggctgtgaagggtaaagccctttctgccaagctctcatttggtggctttattcaattctcctaaaaccctgtggctagaatcaactcaaaaccacaaagggaatatggaagtttattctgaaaccaagtatgagtgaccacggctatagaacacagattcaggttacccaaagatctatgttccaacctagtaataggtttgttttgtttctgttttgttttgcttttcatgtttttagtacaaagaaagaaaggaataaaccaagggttattttttaattcaatagtggaaatatcaggcaggtggttatagcaaaggagagaaatctctgttataggtctcaaattgtgcatgatggcgttcttagcctttggtttggtggaagctaagggtctgtttgcacattccaaaaagggttttactgatagtcatgaggatgtcaggtcactcacagaggtgaacaatggatgacgattaaaggaacaaaaaaatagacccggtaattggctccaaatcagcaacatttctgatctccacagtcatagatgtcctagtcattggaccaatcctgaaaaatctttaatacaagtatggcttttttttctaaacacttcagtcggtacttagtcacttggtattttctttttcttttggtagaaaataaattgtaaaatttataaaagaagacactaaggagagtcagtgtgagaatcagcatgactctcagctggcctctgaagaacaaagctgagcccagacattaggacggaaggaaggccattctagctagatgcaataggcaggaagaaacagaacagtgggaaggaatataatgctaacagagggcacccctcctcctattgactgaggtaaaaatcatgagacttaagtgcatccaaggattaaacttccagcccatttagtcttaaatttcctgtcacccaatcccgctgcaaccaaagaataacctcgcctatcagagaccctgacacaaagcccaagagccacttaatgccaatatcgatccaagtgagtgcatctgtttactcctaatgcatagcaagcagggaacgtgggtttactgtaggtcaggaggaagccaagggtttacggaaggccttggagtccagacaaccacgtgcagcttctctagaaggaaaaggccatcagttaagtatgtagggtctaatgtattggtagtcccccaagactggacctacctcaacataaataatatttggagactagaatattccatgcacgctgcaatacgttttagtcaggcttttagacacacatggacattcgggacatccttctgctttctgaagcagaaaaggaactcaacagagggaatataagcagagaatcctatgtaattgaattgtggtttttaagtcctgtgactaacaaaaagcaaagtcctgccctatgtactgggggcctcttctcctcagcctcggaaaaaccccagacacccatgtgggccatcactgtcagccacggatccttcggtggtattatttttagtggcatactctttttttaaaggatattggtattagtgagacaagaactccaaggatttggctcataaatgaatcttattcctcagtaagccagtctaactcagcatccctggatgggaatcactgtgatgttttcatttcccacaaacagagggtaataaaatagttaaaaagtaaaggggtatggcattgaccttgttgaggtagatcagaagttcctggagggcagggataggattggtgattggttgatctaatagttattaagtccgaaccatcttcttggaccctacaagtaaatgtatcaataggcttcatcacaagaagaaggaaaaaaggacatgttgctcttttagaaaagaaatatgttgcattccctttgatgccttctttccttcagctgattaacgacttgaaagagttgttgctggcttaagaaacagagagtagaaagtgctgtctgtgttccatatcacaagagcaaaaaatctctctctttccatccctccctcattccctccctctctttctctgaaataacaaggtggtaagcaatggaaaagatggggtgggaaggaagtgtgggactcactactctcgaaaacattcgaagcacacaatgtcaaaaattgtgcatagtgatgagatttcatacttagtatttctcaagccacagttccgactgcaatggatgtgctgtctaaggaaacctaaaaataatttttaaaaaaaaaatacatgaggagaggcgaatttctaacagttactgtcaaggccagcaaagcatgcctctaaataaacttcctgcttgtgcccaccagtaagttgcctgaaaggagtatcagacaacaacactgaaggaaaggggcagttatcctctggggaccggctgcaggaggtggaagtgccccccataggctccagcagctccacagtgcccaattggcagcctctcttccattatgcaaaggctatgttttataaacacatctaatttggtttaaactttttaatccataaagtcattactgaaggaatacaggctggtaacctgatgaactgacaggcacctaaagcagaaggaaaagctcaggtaaggtgagagtttgctgcactggctcccccctctcttccccaccccctcactcctgcaggcccttttgactgctctctcctctgtggtttcttcaccaagggacctactctttcctttcagcctgttcctcccctcgtgccaaagaattctctctctctctctctctctctctctctctctctctctctctctaagacactttctctctgtgtagccctgtctgtcctcgcactctctctgagacagagagagacagagacagagagagacagagtccattgcctctgtctagtcctacatcccaattactgcctcctgtaccattaagttgaatatacttctatacataaacatcgctgttgttgttttttaatgaggcagggcctcatgtagcccaggcttgtcacaaattcactatgtagtcaaggataaccttgaactcctactagccactcctagctcagagagctggattagcatatcctacagtgtctacttcatacaatgctggggatcaaacccagggcccaagcatgcttggcaagtattttgccaagtaagcttcatcacaagcacccaagcaggcctgtgctgtttttgttttgttttgttttgttttgttttgttttgttttgtttgagagtctctgccattcaatccctgatgatgatgtagcctagggaaacctcaagttcatggcaattttgcctcagtctttcaagtgttagaattacaactatgagcctcagatatcccagaattcactatgctgccttgtactcctgacaatccctcctttgagttcgagttctggcaggtaactaggcataacatgagaggatttttttcccctcagagaacaaaggagattctgaaaccataccacgaactgtatttaggaagcctctaccacatgtgcttttaagggatttacaaacctgacttgcttactcctcactacagtcctaggaaaagggtttcatctgcctatttcccagaagacaaagcacagcgaaggcagactacttgcccaaagccgcacaactggaaagcagctgtcagaatgtccatacacctagtctggttccaaagtctgttcttaattttttttttcaatttatttattgggggtgggcgaacatgggtttcacagcacacatgcagaagtcacagccagccagatggtatgctggctgatgacctgagttcgatccctgggaccctatggtagaaagagagaactaaagtccattcttttaactgctgttctctgctgcttagggactgtttgtggctaaaggtttgggagatgctttcatcccttgtgtatagattctgaccactctaccaggggaaactagataacttatgagtcaatcgattatcaccctatttctccttttggactgggtggtggtgctgcatacctttaatcccagtactcaggagacagaggcaggcagatctctgtgagttcgaggccagcttggtctacaaagctacacagagaaaccctgtctcaaaaaaacaaaataaataaataataatatttctcctattggatgtttaccctactgtgcaaatcaagtatgctcaagactcaagattaccgccttgcctttgacatgtctactaactagaagtactccagaccagcctttcccatctctcccagctcattctcttgccagtccacatatataaccatcacattccctttccaaaaagcaatattttgtccctagcgctaggaatccagtcttgtgctgggccagcactctcccacttagacataggtccagctccccagagtagcttggtgctagtcatggtgttcatggtggtggtttgctttgtcttgtatagtttgaagcaaagcctcactacataatctacagtagcctcaggctcactaagtaggctggactatcctcattccctgcacactaggattacaggtgggagctatcacacccagcaaacgtgagagagaggtggtggggagaaaggaaggtgggcggggctcttaaagaactattctcaagggctttgccctacttctcagcaaggttaaatatagcatccgaggcagctgccgcacccagacaaccctggaacacccaatacataagccagcaggctgacacagaggtgaatgcacactactctcagtcccccctctcctgtgacagttggcagggcttcccagatgaaagtgggcaaacgtgagagagaggtggtggggagaaagggaggtgggcggggctcttaaagaactattctcaagggcgactccactcttcgctgcttggagtcagaacattttcttacttcgggactggtattttttagtgaagtttctttcaaagtatgctgtgcttttggattttaaaacccagaggcctcgggagttttttcctcccttcaaaaatggatggttctgcttttcgtttaaggtgcagtttagaaagaagcagcctgtgaaaccaattaactaattggaaatcacttaatgactgtggcagcgttttgggtttctggcgttggttcacagcagtcaagagaaattgctttccaatattatgataaggtaagccgtggaggtctctcgggggcggctgacggctgctgagagaaacaatcaactctaatatgcccaccaaaataatagagacattataactcggagctcagtgattgtaaagtaaagcaaaacataaaaatccaaagataggctgggatctgctgagaacaaatgtgcagccatagtccttcgtgatgatttctgagaacttgcagtcctccacacacattaccccgtggaaactgctctcactgagccagccaggcatgtgtggaaagggaagtgacatgcaaagggaaaagaaatagagtaaatgcccaccccggaacaattgtccaattaattgtttgagtatgaatacagtcattgttcacattagggaaataatctagctaattgctcaagagttagcagagccagagaaaataaattagcctagacacagtgtttcccctatttgccatttgtttgtttcaaggtagcaaatctcttttgcatttttccaaagagtttatttcattagagctaaatcatcactggaaaacaacatcagtaacccctaaggcttctcattccttttgactttatttaaaagggagatagtgggacctgcacagccaaaaggatttaaaattgctgagatggccattacccagggcttcggacctattctgagcatggaagttctcttagtcccccttggtcttagtttacccagctgtaaaatggactgctggaagaaatgcttactcggatgatggccagattttgtgaccaggaaggtactacagactctccagcaatgatgaacttttgctttctcctcccctttgccacagtaatcatgggcaacagagattctcctggaaagtgtaactactgctttccaacaagagaaattccagagtaggagagatggctctgctagctctttcgggggactggctttagatcccccaacatctgtatcaaatatctcaaaactgcccaaaaatgccagcaccgggagatctagtgccctcttgtggtctctacaggtatccacacgagtgtgtgtatacgtagagtggagaggggagaatctttctctaaaaaggaaattcaatacacacccttgtcacaccaccacctgtatatggggcttacattaccccagccgtgttgatgcatctccactgggcacattcttagatggtcgctattatggttcaaatgtgaagtgtccccaaaaaactcatgtcatgaacagttggtctccagcttgtgacactattttgaatgctatggagcctttaagaggtggctctggctctcagaagagggtcactgggatggacctttgaagatgatacccaccccctggttccagtccctgctgtctcacttcagattcacacacacacacacacacacacacacacacacacacacactcttaccacaattgctcctgcaatgccttcccacagtgtggactgaaacatctctgtaaccatgaggcaaaatcaaccttttctcacttaagttgttagtgttggatatttttgtcatagggacatgaaagtaactaatatatttgtgctgtgcttggttattacccaaaagctgaaaggatgaaagatgttccctgtgtgacagtaccataaacaaagatgagtgctatttctatgaatcactatgccaagcaatagattacctagtactttctcttcttctgcctcattcagagaaaactaccctagaagcctttaacaagtgaaaacacttagggtaaaaggacaaatttaaaactataataaagagatagttctccctttacaaatatttcaccctgtgttggggaaaatgttatgattatttcttttcttgagtcttgatttccaacttgcattccagaaagtagcatgttttattaatatcaagattgtatcaaggcatcaatactgatggtatgatttttaattagtaattttaaaaaatggtgcatagggactgggaaaatgactccatgggtaggagcacttgctgcccaagtctgatccccagcacccttgtaaaaagatgggccctggcacacctaccaccccagtgttgtggggaatgcagagacaagagaatcagtgaaatttgccagctggaagcctagctccagattcactgagactgtttcaagggacacctgacatccttctctagtctgtgcacacacatgtaagggcctgagtacatacagcattcatattcacactcatatacacacacaaaaatcaccaagtaaaacagagcaacaaaccaacattgagggtgaaacttccctaacattaagcagggtgtggcggcacacacctgtaatcccatcaccctagaggtggaagcaagaggatcaggagttctagatcatcctccactacatagcaagttcaagtccagcctaggctaaaggtgaactgtctcaaaataatcatcatcataataataataataataatttcccagatgtaaaataaaaggaaaatatttcagccctcttagtgaaagcaaacctccagcatttcagagaagaaaatcttgaaaattaacctcaagtagttcagaacattttccaagatgacacggcctaagaaaaacatgcagttcaacggacaacattccaagactgtcccacttacacatgctgcacactgaccgaaaagtgaggctattcctatgaagacaggctaaatgccagcacacagcctcgtctgcaaagctctgcactggagcttaaatgtccctgattaacaaatggtgagccatttagcccatctcacagagacaagaccaaggccgaggtctaacaatagctctcctctctcagagtccttgaattagtgaatgttattacaaaaagaaaatatgcttttatctaggttgttacttttccctgtgctcatctgcggctttgcctataagctcacagtgcacagttaaattggacaattaccaagcgagaagtacataattaatgaacagtcactatatatgtttgggaaactgtgacccaatcacagaacagatagcaccaccactaaaataaatgacttgttccactcattacctgatcagcatttgtttagaagttccttggtgccctatcaaaattctaatcagttctatttaaattacatttttttccacagcattgttaaaaatgctaatttatgcttagaaccgaacggctttatttcttacctcctgaagaaacggatgaataaaaacacacttctgcagggcacagaggattatcaagggttcaatgactattggattttgcacttgccaaaacacatcctgcaactcagagctgaagcttttgggaacaacaaggacgtccatctccatgaggggacacagcctgttaccgcagcatctgctaccacccctgagactcttcttttaaggatgggaccagctctaggagtatggaaagaaagacaagctcaactgctgatgcaaagcatcttgaggacaatgatggttgcttcaatctctaggcaaccttctagcatgcagaagaacctctctgggcccagtatccctcttgtttatgatgatgtgcccagcagaggctaaatggtaactccacatctctttatcactgtcagtctgggatccaaatttaggaccaaagtggcactctaagcaaggagagtgacctcacacaagtcatgactcaaaaactgctttcacttcttctgacatacaagtgttagaggaaagaaaatccaactcctggtcacgagaatagcatctctggcttgaatggagacctaaccttccagttggagcaggttgtacacttggccaaggtcctaccttaggaaggcaggctaccctcaaatgatgctaaagagataggtgggatacttagtcctgtgatgaggtattatactttcccctctgtccctagtacagtaacttgcagagccacagggctacagcagggaagtttgcctgctaaagtgtcatttctccctttgtccttttccctttctaagcatgctttccttaacacattgggctcttttatccaatattttgaacttcttcaccctgtctctcaagcctccctccctgtcttatgtctcaccaccattaaaaagtcatgggtttttgtttgttttttgttttgttttgttttgttttttccttctctcttgtatcctcctcttccaggcaactactgaagtttacagtttatttgccccggggtttttcttctaaacagaacaatttcttcctttagcttccatgtgagtccattcataaattcttattaatgaaactgaggactccaagagagggcccagatttccccagtaccatcaggtcagcctcttgtcacctataggtggcccagacacacccttatgtcatttaggatccagaagacttcagaatagggagaagatttccaataatgttctggaacttgctagaaatctgctaatgagatcttataggtcatagcttcttagctgaggacttagcagagaacttgcctagcctgcctgaagccctgggtttaatccctggcactgtataaaccatgaatagtggtgaatgcctgtaaccccggtgctaagtgggtagaggcaggaggatcagaggtctacagtcatctttcgcaagctacataatgctttcaaggccagcctgggctaaatgaaactgtgtctacaaaaaaaaagaaaagaaaaatcaaaaaatgccttatacaatattgtgcaccctacccaggctaggctcagtgtctgtggaagtcagtgagtctgccattatcccgcttggagtgggcggcatcaaattcagaattcattgcagaagtttttttataagctgaggaattaccttgagaggattgaatttccaagtgtaagccagcagctgcctggatgccaaggccacctcaatcatcccacaccagctggtctctgatggagagggggcaaagtaaggctggatcagcctggcttagggccgcatggccagaggggtagaaaacataggttcacacaggcatttaaccttgattaagcagtgtgctatggcaggggcttaaaacaaggctggggcattttcccgcttattatcaccttgataacctgttcttgtagctgggaaggagtgtcacaaaggggtggggggccgaggggagccaccagaagggagggcgggacacaacactgagccagaagagaagagtggctgttttcagagtgtagttgggaagaaaggaaagatgttgctctgcatagttctccttttaaatagaaactgtttttccaggctgcatggctaatagcttcatgggaaaggaagaaaagaatggctttcactcattttctttgaagcctattcagcacagtttgaaagcagaatttccctatgaaatacctacagcagtgtggagttttcacaagatctgaggataaggctggagagggagcagaggcgaagcctaggaacaaccatgttcaagtctttgtgggagacgggggaccacctctgtccatgcacagaaagtgtctgtaaggccaccagcagcaatagtcctcaaggagaaaactacaccagcctccccctctccattccctcctaaagagaagctaacgaggcaggaacgaaaccaaccctggatggactgggtttggttttggttttggttttggttttgattttttggttttgttttgttttaatgtgtatttgtgcatgtgtgtatagtgtagatgtgtgcactgctgtgtgtgtgtgtgtgtgtgtgtgtgtgtgtgtgtgtgtgttccacagattaatattaggtgttttcaccaacactctccaccttaccctttgaaacagaatggctcattggacctgagcagcaagctctgggaaccctccgacacccaaggttacacctcatgcaacaaagtttggcttttctgtaagtgtggggggtcctgacatttgtatacagaaactgcacccactgagcatctccccagctttgacaaatgaagtcctacagttctcattctcatctacaccatagtgggtgatcctgaccttcctaaacagtgactagaaggatagtccagtcagcaaagtgactgttgcacaattatgaggccctgtattgagatctccagcatctgcataaaaaccagtgtgggttacatgttcttaatcccagcagagacaggcagatccctagagctcattggctagccagcctagctgaactttccaactccaggttcagtgagagagcctttctccaaaaaacaaggtggaaagtaattaatgtaaacagccaacatttacctctggcctccacatgtgtacacacacacacacacacacacacacacacacacacacacacacacacacacacaccacccttctataactgtaataaattcaaattttgttaaagaccggaactccaaaatataatatttgattattcccaaatccttttactacttaacattggagttacagaagaataacattttggcgcccaacgtggaaaggctctgcccttataccttctgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctctctctgccctctctctctctctctctctccccccccccgttcctgctctctgtcccctctctgtttccccgctctgtctctctatggcgaccggccatggcggtcagccattaccctgttcctcttcttagtctccccattctaccgggccttataataaacttatagtcaatatgtctgtctcaatatttctcttttcttctttttaaacaaaagaataacacaacctaaaaaagaaaatcaagtaactaagggaatgtacattgtagcagattttcactgtcaggctgtcaggctgtcaggctgtcaggctgccaggcacactcaccattgtggctctcttcctcctgtcttgacaggaatttaatactaactcagtagccacaagtttcctgatttaatccagaacaaataatgagggaattttacaggaacacagttacctttctttttttttttcttttttctttgagacagggtttctctgtggttttggaggctgtcctggaactagttcttgttattgtagaccaggctagtctcgaacttatagagatctgcctgcctctgcctcccaagtgctgagactgagactaaaggcgtacgtcaccactgcccagacacagttacctttctaacggagatattctcagtgaagatgttgcttatattagaaacacaagggaaaaggtcaaaggaaaagaggtggtccatctgtgaaaggattcattgaatatatctcagtttggcctccatcctcacatatgaactgttgagtaagcagaaatggaaccctgtgatgtagcactgggagcctcatttcagactgaaactggcaattactcagcattacatacaccttattggtcaattgtcttagcaattacttagaagacaaaatacgtcattactgttaagcttgaagaaagcataaatctggaaaagatacttaatgctctggatctcatacaactcaaagcttcttgcctttcagagcaatgaagagagtttagtagggatattacaaggataagcatcttcctaatttaagtgtaaaaaataggtatattacattttattagaagtcatgaaaaatcagaagggtcttaatttgctataaaatcagtacaagccagtgtgatatgaccaatcaacacatccaatcaattttaagtggtattgatagagatctagtccaggatagaagtaataatctttctgtattgtggtcagatgtcaacaccattcagagaaaagagttcatacgatctctactgtccaactatgaatttgaatgagtcaaatgtttcatgctttgtgtcctcatctgaaaatggaaataacaacagctgacaaacatattcccatagaattataaaatcaaatgagacagtttccataaaaactcttcaaaaaatcacaaagtgccattgtactggacatctgctgtttgctaaccaacaaccattcgcctcttactgacaagcacaatccagtattcctggagtagcttcagtttcactctttaccacgtgccaggtctcagccccactcagctgagaccacacataacttaggaacagccatgccaccaagtcacaacctgtgatgcgtaaagacactatgccaggacctctgagggaagatgcttgcttttcctagttgcgtttggccaaataagaaattgaacttcacaataccctccaactacccagggaaatgttagcctaaagatgaagctcaactgtgctgggcttggtggctcaagcctgtaatcccagtacttggaagatggagacaggagaatcaggagttcaagattgtcctcagctacagatgagtgtgagcatgggctaacaaaaccttatctcaaaacaaacaaaaacttggtggtaaagcaacacaaaagcaggtggaaatgaaggaaacagacacttgctctcatgacctccctatctgaaagacctgttcagacctgccctgctgaagtccctctctgcttcaatcatctagacaccaagcccttcaactgcctctcaagtcagttgaacaaggttttgtgtccttttcagcaggaacagacctaaaattgtgcattcattcaaagtcataggagaattattcaaatatatggaaataatagataagtgtattcaaatggagattaagtagatacattttagatggaaagagattaaaagcaaacctataaaataaggcatgaaagtaggtgggactatttgggagaagaaagagaccaacaggttgctgcagagaggcagcaacatgagagagtgacaaagatacaggggcatgcatggatgcaaatgtcctgctaaaacccactattttggacaatgaatgtgtgctaataaaaaaaaaagctatgtttagatttttgttgtgttatcagaattatgttaggtagaattatcataactatattaggtatgttatgactgttagaattatattacattatcttggattctaaggcttatataaggtgttatataaacacttctttctaaaatgaaatttttacttttgcattctgctcctaagaaatctgtgtctccagtctaccccatggtgtcttccttgtccttctgggctaatggccagatgtgaaattgcaacagtgatgcccacatctgattaatgggaccatgcccccccttctttcatagcttgctcccgttacaatttcaatcagagcattgctgaagcccttctacagcctctctaggagcagatctgttgacatcctcatccccatcttgagaagggccagaaaaatggcttcttactcccacactaagatccatataacacatagtgaaatcatagcattttttaaacatcggaatctaccagaatcatctggcccaagagctgattgtggtcacacactgcttactcgagttttatttacaaatgcctttgtcaataaagttttatttgaatgtagcgatgactgcctattatgttatttttctgattccatgtcgcagaaaaatagaatagttataacaaagattatattacccacaaaggctaaaatatatattacatggcttatacaggagaagttaataacctatgagctagtccaatcctagttttgagaatcttagaccatgaagactaataacagacaagaagacaaatctaatatatcccacaacacagaatattcaggttctgttcctatctgcctattagttcatagatgctgtgtacatatgtatcatccctcatattcacgttgaatacaggttgaacactgaaggctccattaaaattagttaagtagctgagtgtagtagtgtgtacctataatctcagactctggaggttgtagcagaaggattctgagttcaagaccagcctgagcaacatggtgagacaccatctcaaaacaaaacctatctaaacaatgcagcaaaggttaaataatgaatcatgtgatggaaaccatctcctcttctgcctccacagcctccaaatatctgtggccaaagtgagtcattgacagacatcaaaccaccatctatgatatatgtcgaacgacagcagcagcgcctcacagagctgtgagagccagatgaaacgaagagcgtgaggtacagagaccacatttggcacaaggtaaacactgaaatagcactaggtcatatgagggttatcataaagatggaatattctgagacacagcaggcatcaggaaagacatgtgtccaccaaactagggatgtgtcttaggtccttgcagaaataatggggacagtacacaaggtgagttccaatgtaatgtctgcaaatgactgatctcatcttgagtgccaccccccaagcaagtgagagcacagatgaggacatgtgctccctgtcccaacggtgcctgtgaaactggaaggacagaaagaagcttactcccctggggctaattaaggagccttagttatgtcaatactttaagtggagacctggcagtgtgccaagcagcatggcgcatgtggctgcatctgtggctgaggacatgtcacctcactctcctcacaactgacaagatgaagcaccaaatactggggacttcctctgaccacacctgatcaaagtcacctttgcttctttgaagttggtggctgtaactctctgtagggattgcccgtcaaggctcaacagcattccatgtacagtatagggagacttttagcaatggacaaaacctttttgtcatcttgcccagtcttccgcaaaagaattatgcttacaatggtttcatttggttgtatggggtgggcatgtgtgtccctgtatgtgcacacatgtgtgtgcagactcaggcacatgaaggccagaggttgatgctccttctttgctctctatgtcatttttttatatagggatttcattgaacctagagctcaccagtttggttagactgggtagccagtgggccctgaggacctgctgcctctgctttcccagaactggcattacaaacagcctctgctttcccagaactggcattacaaacacacgccatcacacttggcttgtacatgggagctggagatccaaactcaggccctcacgtttacatggcaagcacttcaccaactgagccgtcttttggcccctataatgtcattttatattttgatagcccttgatttggaaatctcagggactcataagatgtgcaatcccacgaaaatagtaatagcaaaagtcatcctcccccagcctctcttcctgatctaagatgacaggtagtgattcctgttagataaactgccccatcaggaccttatagggacattcagagcaatacggtttaatctatcactctcacccctgctcaattcctttctttgatgctaataacaaaagattttcccagagatggcttagcccatattgggagttgaggcctgtgtgtgcaagtgtgtgcccacatatttttctctgtaatgtgctgaacacctctctctatatatgctggcgaacaggaaagatgacttggactaataaccagtcaactcccacaatcagggggcctttcccacccagccgcctccccactgcctccatctgtgtttgttcttttgctgcataagaactcaaactgggtgacaggcctgttatttttaaaaagcctttagtagcgtctatccccagaactgtctcatcacaattatcggcaccaaacgaggaaacttcacattgagaatggatatgggtttcagccagcaccaaatgtctctccttctgcctttttgtctttccgatcagtcagaacatgtgaagccccaaatgaagagtaaacacacagcccaggttcctttcatctaggaacatatgtcatgacgggggaggggaaaaaccctattcccagcttcaatcagccattctttttctgtgacttgaaccttaaactgaaagggatgttgggagagcttgagtgctgaatgcggctgactccttggaagataataggtattcgcagcatacctgagtcttggagtcattatctcccctgcgagcacttctgtatttatatataatgagatcattaccaggcagctattccaattttattcagactttaatatttcttgaaggaaaaaaaaaactagcatacaaaagggtttgtgatgccaactcaatcagacgtgctgttgatggagaattattcaagtgcaagccagaacaggataaaaaaaaaaaaatcatttcagagaggcttctgccaaagccgagttctcctgcgacgatgtttcaagtgaatgtgcagaactgtccagaggtgagggaggaaaataacaacgaacagaagagagggctgctggaggattttaaaggaggctcagcctaactattcaggtggggagtgcaagagcctcctgcggagactggagactcattcccacctgctttcagagagtaattagaccaggaaagcagtcccttcacctggagcaggtgggagcctagaaattaacccttttgtgagtattctgttctttggcagttaaaccctggactgcgctggtaggggaggtaatttcttcctcctcctccctccttcttccttcttcctccctctttcctatctccccctttcattcttcctccctctttcctcattcattcctctttctataacaagctagaacgctggggactaggtggagctgtgggtgacagtggggagacttgtttgccacagccagcactccaagaagcgctctccactaattgcaatgcctgagatgtccgcactcaggataaacaggagtatatgatttgtctctgggatctgcattttatcctgagattacaaatccacaaagagcatctttttagcttctctctccctgtcctgaaactgcagatggaaatgagcagatggagcaggtacacaggcttaccttcccagaaacatggaaggaaagggtccatgtcttttcttagggtggttgtaaagcacacattatcttctccatggtactgcctacaagacaacacaaaccaacactggggggaaagttacagaatgtccctgctggctcctgctggccactgtaacctgaaagtagcgttggtaaactttttatattggtgttatcctactaagagtaacctgtgttgttcagaagtcaggtctggcgaaggtatgtaggttgaggctagagacctggctcaggagttaggagcatgtaatgttcttacagaagaccagggttccgttccaggcacccacacagtggctcacaaccaccggtaactccaattccggtgaacccaacatcctcttctggcccccaaaggaaccaggaacacatgttatgcaaagacacacatgcgggtaaaacattcatacatataaaataaaagtaaatctttaaaaataaagtacttatttattcattttaaatgtgaaccttaactcataagtcctagtctttggattgctaaacattttaagaacaaaggaaggaaggaagggaggaagggaggaagggagggagggagggagagagggagggagaaggaaggctagagacagatgataggaggataagatttcattgcctcatgaaaataggaacaatattctttaacaaaatccttaatagctactgacagtaatcattttaataaaaacccctggggctggagaggtggctcagaggtttaagagcactgggtgctcttgctgaggacccaagttcagttcccagcacccactgcctgtaactgcactcccaccagggagccagggtcctcttctggcctgcacaggcacctggcttgcacatgatacgcatacattcatgcaggcaaaacactcatacacataaaaaatcttaaaacaaaaaagaattatttcctcaaacggttaccgaatcagttcaagctagaattaccacatctcaaaccatagttcgctgctctatattaataagttgggcatatttatgtgtgtacatgagggagagatctcacttaccagcagtatggatcttcccaaggagcacaatggccctctgtcctgtactacaggcactctgcccctttgtccagcattctcaccaccaccaccccacccctggctcaactcttccttttctcctgtcatcaaatatttctgtgttcatctcagatgggatgtcccaggctgaatctctggaaatgggaagggagggagggactggcaagactccagggagcactgcagcttcagcatcatgcacaccattccactccaattaccctttgatgtcatcaaatccactctttttgccaaatcaaatagtccacagcaactcttaaccccaagggtcctggtatcttgaaagctgtttctgcaggctcccacgctgctgccttgtggtctgctcctccctgctcctattttgacccctctgctgaggggccttcagttttactcttagcaaggaatccaggtacaagggtggtggctttggagactacacatccgcacctcccaccattcccatgtccaccatacttcactccttcactcctccaggctgagtatctgactgaagatctgtatctttgaggtcaagaactgcatcgcataggattttctccccaaagtttaaaacacttttaaaagcttgtgcattgattcaacatgtattagtacaaagttaggttagtagataattaagtgttacttcagaaatcacaaagtacatcatgagggaaacaaggcctattcctaagaatgtcagcactattggccagtgggacaaatcaaaattgacttcaagataataaatatattaatgcatatagaaatattattcccataattgaagcaatgtaacaaatttccaccaggcctggtcgtacaccctcatacatccagcacttggaaggctgagacaggaaggtccttgagtttgaggccagcctgcctcaaaaagtgaaagacccctgccccttagctcttaagtttgcctcctcctccggtcggcagctgatgaggcacgaggcggatgcctcgctcctgcgcctccccgatcacctggcaccgcgacccggggctggggccgagcaaggagcccgcaaggaggcacgagggcgagcaccaggtgggccggcacgagggcgagcaccaggtgggccggcacgagagcgaacaacaagtgagccggcctggggccctgcccccgagcccccgcccgatggggaacactcggtctccgcccccaaggtcagccatctggacgcagaggggggaattgagtctgttgtaccagacaccataccttgagaatatgctggtctggaatggctctgtgcctcatttgaaccatccaatagaaatgactctgtactttgcctcatttgaatgactctgtatttcacctcatttgaatgactctatacttcgcctcatttgaataaccttgagtagcgcctcatttacattgaccaatgggaatagctctgtactgcacctcatttgaattatccaatagaatccctgcttctcgcttgcgctttttgctatataagaacccctctcccttggctcggcgcgcttggcctcacagaagctaagtcgccccgggtacccgtgtatccaataaagcctcttgctatttgcatccaagttcgtggtctcgctgattcttgggtacgggtctccttctacgaaagtacctcttcgggggtctttcaaaagaaaagaaggaaaggagggaggaaaagagaaagaaacaaacaaacaaagaaattttcctgacaactggcaaggctctccagatgtccctctcagaaagtgaaagaactatggagaaagaaggattgtgggaactgtagttctacttattaaggttctgaaatgcctagacaactatagcctgttggtagacacctgtaatcccaagtactcaggaggctgagtcaggaagattgaaagacagaaggcagagtgagctgagctgcacagtgtgttcaaagtccagcctgggtaactcagtaaaacctgaaagagcttgggggcagcccagggccagagtgcttatgcagaatgtgtgaggtcctgtgttcagtccccagtagtcccaaccctccaaaaaagggtgtaaagatagcttttcttaacttactaaatacggcagatctttttaagccacccctacacataaccagaaaaaaacggccccagtttggggtcccgactgctttttcctaaagatagcttcctctgcagttgtgctccgtaggaacactcagacctgttgccacaaagtcatggagcctagcccccgtgattgctgttggcaatcgtcatgcttagcgccacaactctgggtgtttatttatcatagctcactcctcgatctctgcagctgcccaggatattctttcccatagtcctggaacctagatcagtgaggaggaaataaattgctgagatattgtatgtgagagtgaccaagattaaatttccctgcctgcaggatgtaccctgatacaggattaataagattacatctctactacagagcaaagcgccacctttaatcatttcccaagtgggcccagccacccagcctctactcgttaggttcctgaacaagaggaaaaagatcactaggctgtgtcagaggtcagaacaccttgtctctgaaggccttttccttacgaagggttccatgaatcaaagtaagggtatagccacctcatatttcaaacacgggaagaaggaagagcctgtctgtttgtaaggaagctgggcaagctgctcctatccagcccacatcaagtttgcaaggagtacctgttaagttgtagacatcgggaaacgaaacttaagtcagcacttagcagggtgaattgtggacatgacagtgaggtgatttcttgggttctccacctgtttatgagccgtggctagagggagaaatcagtctaccgtcagggtgccaaaacacatctcttgccctagtaagtaaatatcaccatgaacagggtctggagatagaatcttgcctcccccacccggggtgagaaataattctttccctctaggttgattcctgccctcttactgtatcaagagggatcttgtttgtttgtttgtttgtttcattttctttctatctggttctcattgtgtagctctacctggcctggagctcactgtatagacagggtagactcaaacacagaaattagcttgtccatgcatctcagtcactggaattactgcaccaccatacccagccttcaagagatctttcttccaaaaaccatagttcaggagttcttaattgctctgtctccagaaagagtaaactttggttcagtagccaagttggcctcactgcccatatttgttaataaagtttactggaattcatctgtattcatttgtttacatgagacttcctgctacaacagcagaattgagtagttgaaacacagatttcatggcctgtaaagcattagttattcattattcacccctattgacttcagtcctatattttctggcaaaatgttgaatgattatgataatggtcaatgcactattaaacatattacatgaacaatgtcattaaaccttgacttcagttatggcagaggtactttcgttcatcccattttccatgggaagtacccaggttttgtagcattaagtttctaggtctctgaagtggtgaagcaggattcaagagatattgttctgattccaacctgggttctctcaaccaggaaactatatctgtgcaaatataataacaataaaatgtagctccctcttactaggcacttagcatgcaccagcctttacatgtgccgtctctattgctcatctctagccagaatattctttgcaaaaatcggggaacagggagttaggctggttaaacagctcatcaaaaaccagaaagctcagagcacaagttactacatccaaactcaaacaccaaatctttccccttatataggtctccacactagaaaaaggtagtattttaagaaacaatacaggaactggaaagactgctcttacagaggacctgagtttgatctctagcaaccacgtctagtagttcataactgcctgtaataccagcatcagggagatctcaggacaagggtacttgtagtcacataaatataccctacacagatccatgaatgtacacataattaaaaacaattaaaaagtccttttaaaaaaagaaataacatagtatggaatggaaattcctcataatttaaatctcagtgcttagttctctatcctatttagaaagactatggtagctgaggcttagcacttagtgatagaggccctgggttccatccacagaactataagcataattttacatgtttacacacagacacacacacacacacacacacacacacacacacacacacacgatgctacagtttaaatatttgtaaaacttcaaaatatgttgaacttaatgcccagtatatcaatatcaaggagtcggggaggggagtgtcgggtcatgagaactctgccctcatttatggattagtaccttataaaagagctgggtacacttgggagaacaggccctgcaccttgcccaggcagcacagtagagccaaacctattgacagaagtgtgggttaaccagcaccaaagttatgagcatgagagagctatccccattactcttctgtcatgcagaggtgtgggccttaccacttacccctaccacctgtagtgagcgagggagtggccctcccccttaccagttgcagtactcaggaaaatggaccctgcaccttgcctgggcagcacagtagagatgaccctactgacagggatgcaagtgaactacccccaagaacatgagtgtggaagatctggccctgcacctcatctgccacatagtggtctaggcatgggagagccaaccctgaggacatgaaagcagaagaaccagccccgccccttgctcatggctgcaaagggtgaaccagccagggtaacacaggagagtgcaccctgatcatgaggacaagggagaactaccaggctgacccaccctgcagctacacaggcccagaaccagtgttatgagttggctcaccccaacatttaccccatcacaatcttctggagcatgtgaaagggctggtgctgcagacccaaaactgcaggacctccatgacacaggacaataacaagagagccaagcagagtcccagtgagagtccagcgtcaatagtgcagccaaaaccaggggcctccagccagaccaatgactctttgcaatgaacacttgcaagtaaagctatatggataaaagggttcactatgtgactcactgtgtcacactacagcttccatgatgagatttttcttttttttattttattttgggtgggggcattgcaagggcaaagggtggatatgaagggacggggaaatgaatgagatcgaggttcatgatgagaaaaacacaaactaaataaaaagaaagctttacaaaaggagcgggataaacagtgaggcctatattctgcccttcccgcactcccctgtgtgaacatgcagcagcaagccccatcgtggaggcaaacaacagccctcattggacagagattctgatgacacccaccgtgcttggggcttccagccatcagggctgtgagaaagtgaatttctgatctttatacaattatccagacccaagtgttttgttctagcacagtgcaaccaggctaagagagtcaccacatattctctgagcccacacttcatccttagctgtgtgagtggcctcaagtagctaacttaaatctcttcagccctcattttccttgttggcaatagtgaggagtcttctcagatctcccagactcaagcattgggagctttcagtttgctccctcactaagtcactttcactcagtgcaaacatactcataaccagtgtaaactctctaaaaacaaatcaagccctaatcaaaataacttacctggggtggggagtgcagctggagagatggttcagcagttaagaatgcttgctgctcttgcagagaactcaagtttggttccccacacccatgtcacacacctctgggagatctgatcccctcttctggccttcacatgtacctgcactcacatgcacatttgtgtgtgtgtgtgtgtgtgtgtgtgtgtgtgtgtgtgtgtgtgtgtgtgtgtgtgtgtgtgtaaaaaataaaacaaaatgttttaaaagatttaagctggggctaggtgtggtggagaatccctttgataccaactctcaggagacaatggcaggcaaatctctgtgagttagaggccagtttggtttacatggtgagttccagaccagccagagctatataatgagaccctgtctcaaagtaaaggtttaatcagggaaggggacagggacagaacagaggaaggggccaaatgtgtaactaatttttaatataataaaaaggtggtatttgaatgcaggctacctgtgtaagtggacaatgctttcccagaagatgtgggctattccatgagcatctcagaccctggtgtgggataccactctgcaagttattggtcaatgaggccccagaggatcccaggatcacacagtgggcagcagataatccagagattcataactagtcaaaaaggctgagaataaatgaccatgagtgttggttaggtcaaggctcaggaaagatcagggaagaagaactggaaagaaagtatgaaactgaggatcgggaggaacactgtgaaatgctgtcttctgggcatccatggctgttatattcctgagctcattgcagctatgatcacgtgacaaatattgtacaagtcaacatcccagcggacagcaagagggggtagaacgtaaaggaaggaggggacatgttaagagatgtccagggggtgtaaagggaagttgagaggcatatgaccaagatataatgtatacatgtataaaactgtcaaagaataaataaaagatattcctaaaatgaaaataaacttgagaaactctgaaatatttaaagaataacaaagaactaaataaataaaaacaaaccccaggtgtagtgcttgcctataagcagtgctggggagccagagataagtagatgcctggttttcacagccagctagcctggcctgcttggtaaggtccaagccagtgagaccctatctcaaaaccaaggaggaaggcccctaaggaaccacaacaaaggttatcttctaaaatactgatttggtggaaattgattgaacactagtcactcgcaaccaggtaagagggtggatggagtagctggatgtcagcaacaacattcaatttgatagtaagaatgagttacagtagtctattgcacaatggtgtgtctacagcttataacaacatgatatattttataaagaaccagaagatttttaatgctgccaacacatttaaaaaaaaaggcaatgtctaaagatatagaaatggcaaacattagccaatgagatggctcaaaattggtaaaggtccttgctatacaagccaggtgacctgagttcaatctggaatccacagaaaagtaagagagaactgactccacagggctgtcctctgatgtccacaaacagactgtgaacacaaaggcacacacacacacacacacacacacacacacacacacacacacacacacacacacaataatctagaacattgaaagaaatgtcaaaacccagatttgatcatcacacattgtgtcatacattgaatagcattctgtgtaaaacagtgtagagggtggggatgtggctcagtggtccagtgctcttaaaagggtctgtcgtgaggagagaagtgcccagaaagatggctcagagaataacagctcttgccatgcaaggcagattattctggaacacacggtggaaaagattcctcaaaattgtccacacacacacacacacacacacacacacacacacacacacacacacacacacacactttcctttctcttaagtagtgagactttcccaataagctacttgtatctgtatcttatttcctaaccccatcatcattctatgtagattaccaaaccttaaggaccattgaagtcatctgagagatgtctatactaagttaaaaagtgatttatccagaaaaaaaaaaaaaaaggtttattaacattgcccttgagatagagcaccttaaatagcaaccaatagactaaggatacagtgaggttggtgaagtgcttgcctggcatccacaaggctctaagtttgatccccaatccacacaaacagggcccagtggtgcatgcctgtaatcaaagcactcagaagataaagacaggaggaccagaagagcgaggtcatccttggctacctatggggcaagtttcaggccagccagagctatgtgaaactctgcctcaaaataaattattttgtttgtttgtttccctttgctttactttaaatgatggcttgtttccgcctttgctttagctaataggcaaaactgatgtaaggaaacacttgcattgagtttacttctttaagtggcatggtttttaaaaaagaaaaagaaagaaaaaggccatcttgccaataatccctctaagcctttttaattgcaagattcttttttatggtgtcgttgacctagccttagcagagttcactctgtaaatgtgctgaagagggtaccagagctgacaactaaggctgagaaatgttctaagtatcacgactccacatttttctcctgtccatgaggtgcagggactcatcctgtctgagtcatgcctgccctttgtttatgcatgaataagacacttcagacactgcggacaccagcccttccaggaaaaataagacctagcctcaaatcagagtgagagcactgactgttccccagtgccaactaatttttaaatgtgactaaagacacattgctagcttcctccaagtcgcctactggcccctaacctttagcaagacaaaaatgtcacatataatggagcctaaaattaaggacacatcttgcttctccctggatcagatctcgtgagaatgaggtcagtgtcctacctctgccagataagagcagtcattgcatgagagcgttcaacagtaccacagtcattaggccacagaaaatgtctgatcgcttaaaaactcagactatggatccagaatcaacctacaaaaagtcattcagccttgtccctaaattcctgatagggcagtgtgtaaaacaactgttcccgggtcacacaaatcacttcaccagtctttgctccctcattaactgataaccatttcttaggtccctagttattgacacagtactattctcagtgttgggggtgttctgaacacactagacaaatccagagtgtaacagactttaccttctagtggagaccggcaataaacaaaggaggaaaatgaacaggaagagttggtgctgctttgatgatgaaacaggggcttgtactacaaaggggctttggtgtgagtagtcaaaaggtgttcccatgagctggagatgtaggtcagtggtaaagaacttgcctagcatgtgaatggccgtaggttccaatcagcagcaaaaatatattttatttttgattctatataaacatgaacatccatgtggagatgtgctcccatgagttacccatagaaaccagaagaggtcatcagacagcctgaagctaaagctacatgttggtatgagccatttgatataggtgttaggagtcaaatttgggtgctctgggagagcaagaagggtccttcatcgctgagccatctctccagaccctcttttttttatgacccagtaagtttaattaggggtgctgggatgtacgtaggtgtgggtttatttactagagcttagatagcttgccagtggctacaccactaaagaaaatcaattcttcctcctcaagagccattaacagcctcctcaggggggttgagattctgtttttattatcatatattaattctaatagctagctttattatgacatgctcatgcatgtccataatatagttcagtcatattcaccccaactcaccctgtccccttccactctgaggatcacctccctcttcctaacctgcccctcttatactttttgtatttcttttaacttaaatttcttaagaaacagatggaaagaaatgaagaaaggaaagaaatgagaagtctggaaggcaggcagagaccacatctcagaggggccagaagacaagtgaggactccacttagacctacttaatacaggatttacagggaggtttttcaaatgggtgccttgtggtctagtgggctattagtctggatctctggttgccatagaggatgtggattgcaggaatgtgaaatggaagcagggaggccactcaggaggtgatggtggtggtccagatgaaagatagtgggatcctacagaggtgatcactggtagagatgagggatgttcagagaaacattttagagactgactgactgactggcaggattcactgatggaattgctatggggatggcggagacagggatggttctcagggttttggctggctctaggcacactggatcagcttacttggcatctgaaatggtgatgtttcagccaaatggagcccaatgcatggccaactgtactgtgaatttgaactacatctgaggaaagtgatatgttttgtaaattgtcaccagagaattatttcccacacctccaccctctcctacatagcaactgtgtgcctgtgagcacagctccgtgggagtattcctaacctttatttatgaatggacattgaaaggacattgagtttctgcagcctagaagcccatgagctacaaagtgagctgatgaactagcatttggttaaagagaaagtacaataagcaccagggacattagctatagcagtccagaggactgtcaaagacctacaaaaagaaaacctagacatctgagtggaacattcagctataaactaagaggccagatttaatcatctacctatagttgtcatccaagaggactgcttcttcttgcaaaagcaaaggctcctgctcctatttttcagtcaagcaggtgctttgaggcagctaaccagctggctgaaaccttcaccaaagcaaaagctagtaacatgattgattaccctctcgttgaatgagaaaagaatctctcccagccaatcagcatgcagaattgttaacaggttattgctgacctaaatgatacttagagaagatgacagaggtgcccacatcccaggctcaggttggctgggatgtcatctaccaactcagttccacttaatgcactgattttttaacaaagctcagttagctttcaaattgctaagcactggctttcaacttcagactttgaatagacaacctctctctccatcaatcattttaatacatctgcttcagagttgcaatccatctgccccagggaaggcttctcctccaaacatctcgaagcttagggttctagttggctcacagattcctcctctccatccctcttataaaagatgcatgcatacatctcacttcatcctaaactcacaatcaagactccacgtgactcctttttatgttgtcatgcacctcaacactttagcaatgagaaagatggtctccttgaagaaccatcaagtcagagtttttttacacaggaaaccactaagtaagtgtaggccatgaggcgacacttggaaatccagtgggcttcctacttgtgttgtgacttctaagggcatccatctatgattgaaccatacacctatcaggcacgtaaaactggggatcatgcgatcatttcctgtgctaggtacaagccaggtgaggcaggaaaactaggagttccaggccattttcatctatgtagtgtgctcaagaccagactgggctaagacagaggatgtggtgggggtagactcttctaagctgtaaacaaaggtttcaagttcctgttgcacctccctactttccacacttaatagcaatttctagttcttcactggttccatgttggatgttgaatgtaattgacccccataatctcatagggagtggcactgttaggaggtgtggctttgttggagtgggtgtggccttgttggaggaagtgtgtcactgtgggggcaggttttgagatctctttgctcaagcttccctcggtgtgactgttagttaacttcctgttgcctgcaatatatagaactctcagatattcctctaacaccatgtctgcctgcacaccaccatgctccccaccatgacaataatggactgaacctctgaaactgtaagcaagccaccccaatcaaatgttttctttataaaagttgccatggtcatggtgtctcttgacagcaatagaaactctaagacacatgtaaagaaagagctacaaaaaataaaacaccagacacaggcgtagaaggcaagtgagataaatggaaatctcatctaagtgtcaggtagctccttctcaaacacagtaatagaaccgtgtccctcttcctatcacttactctacaggaatgtcacttttccttcttggttattgctagtgttatggcttgtaccatttgctgttagctatagtacttgaacttaagaaggcacttgtgtcgagttgtcacagaggcaaaaagactcaattcaccacccattactcttaaaaactctccttccttccacaaacctcaagggaaaagccaagagtcatcttgtcatggcgtaaaactctttccccttcagctaaaggttaatttactcctaaaaactgaacatctgggcactagagggatggatcagcagttaagagcacttgctactcttgcagaggacctaagttctgttcctaacatcttcatgatggcgcatagccaactgcaactccagttccaggagatccaataccctcatctgtcctccatagacaccaagcatatgcatggcacacatacctatatgcaggaaaaacattcatacagataaaaaattaaaataaatgaatctcaaaaacaagacaaacaaaagaaaagccctgcacatcagacttaacaaacatttccccctgggctaatgctacatttcagtagcttgttcatgtcctagcatgcatgaggccctggactctactcatagtaccgacaacaaaaaagggaaaaaggaaagagaggaaaagagaaagaaagaaagaaagaaagaaagaaagaaagaaagaaagaaagaaagaagacaagaacaggaagtacacttccacttcttatccctaatggagagagtagtgggcagtttgcagaaatacaggagtctggagagatgatcaactactaaaaaacaatcattcaaacacaacattgaagtttaaaatgtttcttaaggtttgtctcaggttaaagcttgggatgctaataacgttgatcttgaggatggtgatggtgaagaaagttatgtgaagataacacaggaagtgctgggttagaaatgctatcccagcctggagatttgagcctgaagattcaagacaggaattcaagcaagtatgggagggaagggccagaaaagggccagaagccaggtgtgaaatcacaagtgtctcaggttctctgactctatctgcactctatgctcccaggcaggaacaaaatacatcttgtgaagaaatgtaatgccagtgacaggagaggaatccaacattcttaagacccaggggaaccttagctcagtcatgagattccatgcataaaaacgggtgggagaaagccacattgtacaggctctacaaacctgtggtatgaggatggtggctctccttcctcagtgaacaaaattcaaacatggttctagttcatgtaatgaagacaaaggagaatgcagaagagcccttttgtggttccattccacagcgccaacatccattacattctgtcaattttagaaggaagtgaaagggtggggagagatatggagggagggaggagagagggaaggaggaaagaaaagcaggttaaaggacacttataaaattaagaaaatgataaaggggtggggagataactcgttggatgaagcatgagaaccagaaactatataaatggcatcctgcctacaatcccgaagtggtgagcttcaggtactgtgagaaaccctgcctcttctttgaagagcaatcaaagaagactcccagtgacaacctgggtttccacatgcacacacatgtacatgtatgcccacacacacacacacacacacacacacacacacacacatatatgcttgataaggaaggaagggaagggagggatggagggagggaggggaggaaggaaggaagagaaagtgacagggtgtatttcctcaatatcttaacaaacctgcagtgatcactgctgctctctgagcttctcacaccagctaagtacacaagaagaatgaagacaaagacctgtgaacaaatccagggcccaagagcaaaaccagaaaagatctgaaagccaagttccttcaatacaagctaaataacctaagcttgttggcaacaccacttgggaaaaaccctacacaagttcccaattgtcaacccaactgcagcctgtggttgaagatctgtgactccctggccagggtgacccttcaggagttccttagtaaagggcttatcaaactgattgcaaagcacaattaatttatatcagatatacaaaaatgcaaatgccccagctataaatgcatgagcaggaggaactcaccccatgtttacaaatgtaaacctcctaagaatgggaaaaggtaagtgggggctgatatggtactaaagtataacatccaagggggcccattagacaaaactgagggtcttaactcaggaggagatgtactagttacttgtatcattgctgtgaccaagtatctgacaacaagcaactttgggtgggaaagaccagtgtagggaatgatgacacccacattttgagtggctcttccctcttctgttactcctctctggaaacacacagacatgctcaggggtgtatcttataggtacactaaatccactcaaactgacaatgaagaaaaaccatcaccagcaacaagtggtgggaagagtcacgtaaagtcctcatcactatcagaactgtctgggcagttttctcaaagtcctactcttctcccccctggagatctgaacatcaacagagagctgagaatgcagacagatgtgcagatgtgggacgtggaaaagtctagatgcagaagagttcgtttgtttctgtctgcagaaccatcatttacacatcactgaactgtaacaagacacagcatacacaggcattggtgttttctaagggactgttctgaaggacttgcactctaaaattattcatattgggacactgagagttattaaacaatgcttctcttgctgacgagactcaccacagccctgaaccagcaccccggtataagctacagacaacacaagaagggaatgtaagaactcaacttttaaaaactttttttccctaacatccaaggcaggaagattctgttatgcacaaacacccacaagttttaagaaaaatcgccacagactagtggaagaaggtgctactgggacaggacaggatggcaaagagatgccaggaccccacacacacaagaaatatggccagctccagcagcaagctgttattgcctcatggagaggaacacttgccactaaaggtggtttgtcaccgcaatgtccaccacaaagaggcactgacctgctcccttgagttgaccctgtgtgacttccatacctttccccagccatccttcatgggaccacctcaccacaatctcgaaacactaaacactcaaagttgctgcctttccccaaattaggtaaggctgaacagtggtatcagggtgaaacaaccttactggagtccaaatcaggtcccaacagaacggtctaaaactgctgactgactcaggctcctcctggtcactgttgttccttcagcactttctccagccagcacctggaaacttttagaactttggtgagtgtttgtgcatgccacaactttcctaacctagattcaaggcacagcagtaaaattctggcttcgtttgtttggtggttctggaggttgaatttgggtcttcctatgtgctagacaaatcctaggcaactgatccagccccatgtttttatgttttgttttgacatggggacactaagttgcacaggctggccttgaacttgtagacttcctgcctcagcctctagaatagatggattggcaccaagaagttgactccttataccttctttcttgttctgctgcctgtgtgctacccatggtgtgtttacattgtgtagtgtgtggtatatgatgtatagtgggttatgcatgtagtgtgtagcataaggtgtgcagtgtgtttggtgtgttcgtatgtgttgtatatgggtatagggtgaggtgtgtggtgcatagtgtggtatgtgtggttcatgcattgtgtgtttatggtgtgtaacatgtttcatatgtggtgctacacagcttacctctgtctttcattgctccttgagcattcttttgtgatgagaaatctgttctgaaagaaacaaatctactcaccctcgagatctcatctccatcaacttgtgacaagctaagtcggtgtctaacaacctgaggacatctttccccatctctaggcacatgtgcacacatatacactatacgaacaatacaatgcacaccacatactacataccatcaacacacacaagtagcatacatcacacataacacaccttgcatacacaattcacaatgcacagtcccacacacatacagcaacagatgccagatacatatcacaaacatacaagataatgaacaacatagatcactaattaacacaccacataccacacctaaccataaacacactacaggccatacatacacaacatataatgcaccatagtctatacacacaacagaaacacactgcaccatttacacaaacactatataccacaaacatgcctcattcacaacacacacacacacacacacacacacacacgtacacatgtagttccttgttgctttcatttgcatttcctccccacctctcttactcctttagtgattaaaagctaatggatttccccttgggcacctagaaacagcagcacccttctttcacagttgcctgatctgtcattattcaccctcacacagtttgttttggggcggctcctcagcaagccagctgctttgtgaacagcttcccatttgccaccaaccactggatctgatgggtctgcaatgagctactccctgtacagactcactaagaacctgaagtctgtggcagtgtctccagaagggatgtctggaatggagaaggggggtgtgtgtagttatagtaaggcttcagaccagctgaggggaggggaatgctgatgaggaaccccacacagagcttggcagagaaccttttccatttggtgtccactccctgaatcttgctgctcttggaggactggggagtggcagactcttcaggccttcttgtccaatgagtgacctcaacgctgttctgtgatgtcagatctccctcaaagttactgagagacagtcccgggacccttccttcactctcttttacttaatttttgttttgagaaaagacctctctaagttgcccagcctgggcttgaccttgcagaattttcatgaacataagaaaggaggggggattttgattagggattcaaatgaaaatatatacagagcaatttttgtttgggggttttggtttctggttaaggcgtgtgtgtgtgtgtgtgtgtgtgtgtgtgtgtgtgtgtgtgctgtgtacacacacacatgcatatgccatgccccaagtgtggaggtcagaggacaatgttcccaccttctaccatgtagttccaggaattgaactcaggttgtcagacttggtggcaaacacctttactctctgagccatctctgagtcagccccagaactaactttggaaaagctgtgctgccaagacctctggggcatgggttgaaaatgttcactacaaatgcatgctcacactatcaccagagtgagaaattcacacagaaaagaagggcagaggggcttgggttgtagtgacagttgagtgcctgactaggatgcagaagaccctggattcataccccagcacaaaggagggataagaaggaaagaagtgtaaaagggagggagttagtgaccatcaggaagctatggagatatcttgcttaggttgggagaggaactagaggccagccatcatcccctgctggacacagatagcatcttccttagccttgatcttagctctcttcatcaagtggggaatgcagcctggagaggcagaggtatcccccagagaccagaatccatgttacctcatttaggagaaacagaacttgttccctggacagaaggaggaaggaggggatgaggggacattgcaggtagagagacatatcctagaccacatgaatcactacttcctgtacattctattccaggaaacaaagcggaaacacttctcttatctgattgacagtcactgctcagtgaagctcagactctaaacatgaagacatgcccaggacgacctttgacatcccttttgtaaatgaactaagtatggaatgattacttaatattatggaaactggtaaaataccatcaaattctggaaagcaaaaatatcagcaaagtaaatgtgtcctccttgagaaaacacagtaataaaagtcaagtgttagaaatgggctggggagatgacttggaagttaagagcacttgctgctcttagagaggaccaaggtttgcttcccatcaccttcatgacagctcacaatcacaaggggattcaacggcctcttccgacctcctccagccccagagatgcaacacatgcacttgcacacatggaggccaaatattcattgtagggaacagcaaaaacccacagtgtgtgctgttctgagtgaatgggcacagtcgtgtcaaggacctcatagtctcaggctcagagggaccaagtgtgagcgttgacagtgtgtgcagagaatgtccctccagcaacagttacagcccaaagactgttcccctacagagattgcttcctgagatcagctaaccctgtcttcttgaccagttgtagaccataaaccctgcctccttatttatctgcacacaataacctgcatccgtgttcaattgtgtacagtcacaccacctctccattcaactctgtataataaacacactaagcttctagggcactgtgatctctctacagaggtctcagaccattgtttccaggtttcctgtgtgtccgtctgtctgttgtttcttcattcccttgctgtcctggttaggtctaagtccgtgctaggatagagcaactcaacacataaaatttaaaaattactaacctaacttgtcacaagtacaaattcaaggacctgagtctggatacccagcacatataaaaaaattatgaagggtggtacacaagcctggtgctggaaggagacagagactgaaagccaggacttgcttaccagccaatccagccaatccagccaatcaatgagctccaagttcagtgagaaaccatgtctcaagaagtaaagtggggaaaaaacaagaagtaaagtggagagcaatacaaggcaggtgatattgacctcaggcctacacacacacacacacacacacacacacacacacacacacacatgcacagacctgcacaggcacacacgtgtgcacacacacacacacaaatggcttgccacattcttctttaaaaatttttaggggtggtggtggtgcatgcctttaatcccagaatttaggaggcagaggcaggcggatctctatgagtttgagaccagcctggtctacagagcgagtgctaggacaggctccaaagctacactgagaaaccctgtctcgaaaaacaaaaagcaagcaagcaaacaaacaaaactgggctagaaaatcttgttttgatttctttgaaaagcttcaagacttgtctttatttggggaatggcagtgtaatagggattatcctagtttttcaaatcacaaactatttgggggcctctaggtagatctctgtatctgggagcatcactgtgaaacaagcaggcttcagaatatgacacctccaaaatgtggaaatgaacatattctcgccatgccaggcctgcagccaggcgcatgccattcactcatcaagcaggcagtgaccccactacatcacagacggcatgccaagagttgggcacagcagagtggaaatgacacccaagacacctgcccctcctgccactgtgccaagcaatcagtgtgaggaaccagccatgaggccacagcagcagagatgtcaaaagaaccgtaacagccaaatattaagttttagggattttatttgttctgttgcagattttctgtttttctaatctcacattttgcaactgataaaccaagagttcaccaataaggtgccaaaaagcacatcaaaatatcataatcaggatatttcagcccttttgttgtctgtcactactaagaaagggattgaaattaagaataatctgggaggcagataaacaaatatacatttatacatatacacagaaaatttttcttcttttttcttggcatgcgctcatgcagtccaggctgtcctcaaactcaatgtagccagagacactttgaactcctcatcctcttgcctgtgactctcaaatgcttatattataggcttgcttttttaccattaattttaatgtctatgagttctgtttctcaggcaataccaagggaaagttaagaagcaggagcaataaataaataaataaataaatgtatttctgtcctaccaatattttattgtcacactctccaacaggcaaatgtgttttaaatgaaagatattagtcactggttctccccttaacatctcttcccaatgaaggatatttttggtaaacttgtctctctaacctgaagattctgtcttgggcaatcaatgagaaaacattttttgacaagtcaaatgcctgtgattaaaaggagaaatggccctttctgtcgagaatatgtggcttactcatcctcagcccctcaagacatcaatctgcatttcactgcagacacagcccaggtgtcttggtcaatgcacacattaaagacccgtcctctgctgcttaggagagagatttaacattagctcgggttagatgtaaaggaacaaccttctccattgaaagagaaattttatttctcggggagaaaaaaaatacagcaagcagtcactccaatgcattatgaacctgctattgcgtgtgggatttatggtcgaggtctcttctctcctgtaaggattcttcacctctaaaaggcagaattaaagatttcagagccatccaaaagtaaaagtttcatggaccttcagtgccatctagtggtcatattctgtcatgtcccaccattggtttcctctaggaatttgaagagattgagaggccttggcactgaaaaatccgagagttctaaatgggcttggcagtaaccagcgttggcccacaccagaactgttgtgcctggaaacagtgtgctggatgcatgacatttccatactggctcccagagagagctgcaaccggatctcatggctgcccctgcttagtcatctgctggaagcaagctgtctggagtacattgtgtgtgtgtgtgtgtgtgtgtgtgtgtgtgtgtgtgtgtgtgtgtgtgtggccacatgagggtagcctgaaaatgctccattggcaagtggcatcaggaagggacatatgcaaaatcacagtacacacaacctctaaatttaggtaatctgtcaatatcctgcactagagagggtttttttctctgcactatggctcaaaggcttaaaaacagaagccagtgtagactgcatgaaaggtcaggctgttcagggcatgacagatagcagcttctgcctttgatggatggtgacctcccagcctcacgggggcagcacctccatctcaccccttcctcttcagccctacatcagaaggcacagaagccaagtgctcagaggcctgagaacttggcctatggattccccttccttttctgtcaacctcagcagccacattttagcttttgtcatttgaatcttcaatgtctccctaagaatcacattagaattctaggtcccaaacctgtggcactgtggagaggtggtgtaacctttaaggagtggggtctagtgacaggaagtcaggtcattgggagcattccctcacaggtgctcttaggacgctgtcctctcttctccttcccaggcttggaactggacctcttccactatgtgttcccgccatggagtactgtgaggcctcaagccccaaagcaaagtggccatggatggaaaccatgacacccaagccaagcctttttcttagaaattgttatcttccaacacagtatctgaaagctagctagcacagtggccctaagctttgaggggaaggtcaaaaagaacttggatgtagacagaaacagattccatgacactccagccttttggttttctgagggagttgggagatgatgagaaaccattgttggcactgtaaggctcagaacatccaggcccaaaagttcgagtcatgccaggcttggagatgctttcaagatccagctagtggctgagtgtggtcacaagcaccgcccctacttccatcaaacagaaagaccatgcaatcagcaatcaccgctgtttcattctgtgtactatttactctcatcaccctatgttttaataaattattttctagtatatgggtaggatagatatctaccactcttcattctctgtctatctcatctcttagcagattgtatgccttcccataaaaaggactgtggcttcctgattaatgcctgccctgaaaagtagggcttcttaaaggacctgctcactgggttgctgtgacgatcaagtgtgttggcgtacgttaaatgttcatgactgtaccactaacaaatgtcggctgtagctactaaaactacgagcaaaaaacaagctgggggagacatggatgacttgctattcaaaaagcctttctgtggttgagtgagtatatttgcttccagaaaatgcatgtctcccttctcagaccttaaactccttgagaaaggtgtggtatcatttggttccccctaaggataagcctattacaaacactttgataaatggatatagtatcaaaccttctaaactcatgtctccatgcccataattggtgcagctttcagacctcatcagagaactttcttttcgaagtgaacagcagttaacaaagatgatcataactgttcaaagtcagagactaaagaatgctcggtcacaaatgggacatctatcacatgagtgcacatgcatgagtacatgtgcactcaaacacacacacacacacacacacacacacacacacacacacacacacacctcagaactagcacagaagatggggatggaagatttcaagagccaggggtcaggacagagcaaaagcaaaagagtgtctgtggacatgacaagatcattacactcaacgaactcacagcaactgtgattcccttcactgcaatctgaaggggatcaagccagtcaacactctagcatggattgggaagaggttcatatgcccagcgctaactgaggagctactggcagttgatggcttctgggggagagagagacaattctctttaaaggtgtagctcctgatagatgaatgacactccagtgggtagaaccacacccataagtatatgggcaaaataagctggactcagtgggttaattttattttagtgaggacaagagtgggtagatggatgagggtctgggaggagttagaggaaggaagatgaggtgaatatgattaaaatacattgtgtgaaattctgaacaaattaattttaaaaattaactttgtgggactctacagccaccaaatcccacccacaactcaggaggcaaagaaaattggaatgcaacaggtacctaaagatccccccttgaggatcacaccaagaggcccctgaggccttcagaagaagaagcactcactgtcagcagtagtcttcacctcttggaatttctgaaaacccttaggaaccattataaatgaatgccttatctttcggggcagaaccggaatttttaattcgatgaaaataactgaacagtccactcaggagcaagattgacagaccacaggtgggaaacactgattcattattcatcttttctaggaagacaagcagtttcagcttagcaagatgaaaatgagaagaggcagagagaacaagcaagtgagattaaaaaaaaaaaagatggaggagtgagcagatgcatgggtggaggagagataagttgattgatgggtcaatggaggaaaaggtatagatgataggtaaaaatagatacacagaagaaagataacttacagagaagtagaagatacatagatgatttgtagacatataggtcgatagatgacatatacatagatgacagaaagaaagaaggaaaaaaaggaaggaaagtaaataacatgataattgatgtggaggcagattataaacatagatgataggatgtgatacagatgataatgaaagatgatagataaatgatagatgatagatagatgacagacagcacacagatacattcatatatgcctgcaaatacacactggtacctagtccatagtgaactagatcatcagagcactgagagggaacagagcaagagacccagtaaatcagccttttgttcctcatctaagagacataatggcatccaagactccagcctgtgcatcctcccctgaaaagctcattgagttcagtcgagatcctgtccttaccccagagctcttgggaaaccttgccattaactcttgcaattgctgcacctgcttgttcactcctgggaaaatgtcaagatctttctccttttgtggagcacaggctacgaggaaggcacttttctttcactgagactttttcagaagcgcttttttttttccccttcctacaattccacagattttattttagacacactggaaagcacaaagaggcattcaactcagcctgcagattgctagaaaacccttcacatcccacggaaattagagaggcagccgcactcatcagcagccgtgtataaatctggaaggagtgatttcatagactcagctggtttcccaacacgaggtaatgttcgtccaccctcttcggctccaggacgcaggcccaggcactcagggtctaatctctcactactcactgcctcgtttttctcatttgtggagcagaaacgggatgcgccggagctaaattaccagcaggttggcattcaggggctgtgctaggaaagagacaatgtcaccgctttccaaggccgtgagccccagctgccaaacctttcatggccccgaagtgggtcatggaccaaagtgagtccagagagctggcctggctgctcccaggccacggagtgactgcaattctgagtgttctcttgacaactgcatgagacacacactggtgggcagacggtgtggggggatgtaaagagggggagaggaatgcagatgtttgggaaacatctttgccaaactgctagaaagcacacaggaggtgaccctccaggacctgtactaggcattcagcctttgatagcctcagtactataaagtatttttttctaacgactcctctgaggaggttgctgggaacagagaacaagggaggggagaaaatagagaggaggtaacacaagggccactgcgcacagaacctgagatggagcatccaccgctgttccacagggagccaagtctgcagaagacagaggcatgggctgagggggaacttctgggagcagccataggagatgcaaaggatacggctcttaggaaggaagataggaagatgccttcaggatggggatagagctcaggagtagagtgttcgcctggcatacacacatcactgggtttgttccccagcaccacatacactggatatggacataaactataattctcacacttggagatggggggcaagagtattaaatccaaggccatccttagctacatagtaaatttgaggccagcctgtgttacatgagacccctgtctccagaaaataaaaaggaagagagaggggggaaggaaggaaggaaggaaggaaggaagggagggagggaggggaaaaggaaggaaggaaagaaggaaggaagaaaggaggtctctcccagaaggccaagatgtctcagacagctgatccaatgacacaaagtgatagcaaaagacttcattttcaactaactagaatcacacaatgggttgtctagtaaagaatagctacaaaaataaaaaagcagagcactaggttctgaaagaacaggcaactcccagggcaacagtcttcccaagagagacaaaggaaaccttcaagaagctttagggaccaatgtaaaaacaccaagtgtctgcaggggacacaggggaatgccagttttctaacaggagcagcaaggtcacggaaggggagaggagagtaggaatgggtacagaagacagctctatggcttcagatctgaagtgctcccaaaggcccatgtgttacatgtttggtacctttagaagggagcagaaccatagagaagtggcgtctgggcgaggccttctgtcactggaggctcatcctaggaggaggctgtgagatcccatccctctccctcccaccccccctctctcttttcctacccccactttgaagccaccatgaagccagcagccctcactaccacgagcttctcccatgatgacccaaaagcaacagggtcaactgtgaactaaaacccccaaatgtatgagccaaaataacttctataaactgattatctcaggtgatcttaccataatggaagctatacacaaatgtcctaaaagagtaaaatgtattcttctccaccctctccaaaaagtataaatcaaagtttaaaataagactggtaccttgaaagtgccagcatggagctcttcagtggaacaattaatataaataacttcctttcagtttcatctctactgtcttagggtttctattgctgtgaagagacaccatgaccacagcaactcatataaagaaagcattagttggggtggcttgcttacagtttcaaaaattcagttcattatcattatggtagggagcatggaggcatggaggcatgtgtgctggagtgtagctgggtcctaaatgactccctcaggtgaggggtgagaaggcgagacttcaaggcacagacaccaggagtcagttaaaagggaaacagcagactcatttattcagcagtggggagagccaatgaggagtaaccacacaatgtcctcccagtgaccaggctttgttctgatctggtgacattgtatggttactcctcattggctaggcatgatcaggacctctgacagcgcctgttgctaggtcctcacactcatctctcagccttgtaggccttatctccctacactagagctgagagtcctacatcttacaggcaataggaagtcaactgactgtcacactgagggaagcttgagcgaaagagacctcaaagcctgcctccacagtgacacacttcctccaacaaggccacgcctcctaatagtgccactccctttgggggccattttcttttaaaccaccacaccatcttagcgataagacaacatatgcatagctctctccactaagaatggtctgggcaagggaaagtggtgtgattagtcttcattgtcaactcatctggatctgggatcatgtaggagccataactacgggtatatctttgagcccagcctttcccatgtccagatgtctgagaaggaagagccaccatgaatgtggacagcactgtcccatgagctgagattccaaaatgacaactatatactcttaaactgtgaaccaaaataaattgttcttttcagttgcttcttattgggtcacagcaaagagaaaggtaactaacacaaaggaatacacagacagaatcaaggacaaagagtaaagaagtcacctgactgctttcagcattggaggacacagacactgcctctatgtggcagtttggatgtcccccacaaatctcaggtgtctggatacttggtccccagtgctggctttctgaggaaaattaggaggtgtagtcttgctggaggaagtacatctctgggggctttgaggtttcagaagacttacaacattccagtgtgctctctctgcttcctgtttgtggttgaagatgtggatgtttccagctccagccacctactgcctgctgtcctggccatcacagactctaaccttctggaacccaaagcccaaattagacactgtcttctataagtaaccttggtcatgacgttttatcacagcaatagaaaaggaatgcctacgctcttatccaggaaaaaaatgagtgactaagtactctgcccagtgcagctggcaactacaatggcatttccagtgtaaaacaaacaggaaaaagaaaaaaaaaaaaaaaacagcagcctgcccttagttttgtgcatatacttggggtgtagggatattggaaccaatacaaaagacagagacaaacacacaaccttcagaagctcttatgtaaagcagttcccatgaggaatttcagggtccctggggactaacattaagcgtctaatatccagaaagattaagggatagtgctgaaaggttcagtgagtttatccattctagcatgtaagcagcggcctcatcagacctgggtagctacaacaggccagataaaaacaaaggacccaggaatttcccatacaatttaagggcgggaagacagactgggttgtgaaccactgctatataaatgttacaaagtacatttggctctctgctacatctctgttgcttatttcccttgtgttctgtgtcccagcagtgaatggcattcatgcaaactcttgaaacagatgttcaggaaactagaaacctagaagaagaatctcccacactaccttggtgttctggttaggtttttgtcgacttaatccaagctgggtcatctaggaagaaggagcctcagttaagtaaatgcctccataagactggactggaggatagtctgcaaggcattttcctaactaatgataggtgtgggagggctcagcctacctgggtgtgctacccttgggtgggtggtcttggttgtataagaaagggaatggaataagtagtcacagagggcaagccaggaagtagtgtgattcgtgacctctgctgccatctgtgcctacacgttcctacctggaggtcccaccctgacttccatctatggtagattatgcttgggacatgtaagccaaataaacccttcctccccaggttacttttggtcgtggcctttaccacagcaacagaaaccaaactaagaaaaatgaggagggagcaaaaccttcaagagaatgaaaaaaaggttgttctgagagggggtgtgaatgccaagttgttctgagagggggtgtgaatgctttaaagcttggtgagttagaaagccattacagggtgtgaagagggacacattcagtgggaaccaggtcttgggttataaggaagctccttctatgccttccactgtgtacgagggcaggtctcacctctctgaatctataatcagcagcagggtaggattcggctccattactgagaagttagccagattggtgggcaccaaggtggcacaaggactgtgctgttagtagacattccttaaacaacactaaaaccaaaactcacccactcagattcttcctaaaaccatgcttcataatgaaatagtgtgaacacaggcaatagaaagcaatgtcaatgctaaattgctctttcctgccagagtgttttatctcattcctcacccccttggtatgcttcaaggccagagagccctaaattggcagacagtcccccagaagagccttccagtgccactcaacaattaccatcgattagagttacactcacagtcaaacacagcactacagaaaaattaacagaggtggtgtcaccagctgcagaatggccccagaggtagagctcctaatacctggaccatgtaaatgttaccttatttggcaacaacttcgcagatgtgattaagttaaagatcttgagatgcagaaattatcctggataatctcggtgggccctaaacacaatcacaagtatccttacaagagagaggcaaagccatgtggctggcttgggccaccactggaagctaaaaaggatgatagattctcatccaccgcctctggagagtggatggccctgctgctggcaccttggcttcaaaccaatgttactaatttcagagttctggcttccgagtacagaaaaggggaaattcctgttgtttacagcagtcacaggacagcaaatgggtaagcagagaaaagcaacctccagtgaagggagaaccctagttcaaaggggatttctttggatttttgagatgggtttctctgcgtaacagctctggctgtcctggaactcactctgtagaccaggctagcctcaaactcacagagatccacctgcctctgcctcctgagtgctggaattaaagacgtgcaccacccacccccgggctcaaagaggatttctgtagtgtggaaataatttctgctgttcaccacacctgcatcttctccctggagtctgaggtgtttaaagcttcagaggtgttgtgatttcaatattagatgtctcctatgggctcatgtatttgaacacttggtccctaactggtagggaagattcaagagcattgctggaggacgtgggtgactagggttgagccttaaggtttcctacttgtgctggctaattttgtatcaatttgacacaagctagagtcgctggagtggagagagcctcaattgagaaattgcctccataggatcaggctataggcaagcctgtagggtatcttaattagtaattgatgggggagggccagcttattgtgggtgatcatagttcttgccatttgctcttgttgcttcattggcgataggtcttaaatgtgtatgttcttacatttcctagagaacacttgttatttgctatctttgtatatagctctgtatcaagtctaaatctattctttagactaaaggagtacttgtagtgagatatccactctgccctcacctgttgcactgaccacacccgtttaggcctggtgacaagtgtgaatgtgacaggggaaggctaggcctggggtcccggaccccagctcgctctcttgggtcacatttgggtcacagagagcagcctgggtgtggttcctcggagcaggaacttacaggtcatctgtttcttttgtaagtgacttctccccgaataaaattaatctatatttaagcaagttctgtgtatcttaatctgtgcctctacaggtgatgccatccctgggctggtggacctgagctctataagaaagcaggctaagcaagccagagggagcaagccagtaagcagcacccctccatggcctctgcatcagctcctgcctccaggttcctgccctgcttgtgtttctaccttgatttctcttaatcatgaataaggatgtgaagtatagaccaaataaaaccctttcctccccaagttgctttggtcatggtgttccatcacagccatagaaaccctaaccaagacaacagcccagccccacttcctgttcaatcttcgcttcctggatgcctatgcagtggaaccaggtggcctcccagtcctgcctccaagactttatgccatgatgggatgtttcccctcaagctgtaagccaaaataatccacttctcccttaagtattgtcttgtcaggtatttggcacaacaatgagaagcacagctaaggccagcagagactatagatgagcccttagatggagaaatgtcacaaacactctccaaagtggcactgtcccccactgccactcaggcgacagtccccacggcactgggtgtgaacttgctgccagaccagagttcctgacatttggccacctatcttggaccaggatgtccctgctcataatgacttcctgcacaattcctagaaagtgcccagttggctctgtcatctgttctctgggtctggtctgtcactttggtcagcagcctctgcgtcctgctccagtgacagagcattgctccattgtatgaagcatttccttagtgacctactttcttgctccacacatggcagaaactgaaattcccactcacatggaaaacagaatagagccctgagacaaaatgcacaggttatgcttaatacacaaatggacataaacaaagcaacagacttacctgggtttgacatctctctgggaagaaacttactgtgcagtaaaataccatgaaaaacaaggatttacactgactcatgaacttactgaaccatgaggtggtctatagattaccccagttgtatctcatacgtttccctgcgatgctagaaaaaaaaacctgctggtaatgaacacatgtgactcaaacattaagacaattgcttactagaaaaatctcccagcgaattcctttataatgtgaggactccatttttaatttatttttgatgaaaatctgaattcttcccatcatatttgcttaaggagagcagcatatttacaagtgcaaattcacatgtgctctgctccactgccaaggttaaaagccatcctctcaaggaaaacaaggagcccaagcttccactgtggcatctgcaattgtcaacttgcctggtcctagcactgagtggctggaacaatttccatatcttatacacaggacaaaaatcattaggacccctcagatggaaaagcaaggacccccccaatagaaaatgtgcctaactctgggtgtgttaatgagcaaataataaaaggtgatatggccattgacacagtatatgacttatcatcctcaccctagaattcagctagttgtaaaaatgagggggggtgtcaacagagaaaattagggaagagaagtgagaagaagagaagtctaaaactaatgaatatggactagaagaaggaagagtcaacaacaagggtctcaggtttgtctctgcagcagattgtttattcagtgcacaccaggccctgggttcgaacccagaactagaggtaaacactcacagtggaagctctgagaagacaccaataattttcaggaaatctcctttgttcctagtctcagtagtttaaaaatgcctctcagctactaatactttacatctggccaagtgtggcagaacttgcctgtaatggcagcacttggaaagttaaggcagaaggtcaggagttcaaggtcatctttgtcgacttagtgggttcaaggccaacctgagccatgtgagaccctgtctcaaaaacaaacatgccttacatctgtacagttcccaagcagccctccttcctggccctcatgccatcatgatgggctaacacaggtatcatacaatgcaccctaaagctctcacatgctccatttgctgcaaataccttgaaatcacttccagtccatttgcacccaactatgtttatcacctgtctgcgtcagttcaagctgctataacaaaatgcttcagcaataaggcagttctcaggactggcaaacccaaggtcaagatgccagcatattgatctcttggtttattttcctcttgctgtgataaaatatcctaacaaaagcagcttaaggaaggaaggaaggaaggaaggaacacatgtagctgcccaacccccttctctatttatgcattccaagattccagaaagaaaaatcctaagaaggtattccagcctcagttaacaacatgaagataatccttgacaagtgtacccagaggcctgtcttctagatgattctagatctgtccagttgacacttggcatcccatcaattggtatctgctatcttaattaatttggggaagtgatggaggcatgaggatggagccctggggaacaggattatgcctttgaagaagacactggagggaacagtgagatggctctgctggcagaagcacctctggtgacctgggttcagtccctgacctcctgaaagctgtcctctaacctccacatgctcactattgtaggaacacacacacacacacacacacacacacacacacacacacaaattcaaagaataagacacttctacagtttgtaacacttttgcttgctggttacatacccagctatcctccttctgagagacccctgaaatacaggacttgcagttcatggctacatggtcttatttatttattcattcatttattcattcattcattcattcattcatttttacattggctcagtaccttaggttgacctcagatttactacgtagcccaggctggcctcaaactcatcatcccccagcctcagcctcccacattctgagattacaaacccatgccaccacacccatactgagcttataaacattctccccacatggctacctatgagctatggtggtgactctactgaaggcgctgtcactgaagagtgagcaataacatttccacttaacagttgcaacagacacaaacagcctcgtggtaaagattgtcctaacacataggcaaagaaatagcaagtggagtatccaggagtgactgtcttgtcactcagctctctatcacagtaacagatatctgccataaacagcttatgaagacaagaggtttattcaggctcatagttttgtttgtttttgagacccagtttttctatgtagccttggctggactgggactcactatgtacagcaggcacgaattgaactcacagaaatcctcctgtcttggcctcccctgtgctgggattaaaggtgtgtgccaccaagccggctggacttgtagttttgaaggtttcagtttattgttgcttggtcttactgcttctgggtctgtggcaatgcagggtatggcaggggttcatgatggagcaagcattcaacaggaagcagagagaagaaaggccctcactacctctaaaatgccacaccttcaacaacccagaggcctgccttagcctctccttaatgtttcctctacaccacaacagctccaaaccagcaactgagcttttaacacacggacattccagatccaaactctggcactacctttgtttctagtactgtgtatctcattgaacgttaatatcattcagtccttaataacaatgatggtttttaacagcctggccctgtgattcccaaaaatttaacaaaggattctcccacctgcagccatggccctcatctgctcccaggccttctgctttgctggtgtcactcattggggacatttttatgtgaactggggaacagattctacgatcaaatttcaggaaactctgcaggtaaaggagacactccttttctccccttgaattctctgtgttttcaggaaagaactctaccacagacagacagtggcttcaagaagagaaccatttggtggctgcagtcttgtcctcaacacaagcaggagcacacactctcaagtccacctgactcccaagcaagacaagaaaacaaaagtctgacttgggctgtagcaccattggcagcttgcttggctggtccacacaaagcccaggattcaatccccagctcttcgtaaacttggcatggtagtgcacacctttcaacccagcattcaaaaggtagaggcagagggatgaaaaccttaaagactcctaggctgcagagcaagtctaaggccagacagggttacaggaaacctgtcccaaaagaggaaaatccaaaaaggaaaagaaaattccagtcagcatttctttcagctacgccatgtcactgctatacctaagatgtttttctcctctgaattaacaggtattaccgcaatgaaaagacaaggccatgttcctgagagcagtcattcacatgcctcctaccacatagctaactctttcagaaaaaggttcgtgtggccttgaaatctgggagaaaaaaaaagcaggccactcactcctgctcgcccccaatgtccttgagtagaggtttagtttcttggctcttctttccaaacacatggtatgttttttaaaggacagaagagcaggcaaatccgctcatcaaaaaggcattgacttttaattttacaaatgtgcctctctccccataaggaatagagagaattcattagaaaccataccctggagactgatcccgcctgcatgtttctttctcctggctatcatataattataccccagatctctgattacagaaactttcccctgaactgctacactttcagaatctttctttcccatctctccttttccagaaactctttaagaagagaagaaatgagaaactgataagtgtgtgtgtggcaagtctcaccttcactcctgcagaggaatgtaactgtggatgggtggaaatccatcagtgtccctagaaaagaagacagggtctctagccccaatctggggtaaactgcactaagtgctgggatgatggacatatgccatcaatttatggggttctggggattgaacgcagggctttatgtatgctaagcaagcactccaccagctgagctataccctgccaaccatccacaggaggcaattctaatatgagtccttcttgcagtgaggcaggaaccaggtgaactgctctgatggatgaatgaaagagatgctgaaagaatttcatgttcagcatgcaacactccagagacacttgactgccacagatgccagccttgtagataactagacccttctcagcctgccctaggcattgtttggccactgacactgacgaggaaggaaattatacagatcagcagcagttactactagcctcaccaaaatgtttcttctgtgcttgctggagcaaggcctgtgtagaacaaaatcacccatggtagccagcaaaatggatcaacaagaaagatgattgccaccaagcctggccacctcagttcaatccctagggcccacccagtagagaaagagaaaaccaattcccaaaggttgttctctgacccccactcatagagtgtgtcatgcccagatacatattctctctctctctatctatctatctatctatctatctatctatctatctatctatctctatccccccccccccccccctctctctctctctctctctctctctctctctctctgtatttttaaaattttagaaagaaggctgggcattggtggcacacacctttaatcccagcacttgggaggcagagacagatgggtcttgtgagtttgaggccaacctggtctccagagcaggtgccaggataggctccaaagctatatagagaaaccctgtctgggaaaaataaaaaaaaaaaaaattagaaagaaagtgcccatggtatctatgctctgtcaagaggttgtaggtgataatcccaggggtacaagacactgaaaaccctgctaactcatgcaggtggcatctgagggatgctccattctgctcccttcaaatgcctccctctgccccgtcaaagaacagcaggacaacagaggggttgaaatgtctgccttcccgcacacaatcatatcctctcttcttttcaaagggaaatttgtctccttagctttctggtattcatctccagtgatgaacaataggttaaaatttctgagaatataaactacaggaattattattcactccttgccctagatctctctgtgagctgccggctgcatgttctgcattcggtgacgaagggcccgtcccaagtgttttcccagttcaatcaactgtgctaagaactgtcacaatagcccttgacgacaagaaaataaaatttagggtagaatgggagcctgacttgcattgtgattccagtatgcacctgttcccccttcctcaccacactgttggcaaaccttttcatccaccttaatgacaaaggaaagggaatgggttgttttccaggcttgataattacttctgaaatgttgtcacaatcttccaaatgactgtgtttctttcatgttagaccactgtgatttcagagctgcacaggttggggctttgttaggattctggtccgcagagggccttcggagctttgttttcttctgttgttttagttggggggggggcgggcagggagggcattgttttgtttctttttgttttgtttttggaaaagacaaagcaaaaccaaataagtcacaatgataacttatgacagaaaaatcaacatctgaatcaaatggtaatagcaggagcctcgttggggagaggaggcagtttgtgccaggaaaagaaaggcccagaaagttatttaaaactgatcaaaacccactaggagtcacaatcccatcatgtcttccctttggaaaaacagttttcagaagccccaattaaccttaattgaattctgccttagtaatatctggaattttaattgactgggaaggtgatcataaatctctgttcataatgtgcttagccattaggaaatccccggatggcacacagccttgccatgcagggggctgagccattctgtaggtgaggctgggtttcaggtcctaatgcaaacattcggaaaagaaagctgcgcacagggagagcagcctaagattagctccagtggggaagttcagtgtgaaagtaaaggactccaatagcccaaggtttctattagtggcatcagcttcaatgtggtcccaaaacacaaagtcatacccacacacacacagagggggggggggggggggggagggagggagggagggagagagagacagagagagagagagagagacagagagagagagagttagagttgctcataaagaactcaacccaagctgggggtgtggctcagttgggagagtgctctcctagcatgctcaaggcccagggttcaatccccaacaccatataaatctgaaattgtgatgcaggcctgtaattccatcactggggaggtggaggcagggaggtctatcaatattattcttgactacacagtgagtttgaggccagcctggctacaggagacaaaaagacacccagaggaagagacactcattgctccatcactcaggataaacacagtggtagtctctgggatttctttggtagggggaaatggggaagaatgttttttcaactggatctcccatacccaaactagcttggaacttgctaagtagctgaggtttgcttccaactcctgattcccctgcctcacagctccctgagagttgagatcaaaagcatctatgcctgaattaccatgttcatcttattttctcttttaaaaacataatcatcctcacccctccctattttttaactcgaggaactatcttaggcctttaaaatgacctaagtgtgactattttggcctaatctggtgagggtgtgggagccaccagaatgacccaggcgctttcttagaagctcaagagtgtatgtaaaaccaaatgaaatgtcaaggatgtacattttgaagaaaaacagaaggagaacaacttttctggtaaattctgattctggtcctccttttgtactccaaacccatcaacttgggcagagaaaccaatggtttgagtaacaccaagcagtcaatcagaatgattggctcttgtttcatgaaactgaacgtgtctgtggtgagatggcagacacagacctacattgtcatcctcgctggcctgaggaattcccttaatctcttatttttctaatcgatttatttattttatgcttatgggtgttttacatgcacgtatgtctgtgtatcacaagcatgaagtgccttcagaggtcctaacagggcttcagatgttctgcccctagactttaaaatggttgtgggccgccacagggcactgggaatggaacctgggtcctttggaagagcagccagtgcccttaaccactgagccatctctccagcttccccttaatcttttagggaatacaactcaggtcaagctgggatttgtggcttcagttctaggaagtttcagcaatgagcaatctgaagcagagctggagagctcattaatgatatcaaaaaagaatggcattcaaaaagacgggaagagcatgaagagaacacggatgtgggttttgctaagagaaactcagaaactacggcatgcccaagtgtaggcatgggctcctccagagagttgtgacagctttagccatacacagtttttggtgaacctgaagttacatcacatcaagttgctataaaacccttttctctctctctctctctctctctctctctctctctctctctctctctctctctctctccctctccctctccctctccctctccctctccctctctctctcctctatttctatctctatctctctctcaagttactatgaaatacctctctccctccttccctccttccttctgactgagttaaaatctgataaggtgagactagaagccagtagagtcacacaaggccttagtccctgtcctttccttgtaagcagaatttctagctaagaggcctggaaacttgcagacccacaagacagggaagcgaaaggccataagcagcagaaattgtacagggttcctactctctgttggcaggaggcttcagggggattcctggggaggtgtcactctccttcctcaatctgagatttttcctgtcttctgctcagctccaagtgaatgtttgggttggctaacctcatcagctgttttaaaatcaactggaaatagttagcctcctttgaagaagatattctcctcttcctcaggctgtctcctatggagaatggttgtttctctgacgctgtgataaaatactatgaccaaaagtaacttgggaagagtttgcttgacttatagttccagaaggtacagtccttaactgcagaggacgtcagggcaggcaccacaggaaatcagctgataatgttttaattcacacacaggaaaggagggaacaggaaacagagaaaggctatgaacccacaaaacccagccacttgaggcggcatctcataagaaaacagagccaactggagaccaggtgttcaaattcacgagcctatagggtgtctctcgtgcaaaccaccaaaaatggactcctagctgttcttttttttttcatttcaacacctacttatgctaccagcggacactgtgacaactcaaaaaatctccagcatgtggagtagacattctatacacccagccaggtaaggagatgagcaacaaaaagcaataaaattacattttattcatctacgtgtatgagtgtgtgctatagtgaatgtttggagaccagagagaaacctgtgcaagggttagttccctctaccacatgaatcccagggatggaacttgggtttctaggcttggtggcaagggcttttatccactgaggcattaccagcccaaaagtgaattttgaaagaatcccaattggaacacgaggaaaaccagccactcttgtaaagatgcacaactctcacccttctcacctatccctgcttcttcgaaggactactgagatgcttgtgatcacagataaggtatggaaactggtacagtgaaagctctgggtcatttcttcccagttctaattcactttcaaagtcatgatcaacccagaggtagacaccagactgaaacagaaactctgcagacatcttctaaaacctggatggaaaggaaatagcaatgaacattacccttgactattttataaaattaaatcctgtcctgttttttttgtaactacctcagcctctctctctctctctctctctctctctctctctctctctctctctgtgtgtgtgtgtgtgtgtgtgtgtgtgtgtacatgagagagacagagaaagagagaggggggaatgtttctctgtgtaaccaccctggctgccctagaacgctttctgtagaccaggctggcttcaaactcactgagatcctcctgcctctgcctcccaagtgctgggattaaaggtatatgcccagctttgtctgtcttttatacacattttaaaacctcctcatctaaactatacttttccaaaaaaagatattgagaaaaacactattaagaaaatctagacagcaattaattttgccccctgcctgctgtgtaacttttcaagcctccttggtagacaggaataagaatgtcagtgattgatgagagcaaagaagatgcctacagaacaggcctgcatgctaattatcctaattccctcaatatccctcatttagaacagaatagcaagaccaacagaggggattacattagtaagtctaccatctacactggataagcgccagaggtcgacatcagtgggttgtagctgttcacagattggctagtttccaggaatgcttccagttacctgtactgaaggtcaaatcacagagcaaggccagagagcagtcctaaccacaccacttaagaataaatattttcagttttatttccaaagtgtggtcagtgaagtactttcttcagatccatcccgggtccttactatcacttggcttttgagccccataccggatttattgagtcaccttactgaaagtggcactaagactgtgcatttaacaagcttttcagattaaacttgtcctcaacaaagttgaaaaaccactgaggtaggcaacaattattaccatttatgggaagttttctatccaggcaagtcaaagcattattctagttgttcaaagattgaattcagaagaacttcccccacccacacacacatacttattcccaagatgccaaattaagtcaaatttcttattttattctgttgtaaaaatcataagaggcaaacagatgtctgtccaaggctagcctgatctacagagagttccaggacaggcagagaaaccctgtgttgaaaataaataagtaaaataaaaaaagtatgtgtgccctccaggactgcaaagtcagcagcttacagtggatggcataagccagttctctggccgggtgttggtggcacatgcttttaatcccagcacttgggaggcagaggcaggcagatctctgtgagttcaaggccagcctggtctccagagcgagtgccaggataggctccaaagctacacagagaaaccctgtctcaaaaaaataaataaataaataaataaaaataaaaaataaaaaagtcagttctccatgggtgacaaaacagaccaccccaataaatcggataaaatttgcttgtgattctgaaggttgactgagtgggggattacttgtttgttttgacccagcttatatgggttaaataatctaggatagcatctctcatgtggctaaactccctcaatacccaacctgggcttcccatacataacaaacctaagagctgatagaatacacatgaatacacagagagagaaaaaaaaagagacagagagacagagaggcaggctgtggtccagctaatccagcaatggctagctatgaatgaaaagaatccaagaatccagtagttgttcggtcaatgaggttggatgtttcagctggtcttcagtatatccagaatcttaaagaagtaagctctaatgccagtgaaggaatagacttgccagctaaagcgaaggcaagcaggcaaagagacagctttcttcttccatgtcctttctttaggctgccagcagaagatctgatccagatcaaaagacgatcttctcatctcaaatgatttcttaagaaaaatccctcaagatgccttctgcctgttgccccatcacctgtggtgggtgagggagctgacccttaccagctgcaacacttgggaaagtagacactgcatctcgcctgggcagcacagtagagttgaccctgctgacaagggtgggggtgaaccaccctaagaacatgagcatggaagatctgcccacacccatctgccatataatggtgtaggtggcggaacgtgggggcacaccaacctctcgacacctgtagcaggtaggagagcttgccctaagatcataagagtgggagagctagctgtccctgcccctcaccagctgcagtacttgggagagtggcccctgcacctggcctggacaacacattaaagctagcccttatgatgtaagtatggagagccaaccctgaagacatgaaagcaggagaactagcctcaagtcttgctcattgctgttaggcgtgaactagctggggcaatgcaggagaccttaccctggtggtgaggacaagggagagttaccaggctaaccaaccctgcaaccacccagacacagaaccagggctatgagttgacccaccccaacatccaccccatctatgatctgctggagcacgtaaagggacctgacccacagaccccaaactacagaatctccatgacacacggcaacaacaggatatccaagaggagtcccagtgagggcccagcattgatagtgtagcagaaaccagaggtcttgaaccagaccaatcactctttgcaatgaacacttgcaagtaaagctatatggattaaaaagggttcactacatgactcactgtgtcacactggctgccatgagattatttttttattcttttttctcttaaattttattttattgggggagattgcaaggacagagggcagatacaaaggacagagaaatgaatgggaccaagatgaatgatgtgaaagacacaaagaataaataaaaagaatgttttaaaaaagtgaaaatccctcacagatttccccagccacttgagttttagttcattccaaatgtagtcaagctgataccaagaatagccatcacacccaccacatttatttacccacaaaaaaaaaaaaatcatcagtgaggagggcatagtagtacatagacgtcatatggaggctgaaacagaagatcactagttccaggccaacctagactctaaaatgagatctgatcataaaaataaaagatacctaggcagtgatagcacacaactttaatcccagcacttgggaggcagaggcaggtagatctctatgagttcaaggccagcttggtctacagagtaagttccaggatggcagggctgttacacaaagaaagcctgtcttgaaataaataaataaataaataaataaataaataaataagtaagtaagtctccaccaacatctaaaaaataaaaataaaaaaaaaatccattaacctgataggctggggttgtggctcagttgatagcatacttgcctagcctgcatgagaacactggattggatccctagtactacataaaccagaagtggtaacgaacacctacaatctagcactcagaaagtagaagcaggagagtcagaagttcaaggtcaactggttaagatggctcagtctgtacaggcacctgcaatcaagcccgatgacttgtgttcaatccccataacccacagagagaaaggagaaccaagccccaatcccaaaagttgtcctctgacctgcacatacatgccaagtgcacatacatacatgaataaatatgacagaaagagatagatagacagacagacagacagacagacagatgatagaatttcactcccaaaatgttccatgtcatcttcagctacataacaacttccaggccagtttaggctacacaaggcccgtctaaaaaaataaataaggccagagatatggctcaacaagtagagttatttgccacccaataatgcaagtctagtgacctaagttcaatccctagaccccgtgtcaaagtggaaggagagaactgactccacaaagttttcgtctgacctctgtccaaattcatgctgttactctctctctctctctctctctctctctctctctctctctcacacacacacacacacacacacacacacacacacacacacacacacacacgtgcatgctcacacacactttaaaaatcactccatctggaaggggaaagggtcaagatctcctgagaaaattgggagcacgggaagaggggggagggagctaggagaatgagaaggggagaagaggagggatgcagaggacatgaggagcagaaaggttgagtcaggggaagaatagaagataacaagaatggagatgccataatagagggatacattttaggtttacagagaaatcaggcactagggaaatgtctggagatctacaaagatgacaccagttaacaatctaagcaacagaggctaccttaaatgccctcccctgataatgagattgatgactgacttatatgctacctgatagccctcatccagcagctggtggaagtagaagcagaaacccacaactaatcactgaactcaactggaatccagatgcagagaatgacgagtgaagagcaaaggggtccagaccaggctggtgaaacccacagaaacaactgacctgtacatcagggaactcttgttccccagactgatagttgggataccagcatgggactgatccagaccccaagaacatgggtttcttgaggaaacctcggaaatctacgagacctcctgtggtagtccagttcgtatccctagcaaaggtgtggactctgggagcccattccacatagaggaatattccctgagccaagacacatgggggtgggcctaggccctatcccaaaggatatgatagactttgatgacaccctatggaaggcctcaccatccagagggagcagaaaggatatgtgatagatagggttttagttggtggggggggggttggtaggggaggactggagggagaagggaattgggattgtcatgtaaaacaatcctgtttctaattcaatcctgaaaaaaatcactccatgtggcattgaaaaattttcatatctgatgtatgtttccatcctttctcactaaaaaggatatgcccctcccttttgaagaccattttctatctatctaaggcacactaatccttcgagatacgcacccagacactgtgggccacctacaccctgtcgctgggcatattatactagttttcagttcattgtgtgctatgttatttatgatgagcagaaaacttatttctcagagttccaaggacactgccatgattgatgtctggtcaaggtccagtttccactcccaagatggttcctggaggctgcatcctccagatgtgcagagcaccatccctcctaagtcacacagaagcctttttagtttgacaggaatccactcaccctcatgacatccccctttaggttccacctcccagcatcgttgacaactttccaacccatgagtcttggaggcaggtgggcaattcaaaccacaacaactagtaaccccaaatacacaacagctcacagtcctgttctaaaaagttctgttactcgccgggcattggtggcacatgcctgtaatcccaacactcgggaggcagaggcaggcggatctctgtgagttcaaggccaaccttgaaaccctgtctcgaaaaaccaaaaaaaaaagttctgttactcaaaatcacctctgatgctacatattttctcatttccccagttcacaatcccaggtactgatcctggactctattttgtagttctgattaaactgacacactggttgcaatgccttaacatcacgtgactccctcagctgcgttcagtccatcacccagtatgtgacagacctcaacacattttcagagtcaagagataaacagggaagtggggctggaggtggagctcagttgctagagcacttgcctaacatgaacagacctggggttgatcccagcactgtataaatcagtcttgatggtatctacctgtaacccacacattcaagagttggaaccagaaagattagaagtttaacatcacctttggctataaaaaaggtgtttgagcctagtctgggctaatgtgagaccctgtctcaaaaaaataaaacaaagagaggcaggactaagccctgccatgtcagcacattgagcccacatcaggctacaaggactgtactttggctcataatagcactggcctaataaaatgatgcaccctactatgaccgtgttctgcagtattagcaatgcaaatatgcataattcactacctcaatttcttcctatataatttgaaagttttcgggagcaagaaagtcacaaatttcccccattcttggttttatcccccaattttcacaggacctgtgggtgtgctgttatctctgatggacagtatttttgcatttacccaatggtatttaaatttatctgatcacattttaaattgggctaatttatttgatttacttaatctaacttaattaaatatcatctccacctgatgttatttaactacttttaatgctgctttaaaacctatcactgtccagaagctaatcagaatcaataaaattggtttggggaaatgcttcccaaagtgttatccctgggtcaacaaaagactaacttagagacttagtaacagtgaaaattcccagaaacccaatccaaacctactaagcaaattcgaggtccatctggctctcttttttttaaaacaatgagtatgagggggtgcaatcatgtcacagtgcaagtgtaacggacagaggacaactctcaggagtcagttttctccttctaccatgtggatcccagggattgaactaaggccatcagacttggccacaagcacctttgcccgctaagccatcttgctagcccttggctgtaatttctaaaaccctctggatgagtccagtgtagactaacatgcaagaatcacagagaaaaattgggaggaatagtttctagacaaatcagaagctaactcacaagatgtgagctttgttgatgaaaataaactcttctcaagctatggtttgcatagatttccaggagcctagtagagaatgcagatgagtacagtggctgaaatccaaatcccttgactggccccggggcaggatatacatgtgtttattctagatctaaggggatagagatgcgtcatagtgtgacgctgtcagcaaccagttacttttagagttgggacttttcttcccaagtgaaagaagagtccaaaaggtctagaatacactccaaagagtgcatgtggagatcagaggacagttatgtagaatgtgttctctccatccatctttacataaattctggaaatccaaactcaggatgtcaggtttgcacagcaaccacttacatgtaccgagatatcccacagatcctatcttaaattagaagatctataattgaaaacctttcagtcatttcatagagaataaaattggcagtgagattgaactgttctggatatgtaaagaggaggtctagagaaaaagagtaaacaatctagacttcctgatgagctgttggtcaaccaaaacaacatcatctccattcctctaagtaccgtatccaatgtgtgtggtgtcttcagtaataaaggcttaacttcaagttctgggaggtaaccaagggcaatggcaacaacctccttgatggtacgagtcactaaagagtggcattcattgacaatcatcttgatatattcaagccacagtgtccaggcaattttaagaggtattgattttacaatgaacctccttcccagtcccacctcattcaaaatctaagacccaagaacttgtaaacacatttctagaagagcaagcatctcttcttactgaagctccaggagacccagggttcagctcagtaggttccacccaacctactcaaggtccccaggtcagtccccagcactaaaaaataagtacacaaagcaaagccaaagagagccactgggaagttaggaaccacgtgacacactggggtgattgagcaggaagatcaggggttaaggctacataactctcaaaaaagaaaaagtatgtgtgtgatgtataggtttgagtggtgtgtgtgtgtgtgtgtgtgtgtgtgtgtgtgtgtgtgttgatgtatatgtctatctgtatgtgtattgtgagtgtatgtttgtgtattcaagtgtatgtgttcacgtgtctgtgtgtctattgtgtctcaatgactgtgtctgtatctgtgtctgtgtatatgtgtgtatgcctgtatatgtgtatgtctctccctcctttcctcccgccagcccgtgtttgtggggggaggggaactcttccccaaattctctgcccttccttctcatcattcagattcaaagtaatttcactgagctgccaaactgctacattatcaactaaaatccaaggagtcttcagccaggcagaataggcaagccttcatcagtatagcctgcagtgctttttatgtgctcactcctaaatgcctggtccatcctggtgaattcatcctcagccaagtggccacttccatgaagggaaagctgcattcatgcatggtgccttcaggcaaattctccccctttctgcctttaaacaaggacatccagagttccgaagaacaaatgaaccacaagagaaagctttaggccacttggccttcagctaaggctctcaaactgagggagacctctgtgtgattgtgtggggcctatgaggaggccagaggacaatgtcacaagtcattcctcaagtgttccttgcctgggtttttgtttgtttgtttgtttttgtttgttttgaaacaaggtttcgctatgtatccctgaactgaaacctgctatataggtcaggctggtctccaattcatagagttccacctgcctctgcctcctgagtattgggattaaaggggtgccaccatgactggcctctccctagggattggagaaaccggaaggactttatatcaagctctggaaatctccatgccagattgtgttactaaatcttgacatctcatcatctccttaaagagtctcctacattctatgtaggacagggttagagcagagggtggtactgtttcttggcccctctgtgtctttgtcagccttgtggcatggccatcttattcttgtcactataaaaattgggatgacagcttcactgtggtggaaagagtcaaatcagcacacatgatgccagaaagagtaagggaaaatataaagatgccccattatataacctttttaaaaatcctttgctgttttctgggttgagtgacatccagggtatttttcagatttttttaaagacgttctttggtgaaacataaaaaaacaaaagagcttagggagtcagacaaacttggtttaacttcttgcctgcccattttctgtatgattctagaagattttcttggtctcttactccatctcattgactgtaaaacagaatgcatgagagtagaccacaccatcttgatatcatgatgattgactgtgccccagttcctttttattacatttttttatttcaattagaaacaatcttatttatatattgatcccagctccctctccctccatcctcccatgcccccccacactggcccccatcccatccctcttctgctccatagaaagggtgaggccttgcatgagcctcagttcttataaagaggttggaatctggcctggaacactgtaagtgctcagttaatgttaacagttaagtaggaaggtagtctctctccactgacatgtgagactttgtctccatcctacaaagtgagaagaatggcacttgcctctgtcaccttacgactacaacaaaatacctgacaaaagccactgaaggaaggacttctttgggctcagaatttaaaggtattggtccatctaggcaaagaagacatggtggtaggagtgagggaactggccaagtcaggaagttaacagagcaagaaagctggtgctcatgtgatcttcgggcctccacatgggtaccatgataagagtgcacttgcatgtacacacacaaaataaacaaataaatgcaatttttttaaagctaaagatgcatccagacgtttgtcccccaggtgcttctaaatccaaccaagctgacaatgaagattaaccataacacagccatacagaattgcagtgttagagaaagtcactgggacccagttggttaataagttacaactattgatcttcaaataacaagcccattgatctgatcagcccctcctcagcttcctcaatgaagggttctgatctacttaggagagttttgtggcttgaggcccctggtcctagtcacacatcactcctcaaagacctctctcttttagatagcatctattcctacctattatgtgcttcataaaaaaaaaaaaaaaaaaaaaaaaaaaaaaaaaaaaaaaagctaacgttgccttagggtgacaggatttctgccttttgacactttctgtttttcatggctttttccccctttttctctcctttttaagtttgctatggttagcttattgcactctatataggaccaaaaaaaatgagttgttaattggaaagcctaggttctcccaacacccagaattaaaacaatacacttgggtccagagaagaaatgggtattgattccacattaactatcagaaatgttcccttcccccacagccagaaagcaacggagggaccctcctggcttacctaaacaactctcatgctaccttcaaaagcactgtgctaaagccctgaagtgagctggtcccaaagtcacacttgaagtttatccccctaactttcaacctctccaatcagtttaatcattcattgattttcagtcattcacaaattactatggcccatgtgttgctctgatagacaatcttcagatacaaggccaacaaagccaaaatctccctccccctagtttcctgaatgcagacatttgttcactaaaaagacatgagatctcaggggctggagaggtggctcagaggttaagagcactggctgttcttccagaggtcctgagttcaattcccagcaaccacatggtggctcacaaccatctgtaatgagatctggtgccttcttctgggctgcagcatacatgcaggcagaatactgtatgcataataaataaaaatgaatcgttaaaaaatttaaaaaaaaaaaaaagacatgagatctcaagtcagcactgatgctcactgagcaaacctggagatctgagttctattcccagaatctacataaaggcagaaggagagaaccaactacacaaagttgtcctgtggcctccacatgtgctgtgtggaatacatacatacatacatacacacacacacacacacacacacacacacacacatttcttttttggtggggaggggtgttctgagtcatggtttctctatggttttggagcctgacctggaactagctcttgtagaccaggatggtctcaaactcacagagatctgcctgtgtatgcctcctgagtgctgggattaaaggtgtgtgccaccaacgcccgactctctcacacacacacacacatttttaaaaacaagataaactgtaagttttttaaagacataagacttaaaaccagaagaaagaagaaaggagaggagccgggagctaaaggaaggaaggacagcatcagttctgtgtcctgctcagcatccaggcctctagctgaaaaggaagaatcctgccacctctggtccctctgtaggactccagcccagcaaacgtgtgcttttgtttcttttatttctctctcgctctttaatgaaacatgccctaatcgggcatctctcacagagagaaagggactaacattaactaacaccatcccaggtgttttttttttttttaaagtctctttgcagtagactatttatagatccaatgaggtcgctctgtggcctcctacccagctaagtttgtaatattctggggtcaggcccacaaccatgctgtgtggttgggccttgatgtcccacaggggctcttgggattcttagcatgcaatcgcttgtcttgatgggcactctgccacccaagccacccctctggttcccactgttgtgctcacactcagtcatactacaggcaaaacctggcacaaaacagtgtcacagttgagcatccttttgtaaaacaaatatgagcattgtccatacatacacatgtatgtgtatgtgcatgtgtgtacattttttgtgtgttatttgtatctttctttcccagtctacttcaagtgtaatctctaagactctatcaaaagaggcttggaagtgcctgtctaggctcccccagaattctaggacatcaaggcttttaacacacctcacagaacaagctgagtgtgtgtgtgtgtgtgtgtgtgtgagagagagagagagagagagagagagagagagagagagagagagagagagagagctattgtgtatggaggcaagtatgggcaaatgtggacatcaggtgtctttctcaattactctccccattttttttttaagacaggatctctcactgaacccagaactgatttggctagaccagaaacaagtccaagggattttcccattactgtctctgcctccccggctctgagattatagtcatgccctgccacacttgactttatagagttctggggatccaaacgcaggtccctcatgcttagtgggaaagcactgcttcttgctggactgtgtccccagcccctgggctctctcttcagtctgcttcactcaacacaaaactatcgaggttgtttaccaaatttcccagttgggtgaataaaaagaacaacatcagagacatgacataagaaacagagccactgattaatgatatatatcttgattgactcagctatgccaaggcctgtccacagcttttcagttaccatatgcaagtattcaactagcttcttagtcagataccaccattgctggctctccttctgggaaaagagacaaccattaatgatgcaagcctcccactgactcacttctcccttccacatattcctgtgaatagcaacctccaaaagaaaagaaacagtggactacttctccctgggaccccttggtagtctactagagggagctccttgtcaccctatcctactcagatttttcagaccacttcaaagataatactcatgagagcatctccatccatgttggccagactggtgtccagatcagcaatgcctactgggaactctagtgcctggaacatggtgtctagcctgatagccagatgccaagtgacaagatcattgggagaggagatgactcactccttcagcacctacttcagtgagacagacactggcaaacatgtgccccagacagtgtttatagacctggaacccacagtaattgatgaagtttgcacaggtacccaccaccagctcttccaccctgagcagttcatcacaggcaaggaagatgctgccaataactatgcccatggccgctacaccactggcaagaagataactgatcttgtcttggacagaatttgcaagctggctgaccagtgcacaggtcttcagggcttcttggttttctacagctttggagggggaactggctctgggttcacccccctgctgatggagcagctttctgttgattatgaaagaagtccaagttggagttctccatctacccagtcccccaggtttccaccactgtggttgaacccatcaattccatcctcaccacacacactagagcactctgattgtgccttcatggtagatgaggccatctatgacatctgtcatagaaccttgacattgagcatccaacctacactaaacttgaccaccttattagccagattgtgtcttccataactgcttcccttatatttgatggagccctaactgttgacctgacagaattccagacctacttagtgccctaccctcaaatccacttccctctaagccacatatgcctctgtcgtctctgctgagaaagcctaccataaacagcttatagtagcagaagtcaccaaagcctgctttgagccagccaaccagatggtgaaatgtgacccttgccatggtaaattcatggcttgctgcctgctgtgctgtggtgatgtagttcccaaagatgtcaatgctgtcattgccaccatcaagtccaagtgtaccatccagtttgtggactggtgccctactggcttcaaggttggcattaattaacagcctcccactgtagtacctgatggagacctagccaaggtccagagaactgcgagaatgctaagcaacaccacagccatcgctgaggcctgggctcacctagatcacaagtttgatctgatgtatgccaagcatgcctttgtgcactggtgtgtggggaggagggggagttctctgaggcccatgaggacacggctaccctagaggaggattattaggaagttggggcagatagtgctaaaggagatgatgagggtgaagaatagtaggccatgtgcaacaattctacacttcattgtcttctatttgtctttgtatatgtgtataactgtcctgaactatcaataaaggtgcttccagtttaaaaaaaaaaaaaacactgggattaaaggcattagccaccaatacccagcttatgtagttaactagtggataactccaccctctgatcacaaagcaaactttatttgtcagaacacaagcaaaatatcacacaacacccagcccaagcaaactttgtcagaacacaaacaatatatcacacaacacccaacccaagggggaggtgcttagtctacctgtgctacaatttttcagagaacaggactagctagctttcagaaggatcaaatagaatttgaaaatcaccctgctttatgtggcaagagctccaagaatatcaaacatttcttttcatttgcaagcaaatgggtcagaagattctcccacgaatatctcttccagaaaagggcagtttcaaaccacagaaaatggacattaccaagaaaaagaacctgctttaagagggcaagaacaactctgagctatctgggaaacagaggtggaatgatttttccctcccacacatgggagttccaaacacaggagaagcacatttcaagcagaacgctccttccagagcacaaatattgggaaaatagacgaagacatgagcgcattctaaacacagctgtgtttgcccacgcctcctgcctgctaggccatgtttgatttaacctggcaactcatggggaggcgaaaggcctccgcttacctaacctgtgacttatcttctccgatcattattgttgatgttgcaaatagtgaattgacctcttattaaatgttgcagccaacaaacaggttttaataatcttttgaaattcacagtaaatgtgttttcagttggctgtaatttgtattcattccaaggacagagatgcccagccacctgctctgagtgtgacagaatgctccactaggggatattgctgcccttcccaacccaccataaaacatgtcagtcgcaaccatctccgggagaatgcgttcattagctctggaaaacagggtgtaggtttgccaagcagtttacaggatagtttttagccttcagaatcacctgagatgagggaccacagaagttgtcagccagtataaagccccaggttgtcatcgaaataatgagcgggtgccctggctggattggttatcttaggcatgcatcaggaggctagggaacagacacgagaacgcttgtggtacagtatcagcccatccctagttagggccctgagggtaaaagcggctgagcatcagcatccaatagatagcaacaaaagccattatctctccctggctgggctgccaagtgcaggggccaggattgcctggtgtttgcggtttccatagcagcgctgttttgttctagctggcaaagtacacagagaggacaggatcaacattgcagcaaatgacacgaacaacctgagtcctgagcctcggatctctcagcaggctttgccctttttgagtaagccatgggggtgaagatggatgctccaagagatgactggaaactaacagcttcttcaatcaagctcagcagctggctgagcactgccatccatccaaggccaccactatgatactctctacctcatttcccaaaactctggaaagtactcggtgtcattaacatgggagaaagccctgcacaggcagaagagccccactgccatctcctatctggaatttttgaagactttctcctctctcagctagccagtgaggttcccctgagtcctggtcactgatgtgatgggtggcaagtgaaccaacttctctaccacttttgctggagaccaaaagggagggcccatgagaacagaggatgctcagatatgatatttgctggacatagaactagtaattttttgtttgttttatttttgtttttcaaaagaggttttctctgtagccctggctgttctggaactcactatatagaccaagttgaccttgaacttagagatctgtcagcctctgcctcctgagtgctgggattaaaggcctgtgtcaccaaacctgcctatataaagctactattgctaagacgagcaaagtcttgatcccagtctatgcattacccacatagttcaaaatcagtctaattggcttccattttacttatggtctattggatagacattaaattagttatcttagaatagagagtagatttatctctagcatcaaggacgcctagaaatttcttaaatgttaaaatttcattttatttcattcgtgtgtgggtgtgcatgtgtgcagttcagcagatagctaaattgatcctcctgtccctgcctctccattacacccagatttttttgtttgttttgtttagttttttggttttggttttttggttttggttttgttgttgttgttgttgttttcttttttggtttttgtttgtttgtttgtttgttttttgacaaggtttctttgtgtatctttagcctgtcctggaactctctctgtggatcaggctggccttgaactcacagagatctacctgcctttgcctccccactaaccaacctcacacccagatttttatgtgcgtgcaggggaaccatacccaggtcctgtactgacctcctgagacatctcaccagcccctactttaaggacgcctagtgatggttacgccttcattctctgtcagggtcatgacttcacactgacaaataagacaaatttagagttccattaaactttgcatttgtgaaagatcatgtcagattaaggatgagatgtcacaagctccaaaccccagccacaaactaaacccatgagtctggtaactgccttttttcctgatcattgcaggaaggacttactgcaaatagactggctgcctgcctcctccctgttctaagacagggctgttgtaatgttactgcagcttgtgggtaaaactagatatagccacagaactcaaagccgttccctatgtgaatatgtgtgtgtgttcaggttaacagccttaagtgctttttattctggtaacacagactgtatgcacgtatgtatgtatatatgtatgtatgcagctaggtctaaatgtcaaaattaaaagggattggaagacagagccgatatggaaggagttgcaaaaccctcttattaaacccagcaaggtaaacacaggacagatgtctgaagaattgattttagctttgatcaaaagtcagacttcattgatctttgtttctccaaatcacgagcagttgccaggcacaccataggtacttataattatgtgttgaattaatgatgtgccctgagctcagcatcagaataaagggtctggaatgtagcttagcacctgaggctcacactgcttggcctctgacccctcctgcagagtccagggagggagtccagcctctaagcaccctgatttcaaggtttgttgtcctgttgctgcagctgaggctagaaaaaaaggcaggtcacaccttgaggggggaagaatcaacaatttctaccctttgttctaaaactaggcgaggacttatttttgctaattatgagttgaaaactggactgcttctgtccctgcaatccctcaggaaacaaacctgtcgccatccacaccacttcatgttcatgtgcagccctgggtctgagtttgcacaaagcacattcaagattgattcagtagacaaaaataaagtctaacaaaaagcttctaacctctaggttttgacaattcaacattagccatcatgtaagagtttaataacttctatgtactacactaagcatgtcattaacatctaatttattattcattcttataaaatgtacgaagttcagagaggcaaagtagcttgccctggatcacacagctagcaagagctagagccaaatttgaaatgaggtttggctgactggattccagccgggctctttcccattacattaggctgtcccctccagcctaaggcaagagacactactcactgtagaaatgacaaatgagtccacagaagtgttgcaactgccacttccagacaggcaggaggggaaatagtattggaaatgctggcaatcttttttaatgtttttggataggcaaaacatttacaggaagaaaaaaaaaactacaaggctagaataaaacaacttattctacctagtcctcaagcagttctcttgaaaggtaaggatcttcatctgatcttcaagtatcttccagccttcctttatgcaaatacagtgcatatgaatgagtatgtgttgagtgcaagtgtgtgtgtgagtgtgtgtgtgaaaatgtgtatgtgtatgagtatatgtaagtgtgtgtgtgtgtgtgtgtgtgtgtgtgtgtgtgtgtggacagaatctcacatagccgagactctctctgaattcaccatagctgagactgaccttgatctcctgcctccatcctccaagtggtaggattgtaagcatgtgccaccacacacatctgaatatacatttaactttcttgtttttcacaaaatgtaatgcatcccaatattgttctataacttgctggttttccccatttgctgtttcgcttaaccaaagaccaaagtcctcccatgccaagtcacagagacttgcattatcttccattccacactgttctgttgctctgatgcccactgtactgatgcactatagcttaatctgttccaaagtgatgagcctttttccattccaaccttttgccattacattatattaatatactattccacacatacaccagcatacccatacaagaaacttcacacatggatgactagataaaaaagtgactgtgttttgctaaagatggccattggcagttacccccataagagaggtaccaacaggcattttgttagcagtatagcatagtgcctgcttcccagagcccttaatagcaagggtatgtcaaggctttgagatcctatcatccctgagctagaccactttcctaatccatgtggtattaatttacattaaggggccttgtatttccttttgaagaactctattttcgtgtgccttcacccctttcttttctgttctgtaatttcccttattttacaggaagaaagaaagaaataaggaaggaaggaaggaaggaaggaaggaaggaaggaaggaaggaaggaaggtaggaaggaagggggaaagaaaggaaggaaagaaagaaagaaagaaagaaagaaagaaagaaagaaagaaagaaaaaatagcactgaggcttagagtatatgaaagcatgtgatggaacagtcttacctgataggaccaggactgaaatccaggtctatctcctccagaccctgagagtttagccattaacacgtatattctttgtattatttatccctattattgtttaagttttagtttttgagacaaagtcaagaacagcccaggctgaccttaaacccaccatatagctgagactggccttgaacacttgatcctccagtctccatcttccaagagctaagattacagacatgtgacaccatgcccatattgtttttgaactggccaagagagttgtccactcagagcgggtgatgaacctgggggacactaagaaactgggtgatagagaaagccgtcggtgacaatgtttccaagacacaaccatctgtgcaaaggcaagaatggcctgcagctcttcccactggttttacggagcctgccttctgcttctacccatccttctcactctgatgtacaaccaacctaatcctaaagcttgttgcaatagcctgggtgaattcagttccattgcaattcttttttccctttctgagatttgaatgcattccaattagaaagaaagttctgttgtaagtactctgacaatttgtctttaagaccttagctagggcttagggttatgatccaagtggtggaatgtttgcctggaatgcacaaggccctgggttctgtgcccagtactgaaggaaaaatagaccttagctgatactgattaaagagagaatttccttcagctcaccttagaagtcatcccatttctggagaatatgagaaggaaaagatggaaggaaagggaggtacagcttttcctattgtcttttcctgtgaaacaatactgccacaaagttaggagcctaaaagaacacatgccatctcagcttctgtgggccaagaatctgggcatggtttcaccacactgtcaaggtgtatacacacacatctaatcctagcacttcagaggctggggcataaagatggggcatcaaggccagccactgctttcgctactttctcctcatatctcacaggcaaacaatgggatttagtagagtactttataggctgtggtccagataatccaacaagggctgcctcccaacagaaagcccaagagtccatcagtttttcagttctaaagactggatgtctcagctggtcttcagaatacattggaatcctcaaaaagcaggctctggggccactgaagagaaagcaaaggcaaaagctactttcttccatgtcctttatataggctgccaaaggaagttgtgacccagatttaggatgggtcttcagactaaaatccctcacagttgtgcccatcaacttgggttttagttaattccagatgtagtcaacttgacaaccaacaatagccatcaagcaagtaaaggtgcttgctgccaagcctaacaacctaagttcaattcctgaaacccacactgggaggaaataactgctttgagctgtcctctgacctccatgcaggtactaagggacacacaagcacaaaaataaacaataaatttgaacagaggacagccaaggctacacaaagaaaccctgtctcaaaaaaacaaaactagttaatttaacagagagaacaccatttgtcttcctgagtcttcagtagcatccattttcctgcaaatgtaaatgttatgattccattttttctttacagctaaacaaaatacacatatgcttgtgcgttttatttatccattcatctgttgatgtgacagctaagctggttccattttttagcccttgtgaccaaggcagcaataagcacagatatgtgaatatctctatggtgtgttaactagttgttcttctgtttatacacaggtataacatagttggtcacatgtagttcaatttttagttcctggagaatctctacagagactttcacaggggctgcaccagtttacattcctgacagttgtggataaaggttctagctgaggggagttctaaccaaactattgaacaaatgtgccgcttcctacagacttgtagcaaagcttaagaagagaaatgaagaaagaattgctaaggaaaaagaagatggaacttaaagattcagaaaaaatctcagggtcttcttactctaaataatagtaataataaagaaaaagctgagaaacctcctcaggaaagagccccaaaagtgtggttacatggccattaagtggagatgaatacaactttgaagcaagccctccaactgaaacactgaggagtgtagatgggatgaaatgagggaaggctgagagactcctggagaccaagactggaccacagagctgtgtgctgttctccataggaagggttgcctctttggtttcaaaatatatggggatgggtgactgtggaagtagataggggtgacatccatcacctaggtttccacaggctgcaatgcactctgggagcagcagaagcagagttgcctggagcactcattttgctgtactcctccttcttcactactggctttaaagacaacaggaagccacactgaagaactgtgtgaggcaagcatctgcaactgacccagagatgctaagggctgatacctctggccaagatccagcaaagaacccagcggggtcctcagttcaaagcccagagccagtggaaggagacagccaactccaaagacgtcctctgacttccacacacatacacaaaataatagctaatctttaaaaacaaaaagagaaagaagaactcttggagaggagctagggaaccagcaagggatggataattgcaaaggaggaaggcagtgagtgagggaaatgaataagaaaataaagtcacacacacacacacacacacacacacacacacacacacttgaatctatatacgctcacttaaaaaaaaaaaataaaacaggctcctcagctaaatatctaactttactgccttccaccaaatgccagaacatgaaagaactgcaaaggtgtcccctccacttccagtggcatactgctcctttcgcccatctgagacgtcaccagaatgatctttcccttcttattctttccaacaccctattcatgattacttatgcattttccaggaaaattgaagctttcttcagagataacttcctgtctttctgagctcttgccaaacaccatttagcagccaaagatacccagcaatctcggcttttctgagcatatgccttgctctcagttcaaggcctcttccacaagttcaggtatttgtaagaaccacacttcttgtttctgattttgcttcagtctgcctagactatcacaacaaaatgatatggtttagcaggtaaagctgcttgtctccaagcctgacaacctgagttctatccccagaaagtccaaccacaccagatgtcgtcagactttctttggactgacagctccaaaagaatgacagagacttcttcctgagtatgaaagcttggccttagcttaggcttgttcccaactagctctgataaatcaaattaacctgtttatattaacccacattctgccatgtggctcattacctcaacttcctctgtgtctccctggcatattctctgcctctcagattcttcccagagttcctatcttttcctggaaatcccacctatctcctcctgcctagctattggctattcagctctttattaaactaatcagaaagtgccttgaagagacacatcatcacagtgtacaaaaagattatcccacaacaatgggagaaggggagacatgactcctgcaagttgtcctctgacctccattatctgcaccatggcatctgcacagacaacacagacacacagacacagacacagacacagacacacacacacacacacacacacacacacacacacacacacacacagcaatataaaaaatttttaatttaaatttaaaagccaataaactgagtagttaagatagcagaaataccttttcacagctctagaaaattgaagtctaagatcagatgccagttccctaacttttatccagccccttcatcctcatatgaaacagaaagcaagtttggatctgtcttagccagtgtgaagagacaccatttccatgcccactcttataaagaaaagctttaattggggcttgtttacagtttcagaagtttagtccgttctcatcatgtcagggaacatggcagcatgcaggcagaggtggtgctagagaagtagctgagagttctacatctggatctgtgggcagcaggaagagagaaagttactaggcctggtttggtctcttgaaatctcaaagcctaccccagtgacacccttcctccaacaaggacaggcctcctaatccttctaagtaatgccattccctgatgactaagcactcaaatatatgagcttatggggtcattcttattcaaaccaccacattccactccttgtcccccataggcttgcagccatatcattttgtaaaaatggattcagtccaacttcaaaagtccccatagtctataaacaatctcaacactgtttaaaagtcaaaagttcaaagtctcttctgagactcatggcaatctcttaactatactccctataagatcaaaaaggcagatcacatgcttccactatagcatatacattaccattccaaaaggggggaaaggaagcatagtgaggaaatactgggacaaaacaagactgaaaaccagctgagcaaattccagactctgcacctccatgtcttgtcagagcactccagatctctatctaactcctttcaaccttgttgactaacaacatgcttctctctcttgggctgcttccactcctgttagctcaccccagcaggtatcccagcactctggcacctccaacatcttggggtctccaaggcaacccaggcttcaccttcatagcttcacaaactagcctctcagggactccatacagagacgaccctgacacatgcctggcctcacctgctttccttagcgatgaggggagattcccccaccccctttctcatatccatgactgtaaggctggaatcatgtggccaaagctgccaagttctgctgcttcctggggctggaatttgcccccaccccagcccatgttcaagtacattttcacccaatttctgtctttgatggtttcttccactgcttttttcttcatttcttttcacaagttggaagctcagctaggtggggtattgacctgaggtcactactcctcttatgccacttagcatcaggcttttctttaaactttttatctccttgagcactgggcttggctccattagacttccgggtgctcctttcctctttctattgtacattcgtgtttttacttgctcagctcgttcctttttattatagatctgcatatgagtggccattaacaaccacatggtgccaggtgttgctggcgcatgcctttaatcccagcactcgagaggcagaggcaggaggatctctgtgagttcaaggccagcctgctctccagagtgagtgccaggataggctccaaagctacacagagaaaccctgtctcaaaaaaaaaaaaacaaaaacaaaaaaaaacacacatggtagagtctcagtgctagaccatcttgaaatctcctctccaatgccattagtccaaaactctccaattccgccttgggcagattttttggacaaaggcagaaaacaagccactttttttgtcaaaatgtcacaagaatgatctctaagtcacttataaatattcttctcctctgaagcctcttcagccatgtcatcataatctacattgctctcagcaccactgtctcccacattccaactagtgtggaccatgtcttagtcagagtttctgttactgtgaagagacaccatgaccacaacaaatcttataaaggagaacatttaattgggtggcttacagttcagaggtgtagtccattatcatcatggtgcaacagggtagcatgaaggcagttgtggtgctggagaaggagctgaaaattccacatcttgatctgaaagcaacagtaagtgaactgagacactgagtgtaccctgaatatgggaaacctcaaagcccacacccacagtgacacacttcctccaacaaggccatatatattccaacaaagccacacctcctaatagtgccacacatatgaggttatgggaaacaattacattcaaactaccatagaccattaagcaaagcttaaagcattcaactgctttcctaatccaaaattccaaagtccacattctaccaacaagcagcatggtcaggcttgtcacagcaataccccactcctggtatcaatttctgtcttaattggggttcgattgctagaaagatacaccatgaccatggcaactcttacaaaggcacataaagcccttcctcataaaagccccaccctcctcatttcacctaagcctaattgcttccagctaggttgggatagggtttcagagtatctacctcaaggtctatgtgatgaaggcttggtccaccacattctattgggatgtaggggaccccttcggacctaaaagatgttccttgggccattgggattattctgccgagttctgtgactacttggcttgttctcatagccccgtctgcaccaggaggcaatgtactcaaggaaccaccctccatacaaagcctgcattgtgccagtgggactttcatccactaaaactgattctaaatagacctcttctgtcttcatacgtggcctgtgtcagtattctctctctctctctctctctctctctctctctctctctctctttctctctctctctttctctctctctctttctcgtgtttcaagacagggtttctctgtggcttttagaggctgtcctggaaccaggctggtttcaaactcacagagatccgcctgcctctgcctccacagtttggattaaaggcgtgtgccaccactgcccagccagtattttcttatagcgacaaaaagcaacctactacgcttccaaaaatctgtttacaaaacagtgcttctggggacatacagacatttggactaccctcaatgtgagtgcaataatgttcacagtctgtgtaggcacctaccacaaaatcacaaacaaggcagcttaaaccacagacatgttttctcttgcagtccttgaacctggtaggccaagatcaagctgtttgattttctccttgccttgaacatggctaccctaatgctctgttctcagagaacagcccttttccacatctggtatctcttcctcaccttcaaagaatattggcctattgaaagttgggcatgaagcctataacgcaggtgactggacaggaggattgtgagtctaagaccatcttcgatacataaaacatgaaatcaagaccagcctgggcctagtgaattccaagccaacattggctactgaatgcatcactgtttcagaatatccaaaagaggagggggaaaaggaccagctatgcttgattaaggtgccatccttaggacctcatttaaccttaattatccccccataatcactctattttagactggaaggtattgctgaagattgagactatgaagttgaaattcctctgtcatggcacacaccaggcctgaccctctgtcttggcacacaccaggcctgaccctctgtttaaatactgtcacattggcagttagagcttcaacatacagattttgagagacagttcaatccctaacaatgacatgccttcaccacacagcgacatcaccaggcagcaagacaccatgagcactggagggcccttctggtttgcctgtttcttgtcatacccactatcactaggtgcttttatcctgagtacattcacagggcctgcatatgcatccgtatctgtgtgtggtacaagctccaaggccttgtaacagagatgatgtatccccactgaagagaaatgacagtcagagcgagaagaaggagccaatttgtcacttactgcagagcctgctagtgctgcagcaggcgcctcacactgggattgattacaaacaagatgacatttccctgtgggctgcctcacgcattattataaataaataccactccctttagcatctgcacggctatcgagaacagattctcctcttgatgccctaggtgcacagtaaatatcccagggaccacaatggccttcttcagtatataagagggacattgtttcacatgagacagtttcataaattaaggctgtcacacaactccatgagaacagaaaacatacacagagttggaatgaccctaggaattcatttccaagaagggttagctttaaaccatgctgaagttctgttccaaaggcctgggcagatggatacaggcctggaaacttgtgatcccaacactcagaaggaccacaagttcgaggcctgagatccacagtgataccttgccaaagaagaagaaaggaagaggagcaggaggaggagtaataggaaggaactacacaacctacagctcaacatctgtttggagtttgttttggtttgttggggtttttttttaattattaatattttttttttatttctcatcagctcaagagaatcagttgttttctgggagtgtttcctgaaaatcacaatgggatttttaagatggaaataaatctgttaaatttttgaatatctctctggccttgccctgactgttccaaatctgtcatcttatgagtttcaaataaataagttattttaaccaacgaaatatagagcgactgtcttctatttatttccttatgctttgcttcggtgcaagggtgaatttgatctgcctgcggattttttttttcatttcagtatctatccactcattttctatctgcccctccaccatctctcaatgttttcctgtcttttcaatcttttcctcctacataaacccaagagagggttggcatctgtgtttcaggcgtaacatgagtgccccctgctgtcaagaatggtgaatagctccgcatccaggcaggttccaaccaatttggcagatgggaaaaaaactacatctcaaggcaaacactggaaggattgttaaaatgaataatttattaaatcgcgattgtttattgaccggcctttcattatttacttttcagttattaaacatacccgtgaagcatctgggtgtcagcccttggcccactccaagcctttttcccaggcggagatgttgccagtcccttgcttctccctacccaagacattttcgatctcttttgtcaggtcggggtcaaactacagttgttccatgatgactttatcaattctcagttgatagactctaaatgaaaaactgcccgctgctgcctcgcagccacttaagaagggggttatctgtgtaatgttctgtcaatcgagcagggtctgcgacagacgcagggagtcaagtgaaatagggaaaagatgtttttaatgccttttattagttagtctctgtccgccacatcgaagactagctgacatccatcctggactgtccttccaaatcaaaaagataagggaaggaatgtgagcgtgtgtgtgtgtgtgtgtgtgtgtgtgtgtgtgtgtgtgtgtgtcactcttttctgaagaaagtcaacaatatattccttaggtaattaattacactagtcatcacctttcaccttgaagtaggtcaaggtcaaaaacaacaggctacaatgggaggagcacatcccaagaagaaaatctccagatttgaagagatatgctattctgtaccagggagtccttgcttctaaaggacaaacttgtttggtttggtttttatacaatatgttctgaccctacttctcccctctctcagctcctccaacctcttcctcagttttaccatgcaggagttccaaaacgtgtgtgtgagagagtgtggcgctcccaaaataataataaataaataagtgaacctcgagtcaaagaacagagcagagattaataaatgtcattctacaaacccgaattttaaaacgaaccagaccaagtgaggcggttcagtggggaaaggtgctcgccccgcgtgcctcaggagtccacatcgaaaggaacgaaccaacttctctgactttcaaagcccaaatccaaatcccatcacaaactattaataacaataaataatttttaaggagaaaatggaaatcccagttggtaatggcggtactgaagctactcacaagcataagaaagtctctctcgccggacaggcggtggtggcatcggaagtgtttaatcccagaactcagaggcagaggcagatggatctctgtgagttcgagcctacagagcaagttccaggacagccttcaaagctacagagaaattctgtctcagaaaaaagaaaaaaaagaaagtctctctctctctctctctctctctctctctctctctctcataaaataagttgagccatttctgaataactcaatagagatctacatcggtatgagaaaaattatattatcagatgtttgaaaaagttaacagtaaataaaattagaaatgtcatcaaactatattccctccctcaaattaaatatgactttaaagtatggtttacactttggcatttttctctcttagcactgagcgtttacaggctttgcatccagaaagctgagggaaaactcagaacagggccagggaaagatctttctgatgagaacatatgcccagccttcagtctgcctgctacatgtacctctgatgtctaggaatgaggcttgagcatctttgtaggatcaatgccatgtcacaatgtcaaaaggttggacagcctcggcttatgccaaatagtccagaaagttcgtaagagaaaaatcattttagtagccaagagccctgaacttgaagtgaatctgatgctctggcttgggttccagttgtgggttctccagatgtgtgacttgaacgtgtcacatgtgaagcttcaatttccttgttggtaaattaagctggtgtttcttccttcataaaatcaaatgggagttcatccagtcgtgcaaataaatatctaacacaattaggaccatcagccatacttgatatatgtgcagagccttcactttctaccttctttctgtcccagaagccatactcaagaaagggggagtctttgggccaggcatggtgaggcacacctttagtcccagcataaggaaggcagaagcatatggatctctgtgagttcaaggccagcctggtttatacagcatgttccaggccaaccagtctacacggtgagactctgtctcaaaaaacaaaaacaaaaacaagaaaacaaaaatagatggggaggggtagaggagagagatcctaacattaaagaaggaaacagtcattacttcctaggcccatcgatttctcctggattgattaaccatttgcctgccagtgtctgcagtgaacaggtgtgttctctctaaaagaccaaggcaggtactcaaactgccttcacagatcactccccaccaccaacccacaaaagccaggggtggaacccagggcttctctcattccaggcaagcacaactccagccctgcagtcagtgatcttttttttctgtcaaatagctccccactagggaattcttcaccagtattggtttctatttgttcaagctaataaaacaagaactaaagtgaagaaacttaaatgctaagttagaaatcattataacagaattgttctaatcttagcattgcactacaattgaaatgtttagtctttccattaagctctaacaatgactaataattacccaagtaacaacgagcaacagagacagctagtttttaaatggtcaatgcaatgatgaagacgtgtgcataaaattatgggagtagcagagaggaatccctgtcctggctgaagggctgaaagggaagaaggaagcaaggcaaccttcccgagagactcagctgagccctgaatcttccttcagctcagccctcatctcaacttgtaataaatctggcacaaatgtgtccaaacctatctaagggtttgtaatggagcaccccccccaaaaaaaaaacacacttcaaagagcacattgttacacatctaagaaccgaagtcacctgcaagcaaagtaaatgatcgaaataatcaggtttgagattatttgtatttcttcaaagcaatgagggattaaaggagaagagtgagaagtggagggcaagggggaggcatagatgaagaaagaggagcaggaggaagactgaactggtcccccacatagaaaccccaaattcacttttatacagagactgtctcttcccataatgcaattccaccctgatcagcactgacagagagcaaatcaccatgaaccccagcacttctcatgatctgtatcagaggaatggaggatatttatgctttgaaatataagtgctttgaaatttcctgaatgatgatgctaagtgcaagatgttgctattatgtcccctgcatccttcctcagggccttcaggagactttcagatgttgggaaggtattataatgatgtgggggtcaaggaaaatggtaggcaaatgttggtacagacatctacaaacaatacccatgtcatcttttcaaaactacatttcactcactccacagcaaaggaattttttataagcttggagagagtgcagtaatacgattgtctggcagaggctgctttcttccccaccctctgtagggatctattaaagaagcaggaaatggaaagagaggcagtgcgtgtgatggatgtcacttaacattactttttatgaagttctgcaaaggcccttggtataggcagacgtggaacaaggtaagcacataaataaacgatcaccctgcattccagggtcatttgcctcagccctttttgtgaacttgctgggacttagtgaggttgcaagagagattctagaaagagtataatatgatcttgtcacagtcccaatatgtggaacaaaacaaaacaacaacaaaaaaagatttgtggcttttgtctgcaagatctgatggattagggtgttagattcttcactgttggtaggggaaaacgaatgctccaatcccccatgcctctgtgactgtttcattgcgcttttatggatgcttttgttctgatctggaaagtcggtaaggctcagaccctccacaggccagtaatggagctatgagaagccacatatggccatgcttataataaactgtgctgatccgagtgtcaccagggaggatgcttagtaacaaaacaaactcccaaacaagtgatcacagtgccttatgcttgcacagtgtctttttgtctagaagcttctccaagcattttacaaacttgtataaagggtccctcaccagtcattgggatgcagttgcatctagggcagaataaaggcaacggctctgccagaaaatgaacatgctttcaagaaaagttgttttgtaggctggtgagatggctctttggcacctgataccaagtccgacgacctgaattcgatccccattcaatccccaggactcatttggttggttaaaggagagaatcaactcctacaagctgtcttctgacatccacacagatgacccacacaatgcatacacacaaattgtgtgtgtgtgtgtgtgtgtgtgtgtgtgtgtgtgtgtgtgtgtatacacactctccgagacaggattcctttgtgtagccctggctgtcctggaactcactctgtagaccaggataaatttgaactcacagagatccatctacctttgcctcccgagtgctgggattaaaggtgtgtaccatcactgcccggcttaatataattttctttaagttaaagaaaaaggccgttttgaaagtgtagctgtaaaatcttctgatttttcctttttcaggtcatgaggggaggatttaagctagtggacacagcacaggactattgtcttaaggaacaggatgggtattaaagaagctgccacacactcttcacccttcctaatgacaagatccaaaataaacaggtcaaataagtgtcccagctagccagaagtgtgtgcatctgccagagtcagggctaggtgacagaggccacattttctgggagttgtaagatggtgaggtctgttagaggtagaagccccagattctttatcagcccagctggcagaatcagtctcctcagaatccgtgcttaacccacaactctgggcctagtcaccagaaaaacctagtacagaagttctccacggggctagctttgtgtttgaacctacaggggagttcagactacacagggggttcaaggccagtgtggactacacaagactcaggcttgagggaaaaaaataataaataaataaataaataaataaataaataaataaataaataaataaatctcctcatgactccagcagcatccctcaagtcagtatgaataaggattataacctagagtcctgggcttttattttaagacagccattctttgtagattggtctcaaactcaaaatcctacctcagtctcctaaattccaagattacagttatatgccaccatggccatttgctaaacctgttcagtttccaaatttgaatattattgtcctagttttgctcactgtactaaaaacagtgtctaaatcccctctcctcaaaagcaaggtctaagataggctttatccttccattaaatgttgtgtctacagttcttgctaagctctggcatgacctcatgtttacaacacattaatatgcaggcttattctccacattctttcctggtggcaataattattatagacccagccaagactcactcccttatcagtttttccaataattctcacctgcaaaaaaaggcagttttatccttcttcctggcagaaattttgaagcaaagaactccagtgaattctcacctgacagagtttactgcatttttctgaacatactgcaagacatttattagtagactatgaagtatttataatggtaattaaaactaagctatcacaaatggagtaaacgcagagccagagataatgctgttactttttattgtgtatttgctcttcctgtaatctaatataaaaactccttcactaagttgctaaggcatttatcttaaggctgatgttacacaaatctgtttcccacaaggaagacccataacatatacaaagtcactattaaaagagttccaaggtagcaatgcatagaactctgtgtctatactgctgatagatataaatatagattttctttaagaaaaaaaaagaaggcaagccaggcagtggtggcacaggtctttaatcccagcactcggaaagcagaggctggcagatctctgtgagttcaaggccaacctggtctacagagcttgttccagccaaggctacacaaagaaacctagtctcaaaaaaaaaaaaaaaaaaaaaaaaaaaaaaaaaaaaacagatagaaaaaggaggaggaagaggaagaagaagaaaataagaaggcaatttgcacacggcacaaatattcacacctttcagcctaaaacttccactagtctttttcctaactaatcagactcaggcatggtagctcccagtaactgtagcggtgtaaaacaggcagacagatcttcctaagtttgaggccagcctagtctctatagtgagttcaagccagccagggctacatagagagactctgtctcaaaataagacaaagaagagaagaggggagggaaagaaggggaaagaaagaaagaaaatagttactcatgaccttagcatggtagcatacacctttaatccctggaattgagagactgaggcaggggatcaccataagttcaaagatagtccataatacaaagtaaattcctggtcatcattctgcgacacagaatgaggctttaaatttatttttttttaatctagatatgtagatgcccctcaactaaagaatagataaagaaatggagcagcagtttaaaaaagcaatgatatcttgaaattcacaggcaatggatgggactagaagaaaccatcctgagtgaggtaacccagacagcaagacaaacacagtatgtactcacttataagtgaatattagacatagagcaaaggattaccagcctacaatccacaaacccagagaagctaggaaacaagggtcctaagagagacatacagacccccaagaaatggaaagagacaagatctcctaagtaaattcggggtgtggggggaggggtgggagcgaagagagagaggaggagagaaggtgagggaagaggagaacatgagggaccaggaaggtctaattgagggaaggacagagaagaacaacaaggaaaaagataccttgatagaaggagccattacaggtttaaggagaaggctatcactagggaaatctccagtgatccacaaggatgacccccaaataagaatctaagcaatagtggagaggctaccttaaatgcccttcccctataatgagattgccatcctagagccttcatccagtagctaatggaagaagaagcagagatccacagctaagcactgggctgaacttgtggggtccagtttcagagaaggaggagtgatgagcaaaggggtcaagaccatgttggggaaacccacagaaacagctgacctgagcaagtgggagctcatggaccccagtctaacagctggggaaccagtataagaccgaactaggccccctcaaagtgggtgtcaattgcagagcttgagcagtctatggggcctctggcagtggaaccaggatttattcctagtgcatgaactggatttttggatcccattccctgtggaaagatactctctcagtctagatacagaggggagggcctaggtcctgccccaaatgatgtgacaaagtttgttgatttcccatgggaggcctcaccctccctgaggagtgaatggggggacggatggggagatggtgggaggatgggagggagaaggaactgggattggtattttaaataagattgtttttaattttttttaattaaataattaaaaacttaaaataaaaaaactagatatggcagtgcacacctataatctcattacttaagaggtagaagcaagaaaaccagctcaaggtcctccttgacctcatagctaatttgtggccagcataggctacatgagaccctttctcgaagaaaaaaaaaaacaaaaaacaaagatagatagatagatacatacatacatacacacacacacacacacacacacacacacacacacacacatgtgaaaaactagaattttatcaagcaatattagtaaatcaccagaacatgaatgctgagctggaaagatgactcagtgggtaaaggcacttgctgcaaaacccagtgagttcaatcccagacacacgtatgtatggtaaaagaaaagagctgactcctgaaggctctcctctgacctccacacaaagacccacaaataactaatgaaactgtaaaaggaagacataaggttgagaacaaggcgatgacacaggcctacaatcccagcacttagaccaaaggaggagaagctaaagtacaaggcaatcctaggcttcacagtgagacaagagatggatggaggtcaattgggatcagtaaaaagcaattcggtctcactaaagattgagacgcacctgaatggtctaaattcaaagcacctaatgaccccaaattcagtaggatgtgtgagcacacacacaagcatgcattcgagtgcacacatgcagctacagagcagacctcaaggttactccagcttgtctttgctacacacacccctgtaataggcatagttagcctagagacctccaacaaacaggttcttctgacaacactagaaacaagatttaatttaagttggttttaagtctcttccattggccttgggaataaaagacagcaggctcatcattcatgaaacacttattgcttttgtcatcaaatccctgcaaataaagaattttctctctgaaagtgtcattctttgggcttctttctcctttgtcatccagttggaagattcatacatagctttcctgttggaaaatgctaattaatggagaaaaagagggggccccctttgggctggtggtgagagtcccaggtggcagcatccccttatgtcttcatcagtggctgaggaaacctggagggcacgcctcctttcagcacctctcacacacctgcctgtattcccaggctttagggcagggatagaaaggctgccaccaaccttactcctctttgctgtaatggtttttgaagggtctctttttcccaaagaaataatgaatgcctctttgcaaactgtcggggaaaacgttctgtttggaggtaattgaaaatatgtttttgcagccgcttctgaaccattttccaaacagctttcctttctaattaactcacaatgcttagctccgtgattcaccgggtagacagtgacatctagtgtgtacagacagagttgggagaacgccttagacacagatttgtaagaacaaccaaaaaaaaaaaaaaaaaaaaaaaaaaaaaaaaaaaaaaaacgatacctctattccaatgcgggggattgtcaaaatgcaaatttggcatcatacaggtttgtaagcacttgaaattatcaaaggagtgttttctctttagacacttagaaaaatctggatgttttaaggtacattttagcccagcattcctatcaccccagcacttgggagataaaaggcaggaggcgcaggagttcaagggcagcagctacactggggaattcaaagccatcttgggctacataagaccctgcttcaaaacacaaacaaaaagagccacattttatctaaagaaataaatgacctaaaaaaaaagtagtttgaggatatgatgaagtcattacacttgagagatgaaatataacttttccctgagttcagaaaggaactttcacttgaaagtgaaaatgaaaaggattgtgggtgatcagctgcccctggatgttacaggaatttccaagctttgcaggtatacagagaaaacctttagtagggggctggacatctagctcaattgagagagtatttgccagcatgcacagagccttgcattagaactccaataccacaaaaaccagccatgacaatacaggcctgtaggtgaacactcagtaatataaacaggagagtccgaagttcaaggtcatgcttggcaacatagggagttcaaggtcagctttggctaaatgagacccacatttaaaaaaaaaaagaaagaaagaaaagaaaagaaaagaaaagaaaagaaaagaaaagaaaagaaaacattctgcaactgacctggacatttcttttctgacagctagctttcacagcaccaaaggaaggctctgttcaggctgcggaggcagaaaagacatcaatggtcttatccggcagtgacttccgggcagggtgtgcccactgatgcaacagcagaatgaatgttcaagggaataaccaactgctctctgactacatgagaaaattcatgcctagttctgtaatgtggtctaaaggccatggctgggaaggtcgttgttttgctaaaagtcaaactgatttctcaataattatgatcataactttagacagtgctggtctcaaccttggtcagagaagtttagttttacattaggcagcagttaatgctcagattcaaattggtgattgctgggtactcacccctaaacagaacaccagcatcatccaaggctctgggaatattttggaaaagggagtagagagaacgcaagagccaggggagtgggagggcactgtaaacagctgtcttccggacatgcatggccattatgctcattaactcacagcaactgtggttacctggacaacacttgcataacactgagcccagtcatactttgtcatgcatgaaggaagcacatgaactagctgaaggactactgcagttactggtcactgacagagacagagacatttttctctaggggtaaagccagtaatccagtaaataaacccatagcaagtgcatgcaaccaccataattaaacctagttcttagttaaattgaattttaaagacctattttctttttatgtgtttgtgattgtgtgagtgaataccacatgtacaagggtggctaaggaggccagaagatgccagatcccttggagatcaagttccaggtggttgtgagccacctgacctgggtgctgggaatcgaaccctagtattttggatgaccagtaagtgcttttaaccatatctggccatctccctttccccattaaattaaatatattttttatttatttacttacctattgtataacagaagatcactgtcactgccaacttagcaagcacaaatggccaacacaggtcatatgtactgtggtgaatcatggaaatccctgcttccaaatataaacatgggaggtacatagaggagggggtcttacaaaaacataaaaaataaaaaaataagaactttttaaatgagatggatcaaattacaaacaaaagcctggcagggtggcacacacctccaaacccagcatatagaaggttaaggctttgtactggtttggtttttgtttgcttctttttgtcagtttgacacaagttagggttatataggaaggagacgtctcaattgagaagatacctgtgagattggccggtaggcaagtctgtagggcattttcttgtctgatgattgatgtatggttgcattccatagcttgctgggctgataacagaacatgaagcaattgtgagcaattgtgagcagtgtcacccccaggcaaatggtcctgggggtataagaaaacaggtgcaacaaaccatgaggagcaagccaggaagcattcctccacagactgcttcagtgcctgcctccgggctcctaccttgagttcctgccctgacttccctcaacgagaaactgtgatctcaatgtgtaagccaaataaatctttcctccccaaattgcttttgggttaaaatattttatcacagcaatggaaagcaaattaggacaggcagggaacctgaattccaggccagcatgggctacataatgagactgtgtcttagaaataagaacaagccaggcatgagggctcaaagcctagtacttaccaggctgaaacagggtgctttccagcctatgccatgtagtaagtttcagactagcctggcctataattgcaaccctgttttaaataaaaataagataataataattttaaaaagacatgtatggatagaaagaaaaggaatttggggtaaggaaaatatctctctctgtctctctctctgtctatctctctgtctctctctgtctctctctgtttctctctctctctctctctctctctctctctctcacacacacacacacacacacacacatacacacgaaaatcacagatggtgaaaagatctaaggactgctctgatcaaagagcacaaataagttgacaccaatgccagtgttaggtaactaaaggggagaggcagatagtgatgggggcttctttctgtctgttttgggtttgctttcttgagacaaggtctcagtgtagctcaggatagcctggaactcactatacagtcctggatagcctggaactggtaacagtcctgctgcttctgcctccatagtgctggaatttcaggcatgagccaccttgcccagctcagaagatggaatcaatggtatcatctcacagtccctcaaatgcctacagaagatccccaggggatccttggtgcctgtgacatggctgtatggttgcattccatagcttgctgggctgataacagaacatgaaggcaaaaaagaatagtggttagcaatcacctatgacagctaaggaggtagggcaaacgtgtcactgtcatagcacaggactggacaatggccattacggttgtggcagagcagagccatccatctctgtcctcgtccatcattgagtgagctctatgcaagagtctctccctcttcagactgaaggagaaaaattgttcatggtgaaagtcactatctatgacctaatctgtcctgcttctgggaaaagagactttctaaacagacctatcaaagccaggtcacctctgcttgctgaagtcaagactcctcacttaaaacacccctgttctaaatactgtagtgacttctgggtggaacagtaagttagaaacctcccagataggccactgagatgactcattgggtaaagtaattgctgcaccaccctgataatctgagttggaaccctggaacccctggaaaggggaaaggagagaacaaatattctcacatatataaaataaaataaatctaaaagaaaaaagtggcaggaatgaacacagaccaaaaggaacacttacactccactgatggcaatgtaaattagtccagccactatgggaattagtaaggagggtcctcttccatatgacccagttacccatgtcatacccatggcatacatctcagaggtgtttgcacatcagtgttcatgatcagccatttgtatgcaaaacccagacttgccgatttcatgaggaacaaaattgaacccgagataggttattaactggtaattcattgggaatatatactcacatgaggaatcagtaaccagatttggcactccgagaagtcaggacccagatgcttccaggagctggctgaaccctgagagagagcgctaagcgcctctggtgctctctctttatcctaccctctacatactcaaatgggtgtggtcagcagtataggtaaccagggtctttccctacaccccttcactagtactttttgttaataggcaaacttaagtattaataatgatcaacagaatgataggtctcttcatccttgataaaagagtaatacaactgagttaggcaggctttagaaaagatgaactacattgtaaagtaaatttcactaaagcataatattaaatatatgatgtttaatatgatggagtgttactggatagagcaaccacactctaggagtagatggccaacacaaaacaaactcaactgtatttttgtggatttttttgttttgttttgtttggtattttcttatcttactggtctttggcttattcgttgttttagtttttgttttggtgtttttgtaggggggattgtttatttctgctttgaaagagagagaaagaatataaagttgggtgcataggatagtagggaagacccgagagccgtgaggggaggaaaaacatgaccaagtgtgttatataaaaaccatttgctaaggccaagcagtggtagcacacagctttgattccagcacctggaagacaaaagcaggcagatctctgagtctgaggccagccttatctacagagcaagttctaggacaaccagggatacccagagaaaccctatagggaggagttaaatttaaaaagaacaaaggttagagagaacagttctgcgacacaggcttttttattttcctagtaaatccacttttgttttaatgagagccagtctgaatgaagttctgcagatcatgtaagaatgccttcattctcacggggtacgtgatccaagcgaaaactggacctcacccaagagtgatcacattcagaactctgggaattatgaaaggttcttaaatgtatgctgaagaaagtcaagggtggactagtctgagggaaatgagaaagacactgacctattagaagccagccaagtcagtagccgtaacatactgcacccgccaggattttaccagacagatttgccagactgaaagagagatttattgcaaagacttggcttatgtaactgtggatcagctaagcgggtccaaaatccatagggcagatggcaggctggaagctgcagacctcatggaaacttccagttctgtttttaaggcagactaagtctgccttccagatcagtgaccatcattcccttttcccaaaactgatggattgtataagtacaaaattacctcacagcgacacctaagttagtggggggctgaacaaatatggattatagtctagtcaagttggctaccaaaaaattattaacaaattgctagtgttgttcagtgtgctaacaagcagattgcaaagatgaaaactaactacctttgacccagtttggctagcaaagcacagaatagagagttccactgtagggatggagtgagaggtggagaacttcgtgcaacctgagtcaggagcccacctatgctgcttccttggccttcctatgtcttaactgcatcaacagtaaaataacaggacctgcctcatctcagctgtgacgcttaaagtggtaaagtgcatagaacactactagaaacatagcaagtagttaagtgtcaacactcatcactggcattacctggtatgactcctgggggatgggtaaacttaatcctggagtatgtgccaggcataagaaatagaaagtacaaaggcacaaaggcatacctgttatgcctgaagaacagccaacgaagccaggacacgcactggtgagaaagaaccaggttggatcggttggttccaggcggtctgcaagacagtgctgaatgctgtggaaaagaacaactttgttctgcagcaagaagtctttccttacacacacacacacacacacacacacacacacacacacacacacacacaccaaccaaatcctcaaattcttggaatcccagacttcagctaccaaggcgcatcaatgaggctacatgtgaatattacttcatctttgaggcactgagtgtctgttctgtgagtctgccccccacaaacagtcatctttacacagctatggaggattggttctcagacttcccaaaatcctgggatacccaagttcctcttaatgaatagtgactcggcacatgactcagccaggagagcactagcacagcaaacaagaagccctggtttccttccccactgccatataaagtgggcagcccacacatgttatcccaggacttaggaggtagaggataaagttcagtctctgaggctagccagggacacatgggtctctgtctcaatagaaaagcaaaataaaaccacccctgggtgaggagctattaataactgatggctcctgggggagacaaagacagttttctgtaagagtgtggcctctggtggtttgaccaccatccagtggatggccccatacccatagaaaaatgggtagcagaaaactggactctgtgggttatttttttttaaagaagacatgaagttggaagggacaggaagtggatctagcaggagctaaggataattacattatattgtatgcagttctcaaagagtaaaaatatattttaaaatggataaaataaaagggcttccatataacctacaaacatccacctatgttcattttatgtgtgaggtgctttgcctgcaggtatgtctgtgtgctacacaattacctggtgcccctggaagacagaataatgcaccagatctcttggatctagagttcgagagagttgtgagttgttatgttggtgctaggaattgaacccaggtccactggaagagcaaccagcagtcttaaccactgatccatctctccagccccaacctgtgttctttaaatcatctctagattgctataatacataatgtaaatgcttattgagttgttatgctctattatttcagaaacagtaaggagaaaagtctatataggttaatacaaatacttggtcaaatgtttcccaagctattttttgaacccacagatgtgggattaatatgtccaagcattccatagagacattaatgtgagttttccattcaatcttggtagcaatttactgacaccatcatggatggggcaggactctaaacataatcctgaatgcaagacctaacaccacttcagttcttcatgcaggatcaggatggctaagccatatcaaaaccatctgattacagacaagtaaaatcatacagacccaatgaatcaaagataactgattgtctccacaaacccattctctctacctggctatatgaccatgttataatgtacagactgcatttccaggcccttctcatgtagatgaagccagataatttgtcaccaatgcaacatgagcctaagtgatatatgcatcttctagacatatatgcttggaccttagaaaactcacatgtgtactccctcttctatgtccctcttccctcaaccagtaatactggcttttgtttttgtttttgtttttgttttttcagacagggtttctctgtgtagccttggttgtgctagaactcgttgtgctagaaccaggctggcctcaaactcatagagatcgatcctcctgcctctgtctcctgaacactggaatcaaaagcatgcaccaccaccagcagcttttttttttttttaaatacagggtagcatgtgtggcaggctggccttaaactcactgtatacctgaggatgatctgaaactcctgatccacctgtctccaactaacctagtgctggaattacagatgtgcaccaccatgcccagctcagcttcctacacaaaacaaaacaatgaatataattaaattcccaggcaaatgacctcgtccaggaaacacccaagtccctgctactgcctcagcaacaattcccagtaccagagtcctaaaggtacctgagatacctgtgactgctctaaggggactgggattagaaggtgggaacgagacaggacttaaagaggagagaccagggattgcagctgaggtggggccggtacaaacagagtccagtgtgaaccagtgtgggtcacctatgagggttcacccctatcatcccagcattcaggaagctgaggaggaggatcaagaaattgtgccagagcctggtgatggtggcacgtgcctttaattccagcacctgggaggcagaggcgggcgaatctctgagtttgaggccagcctgtgctgtagaataaactttttgtacactgtgactaggtgtcactcagattgacttaataaaaagctgaacagccagccgggcttttccccagcactcgggacgcagaggcaggcggatctctgtgagttcaaggccagcctggtctacagagctagtgccaggacaacctccaaagctacacagaaaccccgtctcaaaaaaaaaaaaaaacaaaaacaaaaacaaaaagctaaacagccaatagctaggcaagattttcagggcagagagaatgctggcaagaagggcagagaagccagacagatgagggatgagtcggacacacaaaatgggatagagttaaaagccacgtaggttaatttaatttataagagctagctaaaaacaagcctaagctattggctgagcattcataattaataagaagtctctgtgtctacaaagatgacaccagctaacaatctaagcaacaaaggagaggctaccttaaatgccctcccctgataatgagattgatgactgacttatatgctacctgatagttctcatccagcagctggtggaagtagaagcagacagccacaactaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaagcagccacccacaactaatcactgagctaaactggaatccagttacagagaagtacgagagatgagctaagtcatccagaccaggcgggtgaaacccacagaaacagctgacctgaacaaaggggagctcttggtccccagactgataactgtgataccagcatgggactgatccagaccccaggaacatgggtttcattgagaaaacctcggaaatctacaggacctcctgtagtaatccagtacttatccctagcataggtatggactttgggagcccattccacggtaggggtcgggggtggggggtgggggtgggggggaggtgagggggggggggggggggggggggtcatgtaaaacaatcttgtttctaattcaaattttaaaaatgtaaaaaaacaaaaaaagtctctgtgtcaatatacactgaactgaactctggaacttagttgcagagagggaggaacgaagatcaaaggggttggtaccagggtggtgaaacccacagaaacagctgacctgaacaagggcctgggaggtcagtacaggactgatgcagacccctgaacatggatgtcaattaggaggcctcctcactctggagggcccctggtagtggattagttttttttttccctggtataagaagggatgttgagagcccatcccatgtgaagggatgcactctcggcctggacatatgggggagagcctaggcccagcccaggatgatgtggtagactttggggagcccctgttgagggccctaccctgcctgggaagtggagggtggatggggtggagggtaagttggggggaggggagagggaagggtgagggagaagggattgacatgtgaagcaagcttgtttctaatttgaactaataaaaaaaatttttaaaaagaagtctctgtgtcatgatttggaagctggctggtgggacagagaaagactggctacaaacctgatgtacagaacaggttccaggacagccagggctacacagaggaactctgtctcaaaaaaacaaacaaagaaaaacaaagaatttgagccagcctgagctgcatagccagaccctgtctcaaaaaagaagaaaggaaaaaaagaaaagaaaccagtgagttggctcatcatctgggtaatggcactggtggccaagcctgacaatctgagttggatccacccatgtggtggaaggagaaaacagtctcccacaagatgtcttctgacctccacatgtccgctactacagcaagtgcacacaaaccataaataaatgtgtccccatttgcttctctcttgccgtaataaaacattccagccaaaaacaactttggaaggagagagtgatttagcctatgtgttctcatcacagtctatcactaagcgaagccagggagagagctgaacaggagcagaggcagggacacccaggaaagcttcttattggcttgcttcccacggcttgctcaacccattctcacacaaggggcagggccctcctacagctgttgcatctaggtaatgcctccacatacttgcttacagaacaaagggatctccttaattgaggttctctcttgcgtcaaattgacaaaaataataataataataataataataataataataatcagatattgtggctggtcaagggcaatgagttacctcaatagcagcactaagtccattagagacagggctggctccctgctcacctcttactagcacttgactgatcctttcaaagcagatacacctggatgttttatcataccaagcagcaacacagtgtttgtaacaccgggataatgtcacgatactctagtgtggctctacttctactctaatttacaggtaaatttccccctcccccccccacccaacactccactccccctctcccacacccaccccaccccccaaggctcatgcataaccagctagaactcacagattttaagacttgagtaaaaagaaaccacgtacattcatatccctctaaggatgaatttggagtaacctatcacaaaccaaaataaataattttaaaaatcaaattcaagatatatgttagaaatcataacagaatttggtgtcacatacacactgtggtaattattaaacaggaaagataacacggtatagcccaataattgagtgttataaagtttcccttctgacttaaaaagtggaatgagggctagagacatggctcagaaattagaagcactggctgctcttctagaggtcctgagttcaattcccagcaaccacatggtggctcacaaccatctgtaatgagatctggcgtcctcttctggcatgcagaagtacatgcaggcagaacactgtattcataataaacaaataaatctttaaaaaaaaatagtggacaagtgtggacaagacggctcagtggctaaagttgttgtcgcctgtcctaacaacctaagcttgatccctggagctctcactatagaagtgagaattgattcctgcaagttgtcctctggcctccccgtgtatgccatgaacaaaaattaaacaaacaaacatgatgtttagggggcaaggtttctctgtgtaatagttctaactgtccaggaactcacttagtagaccaggctggctttgaactcacagagatccacctgcatctgcctcttgaatgcttggattaaatttgtgtgccaccacccagcaattttaagggttttttttcctaagattttatttatttattatgtatacaacattctgcttccatgtatatctgcacaccagaagagggcaccagatctcataacggatggttgtgagccacccagtggttgctgggaattgaactcaggacctctgaaagagcagtcagtgctcttaacctctgagccatctctccagtccccaattttaagttttttaataaactatttttaaacagcatgaggggggaatccagatatcataagagaggaagtggtgagacagaaaagcaaaggtcactcaggaaatgaatagcaatacaggtttatataatattgtcaagaagggctagagagatggctcatgattaagggcactgactgctcttccagaggaccctagttcaattcccagcacccacatgacagctcacaactgtctgtaactgcatgatccaacaggctcactcagacatatatgcaggcaaaacaccaataaaattaaattaaattatttttcctgttttatttaaattagaaacaagcttcatttacatgtcaatcacagttccctcaccctcccctcttcccctgcccctcaccaacaccctatcccaccccctttctgctccccagggagggtgaggccttccatggaggatcttcaaagtctgtcataaccatttggagcagggcctagaccctcccccgtgtgtctaggctgagagagtaccctctatgtggagtgggatcccaaagtccatttatgtactaggaataaatactgatgcacttccagaggccccatagattaaccagacctccaaactgacatcctcattcagagggtctggaacagtcctatgctggtttcccagctatcagtctggggtccatgagcaaccccttgttcaggtcagctgtttctgtgagtttctccagcctggtcttgacccctttactcatcactcctccctctctgcaactgggttccagggttcagctcagtgtttagctgtaggtgtctgcttctgcttccatcagctactggatgaaggctctaggatggcatataaggtagtcatcaatctcatcatcagagaaaggcttttatggtagcctctcgactattgcttagattgttagttggagtcaaccttgtagatctttggacatttccctagtgccagaattctctttaaacctatagtggttccctctatgatggtatctcttttcttgctctcctctattcttcccctgactggattttcctgttccctcatgtcttcctctcccctccccttctccccttctctttcttctaactccctctcacctccccacatgttcccaattagctcaggaaatcttgtccctttccccttctctgggggccaaaggctccctctcttagggtcccctcnnnnnnnnnngctgtaggcctggttcagttcattaattgagcaagagatcagggtccccagctgtctcaggacagacccaaagtgcataccattttttttatttgagttacaaacacgattgaattacatgacaatcccatctccaggggccaaggtttgctgtttttaggttcctccttgtttactagtttctctggcactgtgtattgtaggctggtaatcccttactctatgtttaaaatccacatatgagtgagtacatatcatgtttgtctttttgtgattgggttacctcactcagaatgtttcttcgagttccatccatgttcctgaaaatttcaagattccattgttttttgctgctgagtagtactccattgtgtaaatgtaccacattttctctatccactcttcagttgaggggcatctaggttgcttccaggttctggctatgacaaatagtgctgctatgaacatagttgatcagatgtccttgttgtatgagtgtgcatcctttggatatatgcctaagagtggaattgctaggtcttgaggtagactgagttccattttcctgatgaaccgccatactgatttccaaagtgactgtacaagtttgcactcccaccagcagtggaggagtggtcccctttctccacatcctctccagcataatctgtcattggtgggtttgattttagccattctgacaggagtaagatggactctcagagttgttttgatttgcatttccctgatggctaacaatgttgagcactttaagtgtcttccagccattttagattcctctattgagaattctctatttaggtctgcaccccactttttaattcgattagttggtgtttgggggactactgagatagacaattaataaacgtgacctcctgaaactgagaagcttttgtaaggacacagtcagcaagacaaaacagcagcccacagaatgggaaaagatattcaccaaccccacatctgacagaggtctggtttccaaaatatacaaaataaattagttttaagaaaagactgttgggccttacaaatgcctcatgttctctggcagaaagccctgctttacacaatatccttttgtataaaagggacctagtgttcagccatgttgatctcagccatcttcagtttctgttttgtttgtatcctatgatttcaaacacagagctgcatggtcaaagagattgattgcatgtccccaaaattcatattggcatgttgcatgccttacctccaccatggctgtattcatgtaggactagaaactctgtaaaacctagctacacagagagagggacagagaaagagagacttctagaagacattgcatggaaagaccatccagaaacacaaccacatggaagcatgatcttatctgttagactctagattacaaaattactttttgcttcttaaccctcccaggctgtggcattctgttatggtagaggtcaaggagatgttgtttgtcaatgaaacaaagacagcatcatttgcaacacatcccattattttataaatcacagagcactgaaattaaataatgtgccattaaggactgcggacatagttcatttgatggagtgcttgcctatcatgcacaaagttgagttccatccttggcatgacataagctaggcatggtggctcgggcctataatctcagcactcaaggaagtagacacgggaggatcagaaatccagggtcatactcagctacagagtaagttcaagggtagtataggtcacatgagactctcaaaaaagaaagtcactaactagtcagagatctttaaacatggaaaatgtgcatcatacaatagatgaaataaagagctagagagataacttagccattaagtgctgcccttgcagaagacctggatttgattcctaacacccacatgatggctctcaaccatctataacttcagttctagggcatctgcatgcatgtggtgtacagatacacactcgggcaaaacactcatataaataaagtaaatcttttttaaaaaatgactgaaaaagaattgaatgatgaaatgttaaatgtccttggaagtatagtcttcagaccagggaaataggtttaggtggtccctagctaggagcaaagcctctgtagatcaggctggcctcaaactctcagagatccacctgtctctagctcctgagtggtgggattaaaggcatgcacctggctaagaaaaaaagaaatttaaacaaaaccctacttgtaattttatccccaagttgggcctgaaagcgctcatgtgtagtcccaacactttaagtgatctgggttcaaggaaaacctgagctacacagtgagtcccaccctaaactagacaatacagaaagattccattaaaaaagaagagaaggaggaggagaaagaaagaagaaaaatgggaaggaggaggaagaggaggaggagaaggagaaggaggaggagaaggagaagtaggaggaggacgaggagaaagaagaagaagaagaagaggaggaggatgaggaggaggaggaggaggaggaggaggaagccatcgctgccaccaccagtcctgcttggttataggaagtgagtgaaggcagaagcaaaagaatcaggagtctaagcctcagctacagagtgagctcaagacgactagcctgggctttgtagtaagaccctgtctcaaaaacacaaaaaaaaaaagaaaaagagggaagggagggaaggaggaaggaaggaaggaaggaaggaaggaaggaagtcacaaacttgcccacaggacaatctaatggaggcaattcctcaactgaggttccttcttcccaggcaactctaaatttgtatcaagctgacaaaactaaccatgccagtgtccctaaataccccacccccaccccattcagctaagcagtctctccaaagtctttggccccaccgaaaagtatggcagaggactcctctcatgctgttagtgcctccaggtgatggggaaaagctgggcatgttgtctcaggcctttaatcccagcactcaggaagcagagagttagaggccagcctggtctacagagtgagtttcaagacagccagagctatatagtaagaccatgtctcagaaaacaagagaaagagagagagagagagagagagagagagagagagagagagaagagagttgcaagtttgaaaatgtcataatgaaatccattcttctgtgaacttggtttaataaattaataataaaataattttatcttttaaataataaaacagcccttctcaaacattttagaaagataaacaatgtatcagtgttatagggctggagagatggctcagaggttaagagtactggctgctcttccagaggtcctgagttcaattcccagcaaccacatgctgactcacaaccatctgtaatgagatctggtgccttcttctggcctgcaggaacacatgcaggcagaatactgtatatttaagaaacaaataaatctgaaaaaaaacaatgtatcagtgttataaagccaatattagaccctgacacacaaatttaatgaacccctagtcctgtaagtgcataagtggagccagtttggaggaaaccccagtgtggaggccttcatcgcccagcattctgcacttctgtctccctggccggtgctggcttcctctccagactggagggacattttgactcattccacacttggagacactgagaaagaaacaactcttcagagccttactcaaagttagatccataacagctgggtctcaggagagagcacatggaaagaacagacatgaagatgcaacttcaaggccaggaggctcctggctctgccctctaagacgagatcattgcacatcagtcagcaactgcccacacaggtaacaggaaacatcagaacccaaaacatctctctgcttacctagactgaaaatgaaagtcagacattgtggctcacagctaaaattcctatatatgtagcctgggctacataggaagaccttgtatcaacaggaaacaggaagaagtgagggagggagagagagagagagagagagagagagagagagagaataaatatacagtgacataaggatagagatggctcagtggttaagagcattggttgctcttgcagaccacctaggtttggtacccagcatccacacatagcagctaacaactatctataactccagcctgagaggatcagaaaccctcttctggtctcctcacacctgggacacaagcacacatgtaggccaaaatacacacacataaataaaatttttctttcacttaaaaagtaattctttttcatataaaataaattcgggggctggagaaatcgctcatcagtactgttcttgcagaggacccaggttcagttcccaacacccatgtcaggtggcccacggctctctataactctaatgtacagtctgcttaccgtcttgctccagatctgacttcttctgggctcttcaggcatctgtactcatgtacacatacacacataatttaaaaagaaataaataaattcaggaataaactgaattaggattaggatagtgtttccaccaagttgtcaggggccagaactcagctcagccattctagtcagtagctcccatcctcaaggtctgaggtgggtaatgagcctggccattaccattgtatttatctcagaagaaacaggaaaaaggaagctggacattgttggcgcatgccttttatcccagcacttggaggcagaggcaggcggatctctgtaagtttgaggccagcctggtcttcagagtgagtgccaggataggctccnnnnnnnnnnngaaaccgtgtaaaaaaaaaaaaaaaaaaaaaaaaaaaaaaaaaaaaaaaaaaaaaacaggaaaaaggacacatccagagagatgcctatacttttatttacatctcagtggccaaaattagacacatatttatccccaaaagatataaagaatgtcttcttttagttgggtgacaacatgtctagccaatgagctggaagagaatgaaatgtgggcggcactaaactaaactatctcagccacaaatcctcacaccaaaacaccggaatagcagcaaagcaaactcctagtcagctgtgtgagtcatccacctgatgactcactcactcccacccgcagcttgtcagcgcaactgagtttcgaagcgtcatgcaacttacagattgctaaaatagtcacagctctaaatggtatgctcttgaatgcaaagagtctacttagcatttagcacactgtctaagtgtccaaattacatgtttcacaccaaaattactgtctctgtcaagcactaaaggtaaacgcacttagacatcaaccataacttcagaaagattatttctggctcgtagaagtgcagaacattcttcttcgtgttttttcattcttttctgtgggtgagattccttcaatgtgtacacagtggttctgtactcagagaaaacaatgattgcaggaggccagccttctaactgcatcattcacccattagtgaagggagtcagtcagccacaacccacaggaactgaagggagaggtgatgagatctaattgctgtctgtttatcttctgtctgtacttattgggacaaagcttcattctgtggtctgggctggctctacagcaatacttctgccttagactcacaagagctgggattacaggtatacatgagaactctgggcatagaaattgtttgcttgtttgttttccaaggagggtagagttttttttttttaattgttattgtttgggaggttgtagttattgttttgagacaggatatcatgtagtctatgttgacctgaacgtcagccatactccttcctcagctggggggggagggggtgtggaaataacagccagctgctgcaataacatttcaccctcgctctgctccatttccttcaggccacagtctttgggttaaataactctataaaaattacatcatgacctttttcaacatttccaaactatgctttgtagtttacacagaatccaagaataaatgtaacccacaaacagttttaagaatagccatcaagttccgatctgctgctgctgctgcaattctaagtgagtcagaggaagaagctcaacagctgagacagtgttaaggaaaatggaatgcttctcttcccagaaatcctgagaaggaactcccccctgcatatttgagctggtcatcttctggggaattctctgcagctgaaaataagcccagaagaccgggaactgctggtgttagaccctcagaaagctgaggctttcagaatcttagtccaggacggcggccaccccaaacacagaatggaggcgaaagcttgatacaaactgcatgaggctttattgtagttttacgagctaaccccatgttagctcgggtctttcacccacccgccatggcagatggctagaaaaacacggctccttgggtctcccaaaagatcttatagggcagcgtaaggggagtgtctaggggtacgcacaggctcacgattggtgtgcttccaggcttggagggcttgccctgtgttgattggtcaactggttgttatggcccataggccctcccagggcggttgctatgctctctacgtcattgctgtgtgcttgtccgtaaagcacacccagagccataaagcatagcgccaccagctaacttctgattggttccttgtcacgagacaggcatctgactttctagtgtctaggtcaaggtcatagaagcacatgttcgaccattatggctgccaaaagggaagccggttccttcactggcaccctgggtgctgatctctgctgcctccagcaccacccagccgtcccctggctcacccagggctcccagatggaggactggttcaagagaaatatcatgaggccctggcttccttttccagaggggatgtgttaatcaccccaccacaccacactgctttttctaccaaaaggatgtttactgaaaatcatttattcttgtttttttgtttgtttgtttttttggtttttttttccttttgctgctcctaacctatagccaaaaggctgacaaccaatttaaacataccagtcttactgaggaagtactcaaagacacatgtataaaaagtatagccagggggctggagaagtggctcaggggttaagagcacttgactgttcttccagaggttctgagttcaattcccagcaaccacatggtggctcacaaccatctgtaatatgatctggtgcccttttctggcatgcactgtatacatgataaataaatctttaaaataaaaaagtatagccaggtggggtgatgcacacctttaatgtcagcactcaagaggcagaggcaggtggatctctgtgaatacaaggccagcctggtctacagagtgagttccaggatagtaagggatgttacacagagaagccctgtcttaggggagaaagaaaagtaataataggggctggaaagatagcccagtggttaaaagcacacactgttcctctagaggacccaaatttggtggccagcacccacaatgtgtacctcacaactgcccataactccagctccacgggatccaggacctctgacctccatgagcacttgtattcatagttaaaataaatgactaaatctttaaaataaaataatagtaaattcacacacaaatcctggcttggttttgtttcctgcagccttacagataaaaatatgcttcgatgagacagaaggcacggttactttttgcagaaaaaataaagacatcactaataatcaagtatgcactaggctctaatccaaacccagccttcaagtatgtatgtgccatccacttgcaacttttcaccttgcatacctactgatgcaaggtgaaactgataccctacaaacattaatcactagccatccccattccccttccctaagctctggaaactaccattctagtccactctgcctctgcccaccctaggaagctctttattgagtgggaccatgtacagtctgtactttccggatggttaatttccaagattcatccatggtgtaacatatgttggaattcctttcatctttagtaaaattccttagtatgtatacatcacagttgtttatccattcacccattgatctaactgcatgtagtttccttacatttatttggtgtgtgaatgcctgtaggaaagagaattttcagtagtcctgtctttcctctgtgtggatcttagtgtgaaactgaggtccccaaacttgccatgggtatctttacagctgagctgtctctccagccctgtacatattttcttttaatttaaaataaatgtgtatcgctgggtatggtgacacatacccttaatcctaacactgagaagacagagacaagcaaatatctgtgggttcaaggccagcctggcttacatattttgtgggatatgctgtagtggtctcttgccagtagagtctatgtgaggtcagattaacatggcattgtaaagggacagtcatttaactgtgaacttgtgaggagcaccctataacagacacacttccctttgtgtcttttctattctggaattgtttaatcagttcataactgtgtggtgagagctatcatttcctttaatttttcaactgctctttgcatcttccatgttctaggcagtgtactcatgaaagaacaagcttgggttatttcccatctcagagggaacaaagccacagattcagctgcaccgcagggcctctgtgtgacagaggaatgagggaagtgctagttaaacccattaaaggaagggtgcctgtacaagtgggtcaagggacaccctccccaggtgatcacatttaatccatgcactgaaaatcctagcactctggaggcagaggtaggagcatctcagagtttaaggccagcctgatctacagagagtgttccaggacagccagggctatacagagaaatcctgtctcaaaaacaaaacaacaacaaagaaatattaaaaagttcaaaagtcatcctcagatacatattgaatttgaggccagcctgggttatatacaaccctgtctccatcaagctagcagtaccatctgcactttgagggtgggaggatacagggtcaccatacgtagccctggctgtcctggaactctctatgtagaccaggctggcctcaaactcacagagatccacctgtctctgcctccccagtactgggattaaaggtgtgcaccactatgtccagcaccatctgcattctataaaggctaaccctctctaaaccaactgtgtgcagggtggattagaatgagaacagaagaaaaagacagggaagaatgggaagatccctacagttcagtgagtctttgtcctgaggaatggcttccttctgtccacagaaacgatgacccaaaatctggttgaattcagttaagaaaaacatctacatttctgcactttggcacattcaagctagcaggtgtgtgtgtgtgagagagagagagagagagagagagagacagacagacagacagacagacagacagacagacagagacagaaactgcttcggttttggggagacagtttcactatgtagtcctcaagctctttattctttcacctacacacacacacacacacacacacacacacacacacacaccttaagacactgtttttgaaatgtctgccttactgtttttgaaaggtctgccccctgacctgttctagtaatttagttctgtcatcctaaagaactactaatctgtttcctgtctctatggatttgcagatttgagacatttcacataaatagaattgtgtaatatgtgactttcgtgtctaacttcttccacctagcataatgttttcaaggctcattcatattataacgcatatcagtttttgtggccagcttaataatgtcctgttgtaaggacaaagcccattttccattcactaactgacagacatttgaactctttctatttttgagctattatgaataacacttctgtgaatgtccagtatacatttttttatgtggatatgttttgtttctagtgaatagaattcagcaattcatatatatacaaccaaaggagcttccaccctaagttaactcggcttctcttgtggctttgaatgccaaagagaaagcagctgatgtgccaaagccatcttcccaagaaaacaggtttggtcacagagaaagcagcagcactccgcagtgagggtgacctcatgccgcccacaattgcacacaaaaggaagcaaatgtcagtccaccctccctcctgtctctaaggaagggaattggacccaaaccctcttcccctgtgaaggagacaaagttttgctttaaggccgagtttcaagtagcccatgctataatgcaggactccaaataaagccaagggtgaccttgaacttctgatctccctgtttgccttgccaagtgctgagctttaaccccaggtttttgtgcatgctaagcaaggactttaacaactgagccacatcctcagctccccaaaagacaaggacttttcaaggaggaaactcagaatctcagaactggcaactcagagtttgacaagtgtatgtagagttcgaactgtgtacagagtggttctgtgtacagagcttatgagaaaacactgagcaacggcaatcagaaaggaaggactcaccttccagccaaaggtcaatatgacactttcgtaaagaaagcaaacaaaacttaatgcagccagtgctgaagtaagaaagagttatgaataacctggcccatgtatctgcagatcccaggacacctcctcctccagcagccaatgtagtaaggccaaagtcacatacagtactaaaagctccaggctggacagaaccaactgacctctggtcgatagtaaatgctgtcaatgtacttgacagtgcagggagtgagatttatatctcaatattgttctagcagtatttcaccagctctgccagccctgtgtgattagaaatagatcctactaggtgtcacagctcactcccagaatccttagatgtatgggaaatggggaaatggagtgtcgagggagcagacgtacctagagaggggtgttgtgaagcttgagctaggagagagactaatgttacagtgttatagaacaaaaaactctgaggttcacaagacaatggcctgtctcccttaatggaagcttgtaacctacaaaaaagcctaagcagcaacaaggaccttaacattaaaagctgaccaacaatattctggagaaatcattcaaagtactattttaggactacgatgtggatcaggagagtgcttgcttgcctagcatgatcaaagccctgggtccattcccagcataaataaaccagggtggtggtgcatacatgtaaacccagctctcgagaggtagaagcaggggatcagaagtccaaggtcaccctcacctatggagaagtctgaggccaatcttggcttcttaaggccctgtctcaaaaaagaaaaaggaagaaaaagcaaagaagaaagaagggcagggcaggagggaagggagggagggagggaaatgctatttttaaaaaagtatttcttaggaatggacgcagatgtggagtttcatttccgtgtatgaaacaaatgaaatgttctgtctttaccttggagaaggtctgaggcaataactgtgctgaccccagaccctggtcactttcaagagtgtcagtctcatccacagctgactgcctgagtggctttgggctaccacttgaggagaatttcaaattctctgttgctttgttttgatctttcctcctttggagaaaactgaacctagggccttgtacaagctaagcaacactgcaacacagagcttcacttgaagcccaagccagtcaacattggttgtctggtttctgatatgctcagcagaagacctggacatcaggcatctatctatagagcaggtatctagatacggctctagtgccttcatagaaacttggagatttctgtttagtcccaagtctgctcagctgtggtcctcagaccaagcaaccctcaggcaccctcagccacagggatagtaagttacatccctgctctgtagttccctgacatgggcatcattatacttgtggataggctccataccacctcttcattctgagccctataatgtgaccatctagatatctccagtaggccctttctttagccaggtgatgtccctgtctcctgtccagtttcactttacctcttggctagctgcccggactttggctgaggttactgtagtgcctctccaggcactagaaatccaaaggtacagaagtccactgggcaactggcctctgaccttgtacttctgggtctcagttacatcacttgaatttctttgccttccatcctttctccagcccaggaccaagcattctgaagagaggggaagtgttggggctctccaggggaaccaaccaaaaggagacataggagaatctccaaagagaattgctaggagacatcagctctcacaattgtggagagtaagacatcgcacagtctgctgcctccaagctggaggcccaggacgtcagctctgtagcttcaatccaaacttagggaggagagtgaaaaggaggagaagggagttggggggggagaaagtaatgccttacaggggcatctagaatgcaaatacaaattcccttttcaaccgtcctcagaactcacagaagtgaggctcaccacatcctgtatcaggagagagcatggtttccagctcacagtggattctaccagacaattttctgcatacatgaacatgcagaagtggtttttgtttggttttggttttggtttttttgagacagggtttctctgtgtaacgatggctgtcctggaactcactctgtagaacaggctggcctccaagtcagagatccccctgcttctggcccactccctgtcccaccttccacacccctaccccaccccacccccacacctgctggggcaaaggcatgtgccaccatggcccagctgtataagtgttttgaatgctgtttgttctattttattttatttattgggtatgtgtatgtggatatgagagtgccagggagcaggtatggcagtcaaaggacaacttgtgaaagtcagttctctccttcctctacatgggatctgagaattgaactcaggtcatcaagctccagagcaagtgcctttccttgctgagccatctcaccagtccctgttttgtatgttttatctcacatattagattacataaaacactgttctttaagttggcttgatgttaaatcagaagcccgtacaccggggctccaggcacagtcctgttctcttcagcaatcacagtgttaatcactgttccattgattcaactttgtttcaggcttctttctgtctttgcaagcatgctgcaatgagtagtgttggggctctccaggggaaccaaccaaaaggagacataggagaatctccaaagagaattgctaggagacatcagctctcacaattgtggagagtaagacatcgcacagtctgctgcctccaagctggaggcccaggacgtcagctctgtagcttcaatccaaacttagggaggagagtgaaaaggaggagaagggagttggggtttctctgtgtaacgagaaattgaatggatagatgtacattctggtgggtcattctatttgccattttttaaaagacagagagtggagggggggtgttgagtcaaggtctcactatacagtcataatcccttggctagcccatcacttccagcttgctttctgaaactttctgaaaccaagacactgcctaaaagattgcaaccatgaacactcctaacactgaaggcaacaataggttttcttctttttcatttgggggaaattgggaatgaaacagcatattgctgcatttatttttcatttccctgttgtgagggaatctccagggtcttacctttttattcataagcagggagaatccagacccaggcaacctcaggcaccaaacgcatggtgtcaaatgtattcatagcaactggatttgtatgtggaaatatgggattctctatgcatcttccatgcttattatcatgtgtaagccaccgatgaagatagcattatataatgatgagaactgggagccttgagttagtgtctcaccatgtaagtccagaaggtcatctaaattacctttgcttgcttgctagtgacgtaagagttgttttgaaatacccccagtgacctttcaatctgagcttagttcttgctcttacacttcagttccacatcagtttttttcttttttgctgtgtcaaatagtattaaccagtgcacttccatgtaaagtgatgaagtttacgctgttcactaaaaactcatcctagtcgtttgtattgacacgtaatttttatttcacatttaattttttcaggcacaattacttggtccactttcaactagcataattcaaaaaagaaaggtttagtaaagattttttagtaaactaactggaatataaatgaatagtaatttttaaatggtattggaaaatatgaaaaagaaaattaccttttttcttaagtagtatctacccatgtggtgggcttgtctgcactatctttctttctgtgtgagccttacaggtgtgtgcaccataccatctacaaaaattacattctttaaatacattttataaactttattatataaaaaagccctgcaaaaaaaaaagaaagaaagaaaagaaaaaagaaaagggatgggcattggtggagcatgcctttaatcccagcactcaggaggcagaggcaagcagatctctctgagttcgaagccagcctggtctccagagagagtgccaggacaggctccaaagctacacagagaaaccctgtctcggaagaaaaaaaaaagccctgcaataaaaaaaagttataccactgagcagtggcgcacacctttattcccagcacttgggaggcagaggcaggtggatctctgtgagttcgagaccaacctgatctataagaactaggtccaggacagcctccaaagccacagagaaaccctgtcctgtctagaaaaaaaaaaacaaaaaaaaaaagaaggaaggaaagaaggaaagaaagaaaaagaaaagaagaaaagagaaaagagaaaattcagataagtgaatgagttgttcaaagatttcaaagaaattatactcaaagactataagaataattttttttttccctttgtgttcgtgttttttgagacatagtctcactatgtagctggcctcaaactcacagagatccacttgcctctaccttctgagcactgggattaaaagtttgtgccaccaaggcccagccaagaatagatttcttagcaaagtgtggtggtatgaaaatgtaatcacggcatttaggacgatgaaacaggaggatggtgagtttgagactagtttgggctattgtaataagacttgattttttgttgttgttgagttttttgggttttttttttcaatattgggtgttttgttttgttttgttttttttctctgtgtagtcctggctgtcctggaactcactctgtagactaagctgacttcgaactcaagagaccacatgcctctgcctcacaagtactgagattaaaggcatgtgccacaaccaccctgttgtctaaaaatatttttttaatttaaattatatagatattacgtatttgttgtaagaatttttaatttgaaaaaatttcattgtttgtgtatggatgtatgtgtctgtgcaccgaaaagggcatcacccctgaaagtggagttacaggtggctgtgagccgttatgtgggcgctggacatccaccctgggtcctcttgcaagagcagccagtgctctaaccactggcccatctttctagcccctatttgagatttttaagcttgggggaataagagcctatgttgttccaagccccactatctagtaagtaaggcagaaagtgttgcagaagtggaaacacaacaacgctcctcccttagctgcctaacagggcagaggctctagccttgctgctgatgcccatgtttccaagggcacagtattagcctgagaagcctgactcagcagtatgctgatgccatacatcagttaccacacaaccttcaatgaagtaagccagtccttcccagtttccctagagactcggcagctatttctgaccaccaaacactgttgcttatcacagcacagcttcacaattgatcagttagcagtcaagcccagggtttttaatgaaaaagtaacctaaatgcagaactagtggataagtcattgcatctattactgatagacctccatattgaatggggaagaataattctttctccagcaaacactaactgcaaacaatatcctaacgtgtaacttagctttagtggctttagtgttagggcttttgcttggttttgtatcttttttgttttaaacagggtctcatgtagcccacaatagcctcaagttcattaggtagctgaaacttctgattctcctgcttccacctctgagtgctgggatgacaggtgtgtcctaccatgccccagtttatgcagtgttgggatggaatccagtgcctactgcataagtgggaagctctacaactgagctacaaaatcccaaatccagggttttcatcgttagctggttggtttggttagtggcactgaggattgaaccaggcctcacacatgctagcaaagtactctaccactgcacttcatctccagataatgaattttttactttgaaacagaatcttactgtgttgcccaggctagcactggtctcattttgtagcctgtgaaggccttgaatttatactcttcctgcctcagcctcctgagtagctgggattacctatctcacatttatgccagacctagattttgtttttaaaagattcctttcaactttcatattctcccaggtcaatgactatagccagcaaatcataaaactcctttctaggattcaaaaacccaatcagattttggtttaaaagccaaaatctggagtagcagcccattcttgtaatcccaccattccagaagcagaggcaggagaatcaagagttaaagtacagccaagaatacacgccaagtgtgagtccaacctggcttacatgagacctgtctcaaagcaaaaaagcaaaagccaaactatcaatatggaactcttgcacagtagattaaatcagtaatcagtgtacacaggaagctgagacaggggaatcacaagtctgaagtcaatctgggctatcaagcaagtacctttctcaaaaaaatcaaattacaaagtttagtagaagaagcttgctgatcactgagcatagtggcaggtagcatctacctgtgatcccagcactcaggaagggggctgaggcagcaatgtcaagtgcttaaagccgtcctggccacaaagtcagaatgtgtcagattaaatgacaatggaccatagtgcagatccagtttgtgcctggattggcctgtttgtggacagcacaacctacacagcctcaaatggcagtctacaggtggatttctacttcctggtacaatggagatggcagtatactccatgttacaccaattgaccaaaacaccatacaaggaaaaggagtgaaccaacctgccatctctaaaccatatttgacactcctgatatttctagggaaatcagacatcatcccaaaagggaaagttgaaactggagatttcctgatccccacagtttgtcctaagtgagaccacttgaaaggtaaatgaaaggaccacccaatgggctgttgagattttggtcagcagagccttgtgcacactcatctaggtgcatttagcaaataggagctggaatccgacaccctggggaagtttgggctgtgtgtcgccagctttagggaaagcactctctctgggggcatgttatctatagtgctcacagcaactcaggcagccagcgtgaacacttcctgtgtagaaaggtcagccaggagtgctggttagagctgcacaagatcttatcgccgccgttcatggttatttccccatcatccctccctagaggtacagcttcactagagcctggactgtgtgaggaatgtaattcgcaagatttatggaaaacgatttttcaggaatgtgctctcaatttttattgggcaaattcctctttccctggtaagtgccggagcatatgggacaggtaaatgtcttaatggacagcataaaagtaacattttttttcctgcccaagtggatgactcacacagagggcttctaatcccatttttcactggagcaaatgttcagtgcaaaggaaagagggggaactcccacccttcaacctggctgtctgcactgctcagtaatggctggatcatttcgcagattcaagccactgcttctggcacatccatccttggggaaacaaacttttattgaatttctctcctccaggtgttagcctccttcctgtctcttatatacatcggacttgtgcctttctaagatctaatacaataagatgaaaatagccaaaggcggtctctcccggttccgaaaggaaagattaatggcagaaacaaacagtaatgaaaagtcacaggagagaacagtgcaggtaaacatcgcacaaacgaacacgcatgggatcacttgctcctcagaattggaatgattacatccattattaattttggcttctatgacacaacagagctaaataaccaccttggaattggtcagtgatcagcttgaagttagaatgaaggcaatgcaatccattcaaccatatccacttactaagcagctacggtgttttactcaaaccatgcttgcctccatcggacagggtgttatgtagctcaggctgacctcaaactcaccatgtcactgaaaataaccttgaactcctgatcctctgtctctacctcccaagttcatatgccagcactcccagccactcacccattcttaaacatctttgggtaaacagtatcatctcttgacacttagcgatgcataagagtggaggaaatggtagattttgccctcctttgagtgttcatcctgctgctgactaaatgaatgacagcatgtgttcaatagaataattcagcctcacatgatagacaaaatgaacactactctaaggcccatgctgagcatcaacaggaaagactggacattttgtgagcagctataaagttaaaataacacttccctctgtccttcccttcccccaccccacctctctctctctctctctctctctctctctctctctcttttctaaacagggtttttctgtatagcctttgctgtccaggaacttgttttgcagagcaggctgacctcaaattcacagagatccacctgcctctgcctctcatttgagacagggtctcatgtagcttaggctagcctcaaacttagtatacagcaaaggatgactttgagctcttgatcctgctgccaccatctcccaagtgctctggttgcaggcatgtgccacatttagtttcatgcaatgctagggatagaacccaagtcatcaagtacactgtgccagtattctgccagcagagctacacccacaacccaatgtctgtcttcaccagagaaacaataagctgcccttaggaccagctagatggctcagcagaaaagagcatttactgctaagcctaaaaacttgtgctcaatcccaggatccgctggaaggagaaaactaactaaccacccactgcaactagttgctctctgactgccacataagcactgtgacatgcacgcgcgcgcgcacacacacacacacaaacacacacacacacacacacacacactaattaaaaagaaatttaacttctagctgctcataatgatggcgtgatggcaatcaccagcaaccgtagtactctgaaggctgaggctcaaaaatcccaaatccaaggcctgcctgggctacacagtgaattcaaagtcagtctacagtaagactctgcctcaaacaaacaaacaaaacaaaacaagagagctgggggggaggggcgtggtggtgcacatctttgatcccatcacttgggaggcagaaatagatctctatgagttcaaggccaacctgttccacgtagtgagctccagaacagccaaggctacctagtgagatcctattttaaaaaacaagaggggtgctcgcttcagcagcacatatactaaaatcggaacgatacagagaagattagcatggcccctgctcaaagatgacaaatgcaaattcatgaagcattccatgttttttttaaagattttatttatttattatgtatacaacattctgcttccatgtatatctgcacaccagaagagggcaccagatctcataacggatagttgtgagccaccatgtggttgctgggaagtgaactcaggacctctgagttaagcacctcagtgctcttaacctctgagccatctctccagcccgcattccatatttttaaggcctcaccctcctgaggagcagaaaggggatgggataggagtagggggcagggaaggaggggagggagagggaactggggttgacatgtaaaacaagcttgtttctaatttaaattttaaaaaaagaaataaatgttagcaaggaaatgggaaaaaaagaggagccaggtagtggtatctcactggagaggcagagacaggcagatctccatgaatctgaggacaacttggactattacacagagaaaccctgtctcaaaaaacaaaacaaacaaaaaaaaaaaaacaacaacaacaacaacaacaaaagagggttgggaacatagctcagttgttgagaccttgcccagcatgaatgtggtcctaaattaagtacccagtggtggcacacatctaaatcctagcacttgaggagtgaaggccagacaatgaggagttcaaagccaacctcaacctcagcttcatagtgggctcaatgctagcctaggctacataggaccaggtctcaaaaaaaaaaaaaaaaaaaatgcccacattataataacccaaaagtaaaattggaatcagggtgctaacatccttcaactctacctcagctacggctgtgtgtctttcaaaagcaattcacaatatcccatctcctcaaggaagggcagtacaagcctgctgtgtacaaagacaaggccctctgcttcaccaaggaggcctcatctcgtgcctgtgcctgttcttgtaactgtgtggagctgagaccttaaaggaccttcaccctccttcagggtgtgaaaccctgtgacaaatctcactccaacagttctcatcagtccctgttcctaacactcaagaacagaatattggctgagtgtgatggtacatacatccctttagttccaggaggaagatctctatgagttcaagactagcctggtcaacacaccaagttccaggacagctaaggatgcatagagagactatatctctaaaaaacacaaagaacaaacaaaacaagaatggaatctttagaattggggagaaaaaaaataaacaaaaaccactcttttgtttgtttgttttggttttcaggacagtttacctgtgtagctttggctgtcctggaattcacttagagatatatcagcctactgtgagagccaaagttacatttttaagttttaattactatgcctaagacatccatgaaacaaaaatgcctctgatctgcaagccccttgcccaagcatagatagttcctgaaatacgggaggctattgtttatgggggataacaaccacaggtatcactcccttaaacaagtttgtttggcttaactgtaccagatgtgcttgatcacataggggtggcagtaggcaggaaatatgtcaagatggatactcgccccttgattgggcatgatgggaaatgcaatgaattatgggttttccttcttaaacccttgccatacttgattctgggccatttcccaggaacctgggtatgaacaaggccatctacctgggcaatatttaaataaaacttgcttcaaatttgactttaaactatgacagtagtcttattctcaactggtggaattagcattgcctctgcctcctgagtgctgaggttaaaggtgagtaccaccacagcccggcaaaatcatctttttcttgatcctgatattatttgatcttgaagcaaagacttagatcaagtttatgctttggcccctttcaccttgggatgggttacttgccagaagccttcctgaggactgttgcattttgaatcttgaatgtatccccagagaaccatgttgtaaagtcttggtctccagcctttggggttataggaagtggtgagacctttggaaggtaggacttagtggaagtttaagtcactgtgggagagttcctaggcaagtgctctaccactgagctacactcccaaccttatttttaagagtaattgttaagtaagacccaggtcccttcatatctctctacaattcctggttgtcatgagattaaatgcctccacacacacacacacacacacacacacacacacacacacacacctgccactttgtgcccaaagcaacaaggctcaggagagcacctgcctagcatgcatgaggccttaagtatgattcctagggagagagggggtggggtgggttctggcatagctatgagcagtctctgaagactctacctgagaatatttcaacccttgaatgtgctagcagtcatcaccaatgtacccacgtgattcccagaacagaaagcacagatggaatgtatcagtatagaatccatcaaccagtttgtatattggttctgacaaccatcaaatttaagtttccctgtccatttacttgcacaatctctatcacttagcaatgttatgaaaattaatccaaagtcggtcagccagcacaatattgcagctgtgacagatgttcagtagatatgaactcccttcttatcatttttttcacctgcacatagatggcagacacatgcaaacacataagtaaaaataaattttctttcaaaagaaaagctatgctgcatccttaaagctatgaattattaaaccccaagccagcagtgagataactgagttggtgggtagcaagactttagaggcccaaaacacaacacaaactcgtatgacttggtcttggctgcccaccagaactagatgatgagacctgtgggtgcagttcagtgaggagggtaccagcctagcttaccagatgcccctgcttcaaatctaggatggcctagaatgaaacagtagaggcatataggtcttgaatgtaatccctaccactcaacagatggaagctgaaggatgaggacttcatcttcctgcctggccttggctggctaaagacccagctgtgagggttacattagatcctgcctcagaacaacagaagaaaaattagatcctagatgataagaccctattgttgacaggacacaccttactgtgctggaagcctcaaatttataatgccaaaaaacactacacagacttctggggaagaaagtgtatcagtggttttactcagttgtaagctttacaagctacaatactgtcatagcaggcaggatatatctacatactcaatagtagcatgattgttctggaatgaccaggctgctatagaacgttctatgaggttaggagggacttgcaaacaaacaaacaaaaaaagagcattaaaggagaagaggagtcaggagtcattgggagatgcagaggaaggaggagatgaatttgccatagtaagaaaaggtaccaagccatgtggcagagcatagataagaaatacgggttaatttaagttataagaactagttagtaacaagcctaagctagcagctgaacatttataattaataataagtctttgtgtggttatcggggagccagaggtcccaatgaaaacctgcacctacaccaacctctctccacagtactgtaaatccactcaaaagttcatggtgagggagctaatgggacctgggagaggggacttaattctggtatgtagctaaacagacacagtgttagacccacctcccaaatacatgtgtttatacccatagacaacactctcaactatagtcagagaagccttctctcttctctctctctctctctctctctctctctctctctctctaggaaactacagtgaaggcagaaatgcacaactgctgtgcatggatgagtgctcaaccataaacaaaacatttatatcatcccttccaagatttagggaacactgtgtaagaaggggatggaatgatagtaagaaccatcagacaggaaaaagaactaaaaaaggccatcttcttgacaatatacagccaatgcaaccatgagccctcaacaactacgggtgactacactgggtctgcactggaacaggctcatcaatagccaatcaggatgagagagaaacctagggagccccattcctcactgatgaactgtttcctacagatagagttagggaaagagggagtcattacctccaggtttgtacccactggtgagcccaccaggttccaaagcatacattcagtggtcacagagatggcagtgactaaaataaatagatcacaccaatagtcaccaatctaggagagacccaggtgaaagggataggagagtggtaggggttattcaatcacactgtgaccccagagtttgcatttgcattaattaactaaaattaaccttgggtcaggaggctgcattagcaactagttgacaggaagtaatcatagagcctcaaagggcatccaggaaagatggagacacaggaagtagtagggtggggtttgaagtggcacagctttttctggtttggcaaagcagaagcatgggtcttctgtggatgccagcaaggaggaaggcttagctagttgaaacctctctgagcttgaaggtttcaccccagccgctgaatctccagtcttattcataactagaatgatagaggtttagttaaagctacctttagcagctacaggtccagtgcctgcaggatcagaatacttgccaggctgcagcctgagtggccaggctgctgtttaagaagcaggctggtaactggagctgcaattcctggatgagatagcagtagattaaggtgcagtcactgtgctgaagttaaagtaagataagagagggtagcagagtaatccaaatgtataagcatgtatgaaactgtcaaacaacttaaattttttaaaaaggaatagagagagggccatcagtagtggtgggataatatacccaaagaatattataaaattgcatgcaaatgaccttatataaccatgtattttttttttttttttggcctggccatggtggcacacgcctttaatcccagcactctggaggaggggcaggaggatctctatgagttcaaggccagcctggtctacagagagagttccaggacaggctccaaagcctgtcttgaaaaataaaaaaaaagagagagagagagagagagagagagaaaggaaggaaggaaggaggaagcaaggaaggaaggaagaaagaaagtgtttaaaatatgtattttgctataaataccagctaaaaaattctcaatgctcctagatattttgttttgttttgggcaaaggggatgggggagtaagctttttgacttgtgtgtgtgtgtgtgcgcgtgcgtgtgtgtgtgtgtgtgtgtgtacagcacatttgcaggtgtacatgtgcaacagtatatctgcagaaacaaaagggcaaccttgtagactcagttctctctttccatgatgcactcccaagatgtcaggcttacatgtcatgcttttaccctctgagccaattaacacacccactggtagaatttattttttgtatgtgtggctgagtgtgtcctgtcacacatgtggaggtcagaagataatggtgtgggttccagggatggaattgccatctggatgaccttgccctgggaatttattattattatattattaaatccacaaaattgaggctggagacacatctcagtggtgaagagctcttactgatcttgcagaggacctggatttggtgcccagtacccacttggtggctcacacacatctgtaacgccagttccaggggatctgatcctgtcttctgacctccataggcaccaagcatgcacatgcaggcagaacactcatacacacaaaataaaaaacaataaatctttttttttcctccgagacggggtttctttgtgtgactttggctgtcttggaacttgatctgtagaccaggctagccttgaacttacagaaatctacctgtgaagggaccagctccccatttcagcagccataacagccgaacacgtacttgcctgaccttgtcttggtcactaggaggtcagatgcctgcctcgtggcaaggaaccaatcagaagttagctggtggtactatgctttacagctctgggtgagctttacggacaagtgcacagcaatgacacacagagcatagcaaccaccctgggagggcctatgggccataacaaccagttgaccaatcaacacagggcaagtcctccaagcctggaggcacaccaatcctgagcctgtgcgtacccctagacactcccctataagatctctatgcagacacttgacagggtctttcctagccatccaccatggtgggtggatgaaagacccgagctaacatggggttaggtcgttaaacaactacaataaagcctcatgcagtttcacctctgcatggtgattggagtggccgaggtcctgggctgagatcctgggggcctgagcctccggggatctttcacctgcctctgcctcccagtgctgggattaaaggcatttgccaccactgctgggctcaaaataaatctgaaaaaaaaaaaaaaaaaaaatgagccaggcagtggtggcacacgtctttagtctcagtactccggaggcagaggcaggcagatatctgtgagttggagaccagcctgatctacaagagctagttccaagacagcctctaaagccacagagaaaccctgtctcagaaatgtattcatttcttctgatattaaagagggacactcttttccctcagtttgaaaatgcttccagtttaataagcctcttagttaaagggatgaaaaactgatatttatttcttccttgctacctgcaaagactgtagcagagatgggtggctaagtacatgggctgggatactccaccactgaactagatggtgatcttgggcagctaacagaatcaggtttgttgttgctgtttgttgaggattttcattagttttagcttgtgtgtgtgtgtgtatgtgtgtgtgcccacacacataagtatctggaggctagaggtgtgtctgatcccctggagtgggagaagtgcttggaagtagctgtgagctacttgctgtgggtgctgggaactgaactctacaagagcagcaagcactctccagtgctgggtcatttctccagccatgtgaaacttagcaggtttcccaccagacatttttctctacaacctcctgttattttctaagaaactgaaactggccctaattaaagaaataaacatgactgggagtggtggcacatgccttgaatctcagctctcaaaaggcagaggcaggtgaatctctgtgagttcgaggccagcctggtctatagagcaagttccaggacatccagggctatacaaagaaatcatgccataacagcctaacacatgcttgcctgaccttgccttggtcactaggaggtcagatgcctgcctcgtggcaaggcaccaatcagaagttagctgatggcgctatgctttatggctctgggtgtgctttacggacaagtgcacagcaatgacttgaagagcatagcaactaccctgggagggcctatgggccataacaaccagttgaccaatcaacacagggcaagtcctccaagcctggaggcacaccaatcctgagcctgtgcgtacccctagacactccccttatgctgccctataagatctctatcccgtggcttctcggcgtcttttcccagccatctgccatggtgggtggatgaaagacccgttagctcattaaacaactgcaataaaagagtcattgcttttgcatcgaaatgggcctcttggtgatttgggaattcagaatttgggcacaacaggaggaggaggaggaagaagaagaggaagaggaggaggaggaagaagaaaagaaaagaagaagaagaagaagaggaggaggaggaggaggaggaagaagaagaagaagaaagaagaagaaaaggagaaggaattgtgagattgagatagttatcagatgtgctctaaggcatggttgatttcaacttgcttctgtgtttgtctaaatctaagccacacaatgaattctagagctccctttcatttcgattgaattcctgccagttcctgctaactgaaccctgcagccaccaggccacagaaagacagcctttcatcctagaagttgttttgctgcttgagaaatacaagtgggaaagaattggtgtttgctgaatgccaagacaatgtgttaagcactgtacttttggatttacttttcttggcatggtaggttctctttgacaggttttccaggtgaaggaataaaagttcaggcccattgtgtcagtcctccaaagcgaagagagccagtgtcagctctgccactctgtgctccataagaatctggcatctcctcatgacatcttttcagccatcctaattaaatactagctaaagcttaggttctcttgtctggcaagctcttcatgtcttggggaacacaaaagaaaacttttattttaatgttttttgagttttcaagacagggtttttctgtggcgctttggagcctgtcccagaactcactctgtagacaggctggcctcaaactcacagagatctgcctgcctctgcctcctgagtgctgggattaaaggtgtgtgccaccactatctggcttaatttctttttagtttaatgtacattagtgatttgtctgcatttatatctgggcaagggtgttgggtcccctgaaactggagtttacagacagctgtgagctgccatgtgagtgctaggaattgaacttgagtcctctggtagtcagtgctgaaaggttcaggcagatacctaggcagcttaaagggccctgtgttgcatggccatatcatgactacatcactcattacagggctgtgtaggactcagtgcacatgcgtgagctcccccttttaaacccaagcattatttgcctttctctctctctctttccagcagccgacctctctcctctctcccctctccccccccctctctctctgttcttccatttctctcccctcttgctcttccgccctgtaataaactggttaatgtgctcttgtaagaccctcgggaagctgaggcttccagaatcttagcccaggaccgcagccaccccaaacacagaacggaggcgaaagcttgatgcaaattgcatgaggctttattgtaatttaacgagctaaccccatgttagctcgggcctttgatccacccaccatggtggatggctagcaaagacagtttgaagccgctgcgtacagatctttatagggcagcataaggggagtgtctaggggtacacacaggctcaggattggtgtgcctccaggcttggagggcttgccctgtgttgattggtcaactggttgttatggcccataggccctcccagggtggttgctatgctcccagggtggttgtgtgtcatttctgtgtgcttgtccgtaaagcacacccagggtcgtaaagcatagcgccaccagctaacttctgattggttccttgtcacgagacaggcatctgactttctggtttctaggacaaggtcatagaagcacgtgttcggccattatggctgccaaaagggaagctggtcccttcactctctatatttcacgttccatgtccatctctcgaatttctaatttaagcaaaagaataacaaatgctcttaaccactgagccatctctccagaccctcacaaaagaaaatttaattgtagctctcctggattctcccatgggaaatcatgccaagattgacttaggtcccagtgctgatttaaccacttacactggccaggggtggtggtgcacacctttgatcccagcagagaaaggtggatctctgtgaattcaaaaccagcctgttttacatagtgaattccaagacatcgagagcaacataatgagacattatcctgtcatcctgtcgagcagagaacaattccattagagaatttctctggggtccaaacctctggttccagtaaccccgggagctctggtctgcattgtattgcagatgctagctgatttgctgttgaatagcatagcctcagtggagaatgcctcctagtttgcatctctatgggcctaagcattgaggaggcctgcacctgggctgaagactctttgtgcctagaaactgtttaggtggacgcttgaattaatagaatcacttgatatcagctatatacatcataatagatgctttctggtactgcccctgcccttggagaactatttaagtggactcttcaataaactctggcttctcagtatcagctaggagccctcctgagatgataatggtgtttcctgtctcattattagtgctgttggttagttaaattcccccactcagaatcggaccagggtctgtacagctggctccattcacagtcctgaagacagctgtctggaacattatcccccctcaaaaaacaaaaacaaaaacaaaaacactaaaattaaataatgataataataaaataataataataataataataacttacatggaaattcactaaggaaatgttagcatgacttccctcacacactggcaaatagcagtccctttgacacaattagaagtctccaggaacacctgtgttgaactatcacccttccttgacccgtccagcaggccaggttattcgcgggtctcgagggggttgtcacctaaaggggtcatgagggcgagaaaggaatggagaccaagcggcgcaagaaaggacaagagtccgtctgtgcaatgtcaaggtctcgtttattgaaaggtaaagcttgcttatatgcaggggatttttactcagggcggggtaagggagcaggaggaatggaaaattttcaagaggaaatagaggcaaggtaaatcttagcccatggtcccattgttagcgaaccgcagctatttctgagaaaagggagaacattttgcaacatgtattgtgcagcttatccggaaaaaacatcttgtagtcacagcagtgattctggtcatctaacaatgattaactcttgactcagtatgaggccccttttggccctcgacatctcccccttctgtatacaaaaagggatgatgaatcttattatcaagagagcccctgtcttaggccgcataggctgcgcccctggacaggcaacgtgccttgttgagccggtcttgacgacctctgtacgttgttgccccctgttccaggacctatgcatactcccgtcattgagtactcccttgctgcatcaatcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagctgtaccaaaatgcaatattcatgtgaaacatcaaggcttaaagcaaatatacagggtgttaatcctgtgttgcaagcccaataggtaccattgggtgcctcaagatagtagcttcctatatagggaattatagttttattgcaaaactgggtgtaactggagggcacctttcctaaacaaagcccttgtcctgaaactccgggcagggtaagttggtgagggacagccctgcaccttgctgatggggaggtgatattggatgtactggccataaaggcaatcccttcataataggggggctcagcagacaagcagagccagcaatctcgagtagaattaggactggatgcatggctagctagataggctccctgtaccaaattgaataatctatctacagtgcctggatctgggctaatagaaggggtaattggggtaagcttaggggtagacgactgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgaacagtagggttaattaaggagagaataaggtcatcggaggagggaggtcctggggggaaaatggtcaggggtttccctagtctggagaggcacctaaggctaaagcacataaaccaactatcaggggggaataggaggggggtggtcgtaatagttgtggaaacattggcagcatcactggcttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatgacgataatgggacagcagtacttacctcgagacagaccggtgcacgagcgatgcagggcgtctccattttgggtcggctagcctcttcttctcttggcgctgtccggagaccaccgtacctcgagccccacgttgggcgccacttgacccgtccagcaggccaggttattcgcgggtctcgagggggttgtcacctaaaggggtcatgagggcgagaaaggaatggagaccaagcggcgcaagaaaggacaagagtccgtctgtgcaatgtcaaggtctcgtttattgaaaggtaaagcttgcttatatgcaggggatttttactcagggcggggtaagggagcaggaggaatggaaaattttcaagaggaaatagaggcaaggtaaatcttagcccatggtcccattgttagtgaaccgcagctatttctgagaaaagggagaacattttgcaacatgtattgtgcagcttatccggaaaaaacatcttgtagtcacagcagcgattctggtcatctaacaatgattaactcttgactcagtataaggccccttttggccctcgacacttcctggattttagagagagagaagcaaaaaagaaaaaaaaaggctgctggacaattaaaggtactgccaagaagctatgagaataaggcagacaggcttgatctgttgggtttcatttatttatttatttatttatttatttatttatttattatgtgtacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgttgggttttttaattgaatgttttattttgaacttaactgtagatttacatgcaagtatgagactatttcaaataaaataaaaggaaaaaaaatactatagagtgatcccaagtaccttttgcccaatttcccccagtggtaatttcttgcaaaatggtatctcaggggactagaagatggcacaatgtgcttgttgcaaaagtgtgaggccctgagcctgactcctcagcacctctgtaaaaagccagcagggcatgtctataaccccagtgccagggagccagcagggcacatctataacccagtgctgggaaggcagtgtcttagggtttctattgttgtgaagagacaccatgactgttatgtttttgaagaaaaagagaaaggcgcaagatgagacatattagccattttattataagcccagcagagtatggagactaaagacagaagagaaacagggtaaatggctgaccgccatggccagtcgccatagagaggcagagaaagcgtgtagatgggagaagaaagagtgaagcagaagtgagcagagagaatagagagcaaagagagcaagcagcagggaagttggaacttttaaagggaagactgtgcatgcgcactgaggttccacacatgcccagagtcctcacacatgcatggtgggtgatatggtgatggcacgtccctgtgtgtgccctgactgttgtcagggggcttggtctgtaattaaagagatattgccaatcagcattaaagcctgaacctttcaatgaccatgaagggaccagctccccatttcagcagccatgacagtaacacgtgctctatgacattgtcttagtcactagaggttaggtgcctgcctggtgacaaggaaccaatcagaagttagctggtggcgctatgctttactaccctgggtgtactttaggacaagcacacagcaatgacgaagagcatagcaaccaccctgggagggcctatgggccataacaaccagtagaccaatcaacacagggcaagtcctcctgagcctgtgcgtaccccactccccttacgctgccctacaagatctcttgggaggccccaggagttgtctttgctagccatccgccatggcgggtgggtgaaagactcgagctaacatggggttagctcattaaattacaataaagcctcatgctttattttgcatcaagctctcgaatctgcctggtgattggggtgactgcattcgtggcctgggaccccggatacctgagttttccaggggtctaacaagctcagggttccatggttgtatagtctgcaggaaggtgcaaaggacccctttaaaagaaagactccccctttaaaaaaaaaaaaacccacccacttaccctcctcattttccctgtttcccgctgttcccgtgggattaggacttttcctgtctccctcttctttcctgtcttccctgtgtctctttacctcttaccttacctcccacctcaataaaagtttcaatatgagttacatctacagatctctgtttccccatctgccagacatccatcatctactcacccaccccaaccccacccaagacttcaatcctcgtggtcccagaacggactggggaccaccaccttcggtaccaacccattagtatttattcctaacaggtgttgtttgggctttttaacaatgtgtgtgcatgtgtttgtcacaggtgggggcatggttgtgaaggtcagaggagggtgtcagatgccctggagatggatggagttcctggaagttgttagcactgggacaaggggcctgggaaccaaacaaagatcctctggaagagtagcaatcactcttaatcaattaaccgtctcttgctttttcaagacagggtctctcgtaggcttgactggtctcaaacttactatgtagctgagggtggccttgatcctcctgcctccacttccttaagtgctgggattacaagcaccatacaatttatccgcctacctttgtttgcctcccatgttctgggatcacaggcatgtgccaccacgcccagataacacccatccttttgactattaggtaatctttctggaatgcacaaacaagaactcctagtttccaccaacccaaacactaagaatgtcatcagataacatctgagacccatagcagagattcccacactacaaacccaccttcctgatgtttccatcagggtgttaatttttaaatttttacattaatgggtcttttgcttgcatgtgtgactgtgtatcacatgtgtgcctgctgcctgaggaagccagaagaggggaactggaactgaaattatagaccattgtgaactgccatgtaggtgctaggaatttaatctggatcctagggaagaacagccagtgttaattactgagttctctctcccttactattttatttttgaaatagggtctctggtagcccagccagccttgaattcactttgtagaagatgacctggaacttctaatcctcctggcccagctccccagtgataggactgtatttgccacaatgacccattttaggccaagtggtagtggtgcaggcccttaatcccagcactctggaggcagaggcaggaagatgtctgtgaattcaaggccagcctggtctacagagctagttacaggattgccagggtaacaactagaaggactggaggcagaactctgtttaatagcacagagaaatcctgtatcaaaaagcaacaacaaaaagacaagttttatatggtgctggggatggaacccagagtttagactatgctagataggcattactaactgaactacacccaaaatctcaatatatcctaaaaatgtctttaatcccagcactcaagagatagaggctgttttgtttttcaacattttttccttcctttctgtttcttctgctttcagtactgatggaagccatgacctcggagcatgtggcatgtagcagccaagctaccattgagcaacattcctacctattgttctttcttttttgaaataatttatttaactttactttatgtgcattggtgtgaagataacagatcccctggaactagagttacagacagttatgggaattgaacccgggttctcttaactgctgagccatctctccagcccctgttgtttcttttctttattacatgtacatttttgttgcttttaacacctaggtttgattcatgtgaattattcaacgcaggtatcccaggggcatgacaggagagggtgggggatggcagagcagagtagggggaaagaggtctattagtaattaaactctgggctcatccctccttgggtttcatagactccagaggcatagtctcccagagactcctgaaccttcaaaatcatcgcttaagaagaagcttgttccaatgaatcccagtttcttcaggttctcaatgatgtcatccatgctgcattttacgagaactttcttccccacaccatcactgccaacaacctccatcattctgcctggagcaaagccaaatcccccaacagaagtcctgactgggagaggaagtgcacgacctgtagtacatagatgctgcttaggtccaggcagccctcaaccgtttgtattctgtagtttttagagacaaggttttatgtagcctaggctggtcttaaacttcgtatatagtcaggtatggccttgaactttggcctctcttgtctcacctcccaaatgctgagattacagttatgcattgccacacctggtttaagaggtgctgggaatagggtcttgtttcatgcatgtgaggcaagcattacaaacttttaaaataacagattctttccagatttgataaagagatgcataaggtaagtttaagggggaagtgtcctttagcaatgctgtctacttaaagtgggggaagcagggctaggaggcctaacaaccacccacacacataggagattccttactttcagagactttagtgggaaggggaatttaagtttagaggggaaggttgtctgagtgtagctgattagtgaaggtaacaaaacttagtgaagttttagtgaagtgattagtgaaggatacaaagccatagtttaggacctaatcttactgtcccaccctactcgggggcagctacaatgctttagcagtttaggaaagttattgcataggataccagatgtgccacaagaaggggcagcattctgtgacctaatactaatcaagtaacattaaattttgttatttaattttaagttagagtcttactctgtagctcaggttggcctggatctcactacttacctaaggctggcctcaaactcaaatcattttgcttgtgccaccacattaggcttaagtttatggacacagtcttttattgccctgactgacattgaactgttggtgaagaatctaatgaactcttaattctcctctgcctcctgtaggagtgatcagactgcaggatctagagggcctttttacttagaggccatctcctcttctgggaaaccatctaatttgggggcagatattttttagataaactaattcatatctacacgaccagaggaggggttgtgcagagaacaccagtgaaaagtacagctcacttgaggagtggggaataggtggggtagctagcatctgcctttagcagaagcatttcagaaacacagacaggatctctctgccttcaaggtcgacttggtctacacaatgagttccaggcctgccaaagctacagaatcgagcccctatctcaaacaaaaccagcaaacaaaaaagattagagaaagaacaaaataaataaaagattaggaaaaagattgggagaagagagaagaaaaagtccttctcattatttcacctcccaattttcctacaaaatagccaaatgagtaagtggttctggacattctctaccccctgccccaatacacagggtctcactatataactcctgtgtccaggaattcaggagtttgaggccactgaagcctcaaactcacaactggttatagtatagcaactataccttcccacacccatgcctggtggaactcagagtcacacacttgctgctgagctacacatctagcccgatagctagataaagtgtcttatactagtttcaaaaatatttcaaaacaagcaactctaagccaggcttggtggcactcaggaagcagagaccagcagagctctatgacttagaggctagcctgttctacatagagttccaggtcagccacaaacactcttaagttctgaaagtacaacttctctaaactaccttcaaagtcttcacgcttcagccaatgccctttctcagacttttccacactcctgctgaagaacccaaggctttgtccagattaagcctatgctccaactcccagggatggctgtaacccccacacttacttcttccccacagtttttacctatgacaccccctatggacagcctacccttaagtcttagcaatgttaagtactgcagacctgaaacaccatccctcttttcctcttactgttgcttctctttccaggaatatcctccctggtcccttcctctctaaatgtaccagtccataaagccccttctggcttctccagtcaattaagtacttcctcttttgctcctgagatatttctccataaggattctgcatttatgagataagtaaaactatttgtgataaaatacaacaaaaataagtactgtatttatacaatgtttttcttttctcctaaaccattaacagattttgttcaattcattttcatatgcagtaacacaatgtgtggtgaatattatggtctgagcaaatgattgttgatttgtgtgcgaatgtgtttcacatgggtcaaacttagtcttacaacatgctagagaagcaagcagtccatcattcatctatttcccagtccctgaataaatttttgaagtgcataagttttaatttctagctttctgattgctcaaagcactttagtttaataactactttcaaaataccatcctctttgaatccctttgagggagagggtgttggggcatcaaacctagtgccttgtgcatgctaaatatatgttttatatttatgtgtttgtttatggagaagggtctcactaggtagccttggatggcctagaacttgctaagtaggccagactaagtaggactctacctacctgtatctatccaagtgctggaattaaaggcatgtaccactgagacatatctaaaccctcattaaatagtgactcttgctgggcagtgttggcacaagcctttaatcccagcactttgggaggcagaggcaggaggatctctgtgaatttgaggccagcctggtctacagagtgagttccaggaccggcctttggcctgatgaaaagccctttaagtttatgtttagatgacaaccaaaataaacctaaaaaccttgaacttgtacctgaacagtagatagtcattactttatcagctagcatactgactagtctatagtggatctgactgcctgattctgtcaagctgacaaccagtaatattacagagatctgagaagggtatattttatccgaatctactaaaaagtgacagaagccagttagaagccagtccatatacagttagccaaacccaattctctccattttcactggaggcagatgtctcaaagaacagcaatctttgctgtgagaggttttttcctctgtggaagagggacatggaaaagactgactttgttttgtctacgcaaaggggtacaatcaattttccagtgtccaacagctttgtccacagtctcggccaggtcgtgacaggcaacaagtagcagcacatctgagcatctcgctcactggtcagcatcaccatcatctaggtgcaggaactggggtgcctcataatcttctttggagactttgggtcactgtccggatctggcagtctgtctgatattataaacttttaagataacaattgaaatgccatattctgcagatctctgaagcattagaggtctgtttgtctgttttagttactttccttaagcacacattaagcacataagtggctaggtaatgtcttatttctgtaactaattttcagtatgactgtaactgattttaacttagtaaaatgtttgaacaactgaacttaaaactgcatagcgctaccttatattccttaaacagtagctacatgtacatattttagctgtttgcttaaacttaagttctgaggcagcgtttttctgtgactttggagcctgtcctggaattccatctgtgaccaggctggccttgaactcagaaagatccacctgccttgcctcccgagtgctggaattaaacttaaaggcgtgtgccaccaacaccctgaatttaaaggtgtgtgccaccaacgccctgaacttaacttctgaaaacacaaactgtaacatcttataatagattagcatcttttaaaaaacaagaactttacattgtcaggatttgcttaaaaataattcaaaattgaagctctttaagtacaaacattaataaaaacaaacatttaaactggttttaaaaagaaatttaattcccttaaagtctttatgtaatatatagaagcgttagaagcgttaacattttaaatcttaattgaaaaacttgtttctaagatggtacctctaatttccatgtcaagatggcgatttaagtatcttttttaacttcagcaaaatggctaccagtcagccatgttacaaaacttaggttatgccaggcaacagaacattttaaaacaagtatacataatttacttgagaaataaacagaactttttaaactgaattaacttgatatgattaaaattttaacttatattaccaattttaaaatttaccatttgtagacatgagaaaccataacactttacagtttacatttttctctgacttgtaacaaccttttctatgaccttcaacaactttcctctgaccttctacgacttgctttaaccctctataacttccataacttcctataggcattcttagacaaatttcttttttttttctttctttctctattactttagtatcctacattttctctcatttcttggtcaacatatattcttatcaaagtccttaagtttttttttttttttttttttttttttagaacacccggatcaggacagatggttcccccgcctgagctccatgtgctcagggaagagacctggggggggggggcttctggtaatcccagaccctcagccaatgcaggggtgagaaaaaacccctgcagtccccctgcataccatgtgtgtggagcacaaagaaggcagggcagctagctaggcagatggcggccttgcagccatgttccctcagagccgcaagccaggactcatggcaggagagcagttggggcagagactcccccacttcgcatgcctcacagcccggcaggtggggatagggaaagactcacctgcatcggccaggctcagctctaagggctgcagcagtggttcagaaaagcagtctcgggggactccaacacaacacattttaacctgtgacacatggcagaactcctttctcatgccacatgcttagggcaacaagaaaagacccctgacccatgcatgccaagtgcgtgggcagtagggacagaaagagatgcttaacaaacacacaacacaaatgtgaaacgtggacagccagtacagtaacacagactagggtcctattcggaatttcagatgacttgctcccagctagtccccatcctacagattgtgcgacccacttgggtccccttatagatggaccaggcaacttggtcttaccaggtcccgctcctacagactgcagaagctgtcattcgaacctctgccctaaacaattcttgtacagaaaccatacagaaacaaagactggaaaataaagttacctagtgtggtgccacgtgactcaacgaaagggggtgtcataactttaactgactaactatggtccttaacgtccgtccagtggtcaaaagtcagactgagggtgtagggagccgtccctgcattctccattacaagatggtgcctgcatccggcagacactgaatgtaaacaagattattgcgcaggcgctgggtaattttccattccttgatctctgcctattccgtggcgtcatatggcctgatgagctgcagccaatcatagggtgacacgtcccaggcggcggctgccagcctttattaggggacgggattcttggctcggggtctccgctctggtaagcttatgctctcctctcaagacgcattaaaagctttactgcagaaggatccgaatgccctgtgtcgttcttgctggcgagacagtcgcgcgggacatgaggggggttggttacggtcagtcccatcatcaaactcacaaataagacaaaaacaaactcaagacacacagacaaaaactatcagatgtctgtctccacctagacaaacaaaatcactccagaaatacttcccaatccaggagaattaccgtaccctcaccggctcccaccggctcccagacgggaatctcccaagcgtccctgaggttcccacagacttcctggaaagtcttccagggtggcagtcggtgatctcccaagcacatctactgatcacactctgtctcctccagagaccagagctcttgtctcttcccaagacacgagcgactgcaaagcacagaaccagatttcagccggcacaaaaacacaaagacacagacaatacagggtacccgcttacctccaagatcgactccactcaggtgaggggtggtcgcaaatcccggacgagcccccaaatgtaagacccttgaaaagctgaggcttccagaatcttagcccaggacctcggccaccccaatcacagaatggaggtgaaagcttgatgcaaattgcatgaggctttattgcagtttaacgagctaaccccatgttagctcgggtctttgatgcacccgccatgtcggatggctagcaaagacagtttgaagcggctgcatacagatctttatagggcagcgtaaggggagtgtctaggggtatgcacaggctcaggattggtgtgcctccaggcttggagggcttgccctgtgttgattggtcaactggttgttatggtccataggccctcccagggtggttgctatgctttctacatcattgctgtgcgcttgtccgtaaagcacacccagggttgtaaagcatagcgccaccagctaacttctgattggttccttgtcacgagacaggcatctgactttctagtgactaacttctgattgtttccttgtcacgaggcagggatctgactttctcgtgtctaggacaaggtcatagaagcacgtgttcggccattatggctgccaaaagggaagctggtcccttcaatggggaggaaagggagtcaatacttacatatcaattacctaaattgtaagtcaacactcttatattttgttatagctgcaaacatttgctaactttttcactgccctttgcctcacctaatgactcaggtatgatctttatatagataagaacacttgagactcagggattctaatgaccagctaaggaagtcctctcccaggtgtggtcatcaacttgtcagctgattcatccacagcctgtgggtgttagatttctaatccaggtctggaaaacattttgaatcctttgtgatactcttccaaggtttccttttcattcctagttagtcattctttacacaatctacctgagatgtttcttcaagtcactcttttgaagttaagagttccttctattctccctcctccctccccttcccactttctcttaggtaccggaaagtgcacccagggtccctcacttgctgtgcaactgctctaacactgagaaacatcccagcccttgcctgccttttcctgtaacacatggtatccaattcaaacacagctctgacagtatcctagcacccattcaacagacctgatagaaatacaggtattctaaagaggctctagagcgtgtgtgtgtgtgtgtgtgtgtgtgtgtgtgtgtgtgtgtgtgtgtgtatgtatgtatgtatgtatgtatgtgtatgtgtatatctgactcttagactattcaaaggactcccaaagaaatggaaatttcctgcagggaaactcctgatgggttgggcgttggtggcacacgcctttaatcccagcactccactcgggaggcagaggtaggaggatctctgtgagttcaagaccagcgtggtctacagagaccgtgttccaggaccagttccaaaaacaatacagagaaaccctgtctcgaaaaaccaaaccaaaacaaacaaacactcctgatgggaaaagggaaaggtctcaatttgaggaatttgtctcccagaaagagatttcacacagttctatctagccagaccaccttacaggatgagattgaagacttggactgcttagatgagcctatcagtggtcctctatttaaactttaatctcactccaggaccccagagagccacttatggaaaggttaagtgttgtagaatatttgtacactgtgcttggtttaataacgaactgaatggtcaatagctagacaggaagaggataggcggcacttctagggacaaagaggactctgggaaaaagaaagacaaagtcggcaaccagatattgagaggaagaggggggtataaaattggagaggttaaagcaacatggtagaatgtagattaattaaaaatagatatggattaattcaggttatcggagctagtgggacaagcctgagctaaagcaaaactttcataattaataagtatccgtgttgttatttgggaactggcttgtgggacagaaaaagactcactacagttaactatctctttggccctcttcccagtgtggccacgttaagtcaatctcctttttctgttttttactggtttttgttcgtttgtattttgtgtttggtttttgagacaggacttcactgagggctctagccgacctggaactctctaaacagaccacacgggagatcctactgtctctgccttcagagtgctgggattaatggcttgcaccaccacacgttgctttccacttttttcagtggtttattgactgggtggcccaccttggcttggggcaccggttgtgacccccctctaaattcggttaacacccatttggtctaatctgtcttcgccacacaccaacccaagcagtttcttcctgatttcctagcctccattccccatgacgaaagagctgtttccccaggtgtgaatcctagacctcctcccatcatggctcatctatctcaaacacatcaattctaacagacatttctggcagtctcgtgggctgacgccctaacgcctgctgccagtttctgcatctggtgcctgagaaactgaaaactcttgcagccgccaccaaagtagcctgcgccttacggtgactaatttccattactgctttggggcgtggagtagaccaccttggccagacgttctcaccgaacacgcgctcgcacacactacgccctggaaccaacccgggattcccagcctgtggacgctcccattgccgccagcgagagggagggcctccggctcacggaacgcctctctaacgagttcctgtgacctccgccttcgcacattctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcctcgggcgccgggagatcgcgtcccggaacaggtaagagtgggagccagcgcggaatgaatgggcagccggccgcgggtgccggtccccgcgcctggctgcggcgtcgcgtcggggaggaagcgctacgccgctcagggtgccgggttcggtatttgtatctgatctacctaatcccgggaggccacagggaccctctcccctcccccagatggtcacacgttttgcttcgttttacccccggatgcagagcggttacgtttcggttgcccagactgcttagggacatctttatgaggggggaaaatgtaaaaaaatgacacttgaccgtgggtttgcagggcctacgggctctgaatcttcctcaagccgcgtcagtactagcacgtgttggctctccaacgtttttgatgggggttttttgttttgttttttggcggggggcgggggggcttccactccgactcttaaattcctgggtgaagcaattgtaaatcaacctttccccaggagtcaatcctatacatcacccctcagttttgagtgtcctctttctacctaagggcagatttcgaccatcacaaactacatacaaattaagtatggcttttaaatgaatagtttctcgctcagatcaaagcaactattctatgtaatatctttttcaaacctagcaactacttcataatacttttctagaaagtgtaatttggttgttacctcaaattaggttattgcctccaacatatttgtatgaccatccttatttactagggtacattttggtcgagttttggattagttaaaggacagattgcacaccagaaagtataggttcattgaggctttcttgtttgtttttcaagacaggttctccatctggctctagctgtcctttaactgaattgtagacaaggctgggttgtaatttacagaggtctgcctgcctctgcctccctagtactgggatcaaaggagggcctccaccactgcccacttgattgaagccaaaaccttaagccatcatcaacaccttattggcagacatttagacttcgaattttttttttaattaaggtgtttaaatgggtgtggtggcatatacctgtaatcccagcactctggctaaagcaggaggatcaagatttggagtgccctcccacccggatacagtcagtacagtgtatcactcagcacaggtgctttaatatagaagacataacattagagattctaagctttaggctgttcagaagagctttctttccatgaagaggtgagattggggccccaggagatggctcaaatggtgaagatgcttgttaccaaacctgaagacctaagttcagttccagggatccacgtgatggaagaagaggactactaactccttcagggtgtcctctggcaaccacatgtgcctacgcaaatataaatttattcgtttatttattttggttttttgagacagcgtttctctgtgactttggaaactatcctagaactagctcttgtagaccaggttggcctcaaactcatagatatccacctgccactggctctcaagtgctgggattaaaggtgttccccaccaacgcccatcttttgtttttcaaacaggtgagattaaacagaagcagatgtggtgactcctttctgcttgttttggagacagggtctcagtgtagcctttactgtcaaggaggtctgcatccatgcgttgggactaatggtgctgcttgtctaggagcagttcttgaattcaaggccagactgggctgctggtaatgagttccagtactgtgtgtcctgaagtgagatccttaagggatagggttttcacaaaggtttgtttcattaagtgaaacaccttttattttcatggttaaatttgtagtgtcagaagggtagggccaaagttcctggcacagtaatgacagttcttgatactttcaggactcagaaggtggctggtgcttgagctggactttgaaaatatggttagggttgaaagggttgaatatgaagcattttattgaagaaaggcagcaaaaaggaaagaaacttttttaaagagtgaaagaagaaacactttgcagagtggacagtattttcctaaatatcttagaaacaacatttgatttctaagaattaatctttgtgtgttttttatgctacatgtgtggtagtacctgaggagaccagaagagggcattggatcctgggactgaagttagggaccctggaaaagcagcaggactctggctactgagctgtctctaacccctccaccttcccttttctctcttagggttagacctagacctttgctcttgttaagcagattcttttttcttttagagaaagggtctgatgttgcccaggctgatcttaaactttgttatgtggctatagataacaacaaactcctgattattcttcccttacctacaaaatgcaaggattacaagcatggaccactatgccaagcaagcagattgtccctaaacaccccagacttgttcaaaaggccctgaaggaactgaaagctactctatctcttaatgaggagcagtagtaactccagctatacattcatactctaacttgatcttgcaattggatgagcacagtctcttccagttctcacatactgtattgtatgggcttaaaagggaaccttggggagtgatcttactagccatgttgctttcctctccaaagcaaagacagcatcctgcagttactgtgctgcagagtagtctgtgggcttggaaatgctattctccagatccctcctcctcgcatgaacatttgcaaatcctttaactttggttgctgtatcttactgacagatgtcatccagaaaagatttaacacatatatccacaaactttgttgaacagtgtacctactgttccccatgctaactacagcaggaattgagaacaatctttgtggccggagttgttgggccaaaactttgaaggagccgaagaagagtgtacactgaagaggggatagtagtggaacagggagaacaccttcatgaaaatgcacagttacaggtttggtttcctcaagacaaacttgaattctatccagcaaatgtcgctggtgcttctatgggcttgggaatattttatgagctttaccccgcctttccaaagctcctcccccattttattttatgtttaggggtattttgcttgcatttatgtctgtgcaccatgtacatgtctggtgcctgaggaggtgagaagacgacattggcttccttggaattggagtaagccgctctgtaggccctggggaagagcgcaagtactcttaactgctgagccttatcttcagccccagctgctacttagaagtttgaggcgccatgaagagcattctgaaagaaggagaagtaaggccgttgccctggtgtattgggaggagcaggaagaagggaaactgagccacatgttaggggtcacctacctctgactctcagaacttacagggcttccatagccttttaaatagtggtcatcatactttaggaaatacttagaacttgagcgtttagccctgtggtaaagccattcggttagctagggtgttctggatttattttgtcctatgtgtctttgggttttcctgtgctgaggattgacctaggggattcccttaacacatggtaaacgattctgagacactgagctacatcccaggcccttagagttgttgtgttctataatagggtcttcctgtggaaggaagaagactacatggccttgaatagaacactcttagcatgagcccagcatgatagagattagacaagagtgctcaggggaaaagaaagatgaagaatacaaatgtctctgtaaacctttttctttttccggtgtcaaaaaatgtcagggcccactcaggttttctgaacttttgatagctgtaagttgaacctgaacatttggtggtgttctgtctggcatgaccttgtggggtgtataagaagacttgcttcagtaagggctttagaagcctgcctacaattcttattgatatatttcttataccttcaaaaattcgagattggtatgaaatgatagggtttgtgcaaaaagaaagtttaaagtcaccttgagaatttgagtaatatgagaagtcatgaaaggagtatcagagtgttcattcccgctctatagcaagttcaaggccggcctgagaggcataagagcctgtctccaaagtatacaatacactaaagtcagagaatgtaactcattggtacagcccttcattcagtcctcagaaccagcaacaggtgtttacagtgatgtttctaggaagtcccttagtcctcgagcattgtttctcagttttcctgtgtctccctttttatctggctttcctacaactctctaaatccagtgctgggtactgaatcctataccttttgcatgctagggggacactgccattgagctaaattgccagttggtggctctaagtgggaagggcatctggaaagtggcagttaggcctctctatagaatgaggaagccagtggagaccatgctctatgccagaggtactgaagctgccttctgtgttggccatcataacccttaatttccctgctcagaaatacccttgaaaagtaagcaggatggtacaagcttgtggtgcctgccctcaagaggctgagaccagaggatgtcaagtttgaagcctgcctagtctgcataatgaggtcctgtctcaaaaacaacagtggcaacaaaaatcaaaggggaaaggtctaaataaatatgccttggatgtgtgttcatagattgctcctgattggtctgcttcactttgaggacaggcatgcttacaaggcctaagatatatcacccacttttccttagagctgtagctaaaattagtacagctgtttaaaatttctattttaaatatattgtttgtttgcttatgtgtgtgtgtctgtgcacgtgtgtaggttcctgaggaggtcataagaatgtattagatcagccgggcgttggtggtgcatgcctttaatcccagccttctggaggcagaggcaggcagagctagttccaggacagcttccaaaagccacagagaaaccctgtcttgaaaaaccaagaaagaaaaaaagaatgtattggatcacatggagctggagttacaggaggttgtaagcctcctgatacaggtgcaaggaatttagcttattgatggcataacttctggttctctgacattgattcactttaatttttttagatttattcatatgcatgaatggtttggttgaataatgtgtatgtgtaacacatgggtgcctgggacccttcaaagtcagaagagggtatcatctgctggagctggaattacaagtgcttgtgagtcacactgtgctaagaaccagacccaggtcctctgcaagagcagtaagcactcttaaccacagagatctctctccagccctacgttttttgtaatgtagatatatgtgtttgtattgctaccttatctagaactactaggcccagtgacttatttatagtgtgccagataatgagcttccattttaaaaaataatgtagcattttacttgagttgtgctttattgtttgtgacatatctcattgaatagcccagtggaattcacttgtgtagcttagtctggcttcccactcaatgtgtactaaagattgggtttgaacctcttgccatcttagcttaacctcccaagtgattacaatcatgtgctgccactcccaggaggctttggaaattcttgtatgaagttgtttttccttgtttcttaagtggcagaaaacttggctgattttatgccaactgtgtaaactctggggtggggagtgaagcaggtgaagagaccgatagaaaggtcgcactgtgtagtactattggacctggaatggacagcccaaccttgaactcatagagctccacctgcatctgcctccctagtactaagatgaaaagtatgagtaaccattcccagctacagtttcattttaataaaagttaaagcaaaagttggcaaactttctgtgaagagccacctggtaaatgttttagtcttctctgcccatgtctaactaacccttacagttggagtatgtgaggtttcacagacagtatgtaatatatagactatggacactgaaatttgaattttacactcttttcacatgtactttatttttctcaactacttttaactgtagaagtgatttcatagattactagcagcagcacaatgccaggacagcagcagatttgggccatattctgtggatcctggtgtagagaactctgtgctatcatcagaatctccctttgggttttcaaagctgtcaaagcagttcattcttcaaagcattcttcaaagtattaatgttagggaggggatgtcaccagagaatgtacaagtatatgtaaaaggatttctttagagatattttctaataaggctgtcatgactggaaatatggctcactcaaccttttctggaacatgctttggctttctcatctactctctgactttctgcctgctgtgacactgtgtctaggtgcgtgtatttttagacatactagattgagagttatgaccttcactggatatctggaaatgccactcaggtcatggcactgctttgtacactttgtgctgtaacagtgtgtgtgccttaatggcagtgacgtcgatagatggagaaggtgaaacttgacctctgatgactcctggcacaaaatatgggctgatttgtatgcctggctgctcccagcaggagccagcaagcactgttggaaatgctgacactcacagtccaaggtgcagcaggtaacttgctccagggcccaaactgcagtgacatcagtatccacatctggaatggtgatttacaagattgctaggaagagtaatgggaacacagaagtaactggcactcctaacagcttgctctttaagccccaaagtgtgtttcattaagcactggagaattgctaacgttaagacagtcattcagatgtgctaggtacctctattcacagtcttacagagctatagttgatttatttaataagcataatgctagagattgaactctgggtcttcctcatactatgcaaacaattcaccactccctcacacacgtaccactctattattattattaaaacttaattttttattttattgtactgggtaaatgccccaccaccatacaccaccagccctgccaacatttgctaaagcaccatgctgtgtactgtccctgtcttacatggtggtacactctgctaatcttagcacttgggttgtgagaggaaaaatggttcaactatccaaggacatctaacgtttaaaaaatctggtagcagccagttagtggtggggcacccctttaatcccatcatttgggaggcagaggcagtcagatctctgagttcaaggccagcctgatctactaacttgagttccaggacatccaggactacacagaaaatccctgtcttacataacaaacagcaaagtcagtaatgtgtgggcatagacctagacatgggtgcttgaatattggattccttaaaatatattaaatatgcagcatagccagtgcccctggaggatattttgcgtgaactttaacccacttgccctgaaagtggccacatttattctggaaccgaccctaataagcctaatgagaaaattagctgccaaatttgctgtcttaactttgaggtagttgggctcatggccagcagatggcagcattgggctgctggtacttgtcatttatagtgttgtgttatatacttcactgttccacgtttccctgggccaagattgatcagctttcaaatcctcctaggtgtatacctaagacaatcctggtatttgcttattctttaccttttagtcttttcttttttagttgggtcatgctggagatactcagctcaaactgagaaacattatccactaactggacagttgggcacgaagaatagtaactgggtaactagagcatggtgaggtgatttgcttttaggactgcttgggaactaggtaggaccagtcagtttgggtctcaactagtgagattgcctccaaagatctaattagaaaggaaaagctgtctttttttaaatcaccatcttgttccacacagctagcagatgttacagctcagttaaacacttgcctagagatacaaagtcctggatacagtctctgtctctgaagagaaaggactaaataaagctagatatggctttctcttgtttaatgtagtggtggagtgtttgacctggcctagctctgtaaccctggctgctctgggacagtatagaccaggttggtcatgaccttgaagcagtcttacctctgcctcaagtgctaggaccaaagtccctactaacatgcccagtgatacaaactattaagttcctttagcaggatagaatggtacatgtccttaatcccagcacttggaggtggaggcaggcatattaggaatttgaggctaaactctgttcaaaagtttgaagccagcctgggctactagaggcccctaagactccatttcaaacaacaaaattctttggttctcttagtacctttgtttcttctgagacagccaagctgtcttgaactcatccaggaatacaaactgggttgaacttaaatgttccctgctacaagtgccacatcttctgaggaataattgatggtgcatcaagacagccttgaattccatccaccttgcacccctcccccacatcaataaaatgtaaagacaattttcagcaatgtttttgcaaaaatggctttagatctgtgtggggttttttgttgttgttgttgttgttggtttttttttttttttttaatcttcatgatcatcctgaacttacaaagatgcatcgaggaaagtgtagttagatggtaatgtcaactaaattacctgttggcagacagcagttagaaaacagtctgtaaaatcagttaccactagataattgagaaatcccatcttcagtaggagaaagggcaggatttcttcaactgcttgtgcatgcttgcagagtactgggaagagttttagatggtcccccaacctagtccacatgcatgacttacatcagaagtgcaagggctgacaacaggatatatttttgaagctctcagtgatagtgagccaggctggggagtcattagtatgattctaggtagttgttcagttatgttaatgtatagggctagggatgtactgctttaaggtgtgatgtgtttagatgcttatttattgcaaggagtagtgctgttgggttactctcctggcaacgggctctttaagttaggctggttctccattgtgctaacttatgactaaaataaaaactggcattttcttttcatggtaagccaacttcagagctgaggtgcaactgtcagatttccctgttgttcattttttactgtcataattccaacaatagttggcacatggctgctaaaagtatttttaatcagaaggagaaattgcagagtatgcttttcaattaaagaaaagcaatagctaggggtggtggcacacccagcactctggaagtagaggcaggtggacctctgagtttgaggccagccttatctacagagctagttccaggacaggcttcaaagctacacagagaaatcctgtctcaaaaaacaaataagcaatgccatctacctgcatgccagcccttcacattccttggggtgtagctcagtggtagagcactggcctaatagtttcaacctcaaccaataaatagaatggtctctgttacataacagcctgcttactctgtattcagatggtgaactttgagatacagttttaatcttgtagggtaggtgagttttcatttctcttgaatacatgcttggaagtaaaattattgtgctaacctgcttttcactttttaaaatctttaacaaactatttcaaaatagctataccattttaaatttgcatcaaacaacatgctgtccataggtacttggcccttttagtctcttttatgtctcatgcttttgagtgctatacagaagaactctgtctagccgggcggtggtggtacatgcagatctctgagtttgaggccaacctggtctacagagcaagattcagaactgtcagagctgttacacagagaaaccctgtcttgaaaaacaaaagaaacaaacaaaaaagaactctgtctggcttacaagacttttcatgtgcccttttcttaggagtataatttttttagcttatacctgtaacagcagcattgggagactagttctaggcaggtttgggccatagtgtaatactttgcctcttggctgagttgttttttagtttttcaagacagggtttctctgtgtagctttggagcctatcctggcactctctctggagaccagctggcctcgaactcatagagatcagccttcctctgcctcccgagtgctgggattaaaggcgtgtgccaccaacacccagctatgagttgttctttttgttgtgctggggcattgaacccagggctttgctagataagtactctaccactgaactgcattcttagctttgattgattgattgattgattgattttattgagataggatcttattacattgcctaggctggccttgaacttactttgtagtctatgcagataaagaactcactgtccccctgcctcagcttccacagtaactgtggttacagatctgtgccagcagacatggctcaggcctttgttttactttcttgtttatttttaggttttttgtttgtttgtttgttttttatgtgtatgtctatatgactgtgtgccacctgtgtgccatgcccagaaggccagaagatggcgtcagatcatttggaatgagaaacagtagtatgctgcctacctggtatgggtactggtactgaaccttcttcccagccttgcttacttgaatatatatatatatatatatatatatatatatatatatatattcatatgtatgattgatttattgatttattttattctctgtgtatgtctgttttgcctgtatgttgcatgtgcacctcatgcatgtctggtgcccatggaggtcagcagagagtgtcagatcccctggaactggaatcatggttgtgagccaccatatgggcactgggaactgaacccaggtcctttccaagagcaataaacaatcttaactgaagagccatctctccaacactacataccacacacaccaggttggttagattttgagactaacattagacaccaagatatgggtgccagaatgatacatgtcattttcttagcacttaggagtgcatgtttgtatacacagccacacacacacacacacacagtattaacatccgtatctagacatgtacatcataggaaggtaagcatgaattctcacagctgtcgcatgtttgagccagccacccacctccccaccccctgtctcagcattccctctccatctctcttcctttacctagtgtcttccaccagggacactcctgctttcacccactagtggtcattagtattgccctgtgagaaagcacttttaccaagtagagcatagtgtgtggctgctttcctgtttttttaacccctgtactttgctgttgaaacatcgttttccaaagatgtagatcacaacttcattttttctatactgcttagtagtcaaattcctcttttgaagtactcctgacggctccaacctccagttaatacttaaatgtatgtgtatcaaattcattctttatggctgctcctgtggattttgacatattgggtccttttcttttgctatgataaaacaccatgaccacagcaacttaaaagaaaaaaggtgtttgactgggtttacagtttcaaagggctggaattcatggtcattgaacaaatacatggtggcagaacagctgagaagtcaaaacccaagcaagaggcagacagggtacactggaaacgtgtttgttttttaacttcaaagccccacccccaacaaggccatacttccagttccaccgactggaacctagtattggaacataagaggcattgggagccattctcgttcacagcacagccatgtatgcattctcctacttcacagaaccgttcttctccttctcctaggagtccctgtgctgcccctagcagccaccacacctctcctttgctgtggttccctagggaatctacagtctaacttgtaggaaggacctggctgctttcccttagaggatagaatgcatgtaagattcattgctctaggagtccgctcatgttctttctacctaatgttttacttaatgggcattctacagttgttcaactgttcacacacacggaaggatgtcatggtcgctagcagaattttcaaatgaatgctagttttaattaagtaaatacctagaggtgtgaactcctggctctatagtaaacatatatatcccaccaagctgtttttcagaatagtcagctacacatagaaataatacaatttataatgaaggcatcaggctgagttagttatgtgttgggacttaattaatttttttctatttttattttatttaaattagaaacaatcttattttatatatcaatcccagttccctctccttcccatcctcccatgccccccaccagcccccaggccatccctcttctgctccatagaaagggtgaggccttctatgggggatcatcaaagtctgtcacatcatttggggcagggcctaggcccttcccagtgtgtctaggctgagagagtatccctccatggggaatggactcccagtgtccattcgtgcactaggtataaatgctgtttcattaccaggggccatagactgcccaggcctcctcactgacacccatgtgcagggggcctggttccctcatatgctgatttcccagctctggggtccatgaccttgttcaggtcagctatttctgtgggtttccccagcgtggtcttgacccctttgcacatcacattccagagttcagctcagtgtttagctgtgggtttccccagcgtggtcttgacccctttgcacatcacattccagagttcagctcagtgtttagtctgcctctgcttccatcagctactggatgaaggctctaggatggaatataaggtagacatcaatctcattattggggaagggcatttaaagtgcctctccactattgcttagattgttagttggggtcaaccttgtagatctctggacatttccctagtgccagaattctctttaaacctataatagctccttctattaaagtatctcttttcttgctctcctctatggactcaatctttctgctccttcatgtcttccccttttcttctccctcttctctttctcttaaccccactcccccatcccccaccccacccaccccctctgtgcttccaatttgctcaggagatctttgggacttatttaattagctttactgccctttgcaggaatatctaccactttcctcgcctgaacctaagtagctttcatgaataaatgcatagtttattatatggtctttgtccttgttgagcatcagaataactttttcatacatcatcaaaaattttagtgtcttagaggacagaagagtggagtttataagcttcctcgagctgttgtaccggaagccagaaataatacacttctttagtatttactctgtcaccccattctcaaacattctatctcaaaaacaaaatgcctgtgctactggtacgtttctctcctttttaggcaattttttctcaaaataacttctcttgtctttccctcctcccctcacactgccaccaaaaataagaaatttctgttgtcactgaagtttgacgggctgcttagtccagatctgctctcctttcatcttgcttcagttgtcagtagcactgggcgatggccctacatttaccgtcttatggatcatttcctccttggttttctcctcccctgcatctgcctttgtagagttttagctttcacaagctgctccccaccccagcccagtgcattcaggaactttcccccacctcccagtgctggtgatggaggacagggccttccttgcacatgacagacactctacctctgagctacctagtccaaacaatccgaactttcttttccctactatcccgtgccgggccacctctgcagctgaacctttttagttatcatgagacaggctcacaccaagttaaccaaactaactgatctgaaactaactcactttgtagcaaggcaaacctagaactctgaatcctgcctcaacctcccaagtaactggaattgcatgcctgcaccgcagagctttcttttccctctgtttctcttctatctgcccatattgccctacaatgtagtggggctttctgttgttgctgctgtttgtttttgagacagagcctcactgtgtaaccctggctagtctggaaataactgcatacaccaaactagtaaacccagaagtctgtctgtctctgctccttctgagtgctgggattaaaagaattaccactctaggatatggtgacacacagttttaatcccagcactgaggagacagaggcaagcagatctctgagttaaagaccagcctggtctacagagctagttccaggacaaccaagactacacaaagaaaccctgtctcaaaaaaaaaaaaaaaaaaactaaaaacaaacaaagaaccaaagggtccgccagcgaggtattttggaagaataagtccaataatcaactcagaattctccaggaacttcttgactcagaaaaagggcctccactactctactaagctcacctccgctcactctggctaccacactaataacccttctgcataaactgctcagctttcatacatgctctccctctatccagactccttcagtagatcccagttgggctttttttcttaccacttacatccattgaagagtcatcctgaccatcacagacagataagcaatttccctgtcacccacaacccatatctcaacttgccctgcttttctccatagcacttttcaccgaatacaaactatggttctttgtcttcccaatacaaaacatactgcttgaaagctagaatttgggtctgttcgctggtgtgtctgcaggaggctagagttgtctggtatacaataggcactgaaacactgggtaggttttagtcaggagacagagaggatctccatgagttagaggccagcctggtctccaaagtgagttcctggactatgcagggtaaccctgtgggggtggtgcttgaatactaattgatcttgatacacagggacatttgtggtgacctgccattgtaactaatttgaaccagctgcttgttaatcagtctgccagaattttataaaagaaaactttaccactaaagagacagcaagttctgactgtggttcttacccttcctaagaagtgtaactgcagcctttaatacagttcctcatgttgtggtgacccccaaacataacattattttcattgttgcaactgtgatttcactactgttatgaatggtaatgtaaagatctgataggggaccctgtcaagatccaagagaagcactggcttagcagataagagcacataacgttacagaggacccaagttcagttcacagctcctgcatcaggcagctcacaagtcacactgtaacttaagttccaagggagtccagtgcccccttctggcctcctcgggtacttgcacatactggttcatgctcaactaaaatcaaaattgagaggacaagatgtggaatatagtaaagaaacccagggtctttagctgcctcaagaaaatgaaccacttctaatggtaattgtttaaagatctatttttatatgagtcacaatctgtcaaaaatgaagttaggggactggagaggtggctgagataataaaccgcctaccccataaacatgaggaaccctggtacccagagtcaagcatgactctgtccataatcctagccaccccctgaccagcctgtctcaaaagctaaggtagaaagagatgaaactcaagtcatttgatggccaccagcctccaaatgcactccacccccatttatgtggatacccagatgaaagcaatttaagaaagggtttattttggcctatagttccagagggacagaggctatcatgacacagagagcaaggaaagaaagtatgtacgtcaggagctggaaactggttcatcattatatccacacacaagaaacagaatggaaagtgggtccaggctagggaacccccaagcccaccttcccaaacagcatcaccagctgggaaccaagtgttcaaacaatgagcctcctggggacaattcacattcagtcacacgcacactgcactaaactacaccataccacaccactcaccacactacaccacacataccataccacaccacaccacaaattggaaacctaagcactggtaagcattcccttctttcaggcactgctgcttcctgcgcctgttctgttaggggtctaagaaatgtagcctgtcaggaaaagaaagctcttaggaaactaacttagcagggctcaggcatctccagcactccccagactatgtatgccctgtgttttttgaagagagtatgttcaatgctgatcacaggcttctccaagagactatagccctgatggacacatccgaaacctgggggacctgttcaaacatcaaacactcacccttcaaaatcattctcaaagaaaaatacttggggccaggtgtgtttgtgcacgactttaatcccagcacttgagaggtagaggcaggtggatccctgagttgaggccagcctgggctacagagcaagttccaggacagcctccaaagctacagagaaaccctttctcaaaagagaaaaataaaaaaaatggaagaagaatgagtattttgttaagcaatgcttgtttaagactgggtgggtatacaaaggcaactccaagaggttgttgaggttagatgaactatctagttttgtgaagagattggttaacacagaacttaaattacctgtcctgatggaagtgggaggctagaaactccattatttacagtgaatgctgacagctggctgtgtgtcttgcttcttgcccacagtgagttccatgggaaacggcacgagtaggctctacagtgctctcaccaagacactcaacaacagtgcagccgctcagcacccggagtatttggtgtcagctgacccagaacatctggaacccatcgatcctaaggagcttctcgaggaatgcagagctgttctacatactcggccaccccgataccagagggattttgtggacctaagaagagattgccccagtagccaccctcccattagagtcatgcagtggaacatccttgcccaaggtatgcctgagccgtttagtctgctgtggcttccttactgttcctgtgcaccccagtgcgcctgtgtgctatggggaggacagagagaggtgtctttcagcagctccgtgggataacagacctccctcgtggactcctatgggaaggatagtggtgtctttccgcagtgggataaccttagaccttctgttgccagcagcttgagccacagctctgtgacagcactggcagggaacgaactgagtgggtggtgtggatatgtgtggagcagggttgagactagccttggctggccttggcggcccactgggacttataatcctgcactcaaggctgcaggagcattatgactgccagagtttgaggccaacttgagctatggagtaaggccttgtctcaaaacagtaaaaccagacactgcttggccaactcctagcacttagttacttaaaattattggtggcaggaaaggccccttttactacacctgctgaattatgaactacatttctcaatcattctcacgtgttaatacctttatgtgtagttgaagttgtaaggaaaggcagctgtctttgggagtgaagggataggtcagtggttaagagcaggtactgcttgtccagagttcctgagtttgattcccagtacccacaccaggtggttccaggagacctaacacctctggcctctgcaggcacctgcacttatgtacatattcctgttatccgtacacatagttaaacattataaaaaatttattcatttttttaaactacttttaagggctggagagatggctcagcggttaagagcactggctgctcttccagaggttgaggtcctgagctcagttcccagcaaccatctgtaatgagatctgatgctctcttctggcctgcaggcatacatgcagacagaacactgtatacataataaataaataaatcttaaaaaaaaaaaaaactacttttaaaaagaaacggcatttcatgtttatgtatctctgacttaccaatcttgttagaagtatttttatttgttctttgacaatttcctatatatgccatgtatgttgtttatacccacccccttccacccttacctgccctggcacctgtacaaacgtgcccacccccatctttgagtctatttccctggtgctcgttcataaggagaaaaagatatttgtctcattcattctgaatagtatctatttttatccgttcacatggctttattatcatcagtgttaaaactaatgttatttaaattgacacacttttctatccccaggactacaaggtttctctaaacttaaaaggcaaaggtctcaatcctagaatatagttatatgaaatagttttagtatatattggggaaaaaaaaaaaaaaaaacctgctgcttgcttcagcacatagtatgaggttattttgtctgggtaggttaacacagcatggacctcccatccgtgagctttgttcatttatgagacaggggcttagtatgcagcctaagctgggctggcactcagtaacatagcccacagtggcctcaaactcatggagatctgccttcccagtactgcatcaccacatcaggcttcccattttctttgaggtcatgatactgtggtaattgacagatgcttggcttttcttttcagctcttggagaaggcaaagacaactttgtgcagtgccctgttgaagcactcaagtgggaagaaagaaaatgccttattctggaggaaatcttggcctaccaaccagatatattgtgcctccaagaagtggaccactattttgacaccttccaaccactcctcagtagactgggctaccaaggcacattttttcccaagccctggtccccgtgtctcgatgttgaacacaacaatggaccagatggctgtgctttgttttttctccaaaaccgtttcaagctcatcagcagcaccaatattaggctgacagccatgaccctaaaaaccaatcaggttgccatcgcacagaccctggagtgcaaggaatccggccgacaattctgcgttgctgttacccacttaaaagcccgctctggctgggagcggtttcgatcagctcagggctgcgaccttcttcagaacctgcaggacatcacacaggaagccaagattcccttgattgtctgtggggacttcaacgcagagccaactgaagaggtctacaaacactttgcttcctccagcctcaatctcaatagcgcctacaagctgctgagtcctgatggacagtcggagcctccgtacacgacctggaagatccggacctcaggggagtgtcgccacaccctggattacatctggtactccagacatgctctgagtgtcacatctgctctggatctgctcactgaagaacagattgggcccaaccggctcccgtcctttcattatccttcagaccacctgtcactggtgtgtgacttcagctttaatgaggagcctaatgaacttttataaacactgtcattttaatcatgagagtcttaaccagggatgttttgggaaactgaagtatgataagaagttgcctgaaaaaggacacccagtttctgccacttcactctccatcattttccagcatgccttggaaaagaatttgttcacaaacctttccaattaaaacctgcagcaaaaagggtacttgcactccactttgggcttgtattgttgattttccataccattctccattctcatttaagggcattaaattagacttacttggaagttgtttttgtttttttgtgtttttaagttgagggtgctataaaactcagtttgtaagcccctcagaaataaagtatgatataggaagttttctagacaacatttcaagttatttgtgggatttttaaatgtcagcaagaaatgcatggcaatatttattttttatatcttcatgtaaaattaaatggattatatagcattttaggtaacttagcacctggcaggaataggcataatttccttaaaatttcaaattgtttttatttggtgatctaacagaatgtacattaaggaactatattttatagctctgaggcatttgtgactttaataagtacattattcacagataatcgctgctgtttgctatgcctccaacttatctgttgtgtttcctgaagaaattccagttcgttttcaactaaatagttttcgctatttagtcattgttaaatatttgtacttttttgttgtacatgtgatgattactccatgacttcttttggaatgtgctttttacaagtagctttaggaacagtggctaagaatagtagtaaaaattccttctgagatgaggactccagaaatcctattgagcagccaggtgtgatcaaaatctgtgtgttggaggccagcttagcctgtatatgaagacccattctcagaaaaatcccaaagacagccagatgactgggttcaaaatttctcagagaatttaagagtagaaatgataacctagagttctcttcgaattgctgaagcctgttcaaaaaaagtaaaaacaaaaataacccactggtggtaaaatggtaaatgttttattgtatgagttctaaatattatttaagattaataaatagacttataacagagtgcttttagtcttgggttttgtttttgttttttttcttttttcagtccaaaaggaagtcaatttggatcttgtggttcaaacagtatccatttccacactgaattttcattttgacacttaacagaagtagctacacattcaagcttctgggtatcttagtaaaaggatggagtcctccacatggcttactcctgcattctacctccaggtccataaatgatatagtggtcaggttagtctcctagagtgcttcagatgtttggaggcttgatgtaaacacactgatactcaccaagggccaacagcactttactacaaggcccgaattcatggtctctgaagttcctatagaatgtgataggcgttggttatgggacacagtcaagtcacaaccatagagcacttggtataactgaagtttaaagcagtttaggagctggagggtaactcagataaggctccaggatgatccccagcaccaggaaagacaaccaaccaactagccagcaggacatggttgtgccctgggaaagtagaggtaggaggtcattctcaactataaagcaagtgcaaggccagcctaggatatggaaaccctgtttcaaaagccaaagtaagtagttgttcaacagagatttgcactgtcagaggctcagccactagtaatgtccttgtgccctaccccttactgtctttggcctatttgctttatcctccttcccttaacaccacctttcttgagacgatcttgctttttgcccaggctggcttggtacttccagtgtagccgaaggtgagaagtttgcaggtctctttgtcccaatgaagttacttcatcttcctgactaagaacacttgttctttctagttactcttcgcaacctgcctcagaattttccagtccttggcctcactcaaggagacctttctccacctgactaaggtggttcaagcctacttcaggggatttttgttttgatgtttcttaattccagcccaataaataagaaaacaggtggaggagatgccatggatagaatagcatagtgagaaaatgtgtgcctggaatagttgggacactagcaaagaaatgggcttgggtaggtgggcatttcaagtaagatgccattgaatttaaagcagtaacacaaatggtgtaatgaaattcacattttccttattttggctttttggcccagttttagcccaggctgacctcaactctagcttcctgaaatcttccagaggctggggaaaaaggatgatgagttttctgaaaccctaaaccacatagaccttatcagaggtaagacatacaagataccatcaatagaagtagaaaataactacataataatggagtgacacggcatctgagacagcctacagacccctggtaggtgttatagcctattagcactaaagggaacagaatttaatccagcactcaagaagaactgtgatgggcaattaaaatgatctaagatttagactcaaaatctagaccaagatgtggtagaaataacatggcagctatctaaagaacagctgttataatgaaatccctttaaacatctgcttgtacatcagacactaactccttccaacctctgttggaaatccaaaaacatttaggctgagaataagccaagcatgtcatggaaaaccaaaatggctttgagaagcaaactaaggcacaagatgagatgggcaagaggaggttgaagtaaggggctagacagaaagctcacaggtttaagagcatttgctgcttctgcagaggagtcaggttttgattttttttttttcctttgttttgtttattgtgaatacaacattctgcctccatatatgcctgcacaccagaagagggcaccagatctcagaaggctcagaggttaagagcactggctgctcttccagaagaccggagttcaattcctagcaaccacatggtggctcacaaccttctataatgagatctggtgtcctcttctggccggcaggaagaacactatacataataagtaaataaatcttaaaagaaatggagaaattctgaatgacagctgttgtttggaccaaggatgtgtgagtggaaagcgatgcttatgaacaggaggcagctccttcctgaatcagacaaggatgtctgctgaggtgagatcctctgtaacaaagggtccagccaaggggattctgtagatgtctcttgatgatgtggagagaagtggtcactgaaggctagaactgctactggagtggatctaaggattaaacacaagctgtttgttcatcacagtgcaaaggctggagactctggaagacgcagtgacatcaagccattgtttttgtagcttttctctggaaatgctggacacaacgtgtaacctcattatattgacttactgttctcaaagaatgagtttgcaagtttagattttagatgtttacctgaaactttttctattgcttttagaataaaacacagaaaaaagtatgttacaattgagctgttaaagactcttagcaaaggtaaccaaaatctgtatatgctctgtgtgggtcaggattggatgcagttatgtacagccttttgaaaaatgagttttatggaagatctgaccaaaaattaactgtacagtattgattttgaaagatgaaatacttagggtagattttgaggttaactctcaatgggaaaaggaatcagcctagactcttactttttttttttttttttttggtttttcaagacagggtttctctgcgtagctttggagcctatactggcactcgctctggggaccaggatggccttgaactcacagatctgcctgcctctgcctcccaagtgctgggattaaaggcgtgcgccaccaacgcccagctagactcttacttttaaaagtaccattagataagtttgtggggtagaaaagagatgtagccaggagagatggcttagcaggtaagagtgctggctgctcttccagaggaccagattcaaaacccaaaggtcagctcacaaccacctagagctccagttgcaagtgaattggacacacacttctggcctcctggggcaccagtacagtgttaagtgtataaagccatacatgcagacaaaacacccacacacatatttttttttatcaatttagttttttttttttaaaaaaaaaaggttagaaagggaactttataaaaaatctttgctgatataagtagcatcgtgttagatatacaaaggccaaaaaatattaaacagttcatctaaatttctaaaaagatagacctagttatgtatgacagtaaggagtttgtgtgattctctggtgcctcagccttcaactgtaaaggctggacttactttctacccataaaaaggtctgatggagaaacaaatggtatgactgaaaatgactctgtgtatgtgaggtgccatgagaaacccaggaacttgcaaatgccaggcaagcagcctaccactagtgctgaaagtgcttccattaagtatggccaactaaaacactacatttgttaagtaggcaattatagttataaaggaaatgggggtgtgtgcaggtagttaccaaatactagtataatgggacaaaaccagagtagcatttcttcatgtagtaattaagaaaacaccagacttctatttgttacctaaaacgacaccctatactggctttagagtgttgtaaaatatcaccagagaccaaaccacaagataaatttcacttctatatttcagaaaacctacttgaatacactttgaaacaagagtacaacaaaatagaatatacttcaaatgttgaatatacaaactattatagttcaaatctgaacactggtactttccctcttaaatgtcaactaaaaaagaaaaagagaaaaaaggaggaaagaaggagaaagaagaaaaaagaatgagaaagaaaacaaacaccaggtattagagctacctgacgagttcatgctgagtctgaatttcaaaatgacaggagaactgatactcatgtgtctgcaagacgccagggctgacttgagcgacgcaggtatgttacagtaaagggccagagccaacagttaatttcttcacaattaagaaaccaacagacttaaactaccatataaaatgttacatgtaaattctataacaatactgtgctaggtacaagatttttaaaattttttcctttaataaaaaagctttacacaaacaagccattagcttatttcaagaaagaaaaccgaaaattagtctaaggcctttgttttaaaacagcttaagctatatgatatatatattcaaaacaaaaataaaacaagaaaacacactagatctttttgctatcctcttctggagcttttggatccactcagttcacattctagaatacctatattagcagagtcttcacatagcaccagttaagtgagtactgtgcaaacacagtaataattgctggtatgcatataaaatgcatcaaaaattgctatatgtaacaatgagatcacccatcccaatcccgccccactgaaaactatgtaacctcttacaggtgttagtgttccaactcttagtgtaacttgatattgtagtgggctgcttggtccctttcagtcttttttcttgagggttcagtcgttcctagtctaagaggcagttttctgtcagcatctcaatgtatagttcacttcccactgaaacatgggataggtaattatttccagtaagtctgattgctttcttatatgcacagctgttttaaagtcctctggcttttcttgatgacttcccttgcagatgtttgtcagcacaacactaacagtctgaagtccatggcagagcctgtttatttctcacatgtcactagtccttcggttttcatagtcacaggaagggcaatagcagaaggtgcactgacaaccactacatgggttactgtcttattcccgtctgctcccttttcttctaccagctgcaaagttttcacatcatgttcctgcttttttgccactgcttctgatttaacctctggccctttaataaccgcactgataactcgaggaggagtctggccagaagcctgttgagcaggcacagatagtctcattacaggagtaccgtgggctattgaaacgggggtaagtgctctcacagccaagggggttccaacaatgttaatgcttcctgatccagtcagattggactttgtctgcagctgacactgtgcaagctgtgtagcagggatggtgataattttggcaggctgcatggtgattttgtctccattttcagcagaggctggcaccacagtcgggatcgtctgaatgacgacttttggagaggtggctgtagttggactggtgctggttattaatggtgcacctgcattgactgactgaactgccacagttgaaatcttctgacccagtgatgtcattaccacaggaacttgcattgccacacgaactgtcctggtagataaaaaacaaagaagttggttatattcaatactaaataagaaaatgagtttcatgttaaaaagtaaatacaaatacaaatgtataaaaccagtgccaccaactttgacagttgtagtgaagctgagaagaaaaatctcctgctccctactggggtttggacctggtgtctcttgcatgcttatcaagtgccctaccactgagctgcatccccaactttttgaagcagggtcttgttaactcactgctagcttagaactcactctgtagcacaggcaggccttgaacttgcaattctcctgtctcagcctccacagtacttaggactacagatgtgttctactatgtatagataaaagtatatttcaaaaaaactctagcactttaaaaaaattttcaatttttatgtgcactggtattttgcctagatctgtatctgtgtgagggtgttggatcctctggaagtggagttacagtcttgagctgccatgtgggttctgggaactgaaccctggtcctctggaagagcagccaatgctcttaactgctgagccatcattccagccccaaaatgaatttttgaaagtcatcatacaatgttggctaatattgactgaacaaggacagttcatttgttccaaggagcatttaaaaacaaaacactgtgtgacagttaaccacctccctcaccttggagctgctgctgctggcacagatgctgtggtggtaggagacctggatgaagcatcatgagcaggggaagtgatattcacaactctagccacacccttctctgctctggagcagtttacagatgagttttttccaccacgaacagaagtcgctgctttgaggaggctttctgcagacaatgacactcgttctaatgacttttcatcagcggctgctgccaagtcttcactgcaggtttcacttttgtcatcatcaatgaccactatgtttttgggcatatccttgaactgatatacaagcctctgtccttcaacctttgcaagaatccccctttggtagtagtatctgtgaagggaaaaatgacttagtcaattttctagcgacttccagattaaaaaaacacaaagcaaacactgacagacatttacttattcctgtagatgagtggcccttctgcttggacaactcggaagattataaatttggtgaggaagtgaggttggtgtgtcgtgccacgggccagtggtggttaatgctgactgtcaatttgacaagatctagaagcgtgtaggagctaacttgctgggtttatctagattagattagctaaagtgggaagacccaacatcactgtggggcggcaccatcacaggacgcagtaagtagcagcattcatctgtggcctggctgcggatgtgatgtgatgcctaccgctatgaattctccacccttcctagagtactgtgtcacaccaatgagaaggagctaatgcagctctgtaaccctgacgtgtacaaagaagttgcggcactgaggactgaacctagagactcactactaagaggaaaggctctattacccagcttttcacccagctttatctccagcaccccaccacctctatatagaccaggctagtttccaatactagactgatcctttttatccccacctcccaagtaataagatcacagtatgtctgccatgtacatcttgttctctctttttttttgaaaaaaaaaaaaaaaaaaagattgtatctattatgtatacagtcttctgcctgaatgccagcagagagcaccagatcttattcaaggtggttgtgagccaccatgtggttgccaggaattgaactcaggacctctggaagaacactcagtgctcttaactgctgagccatctctccagcacccaccttgttctctctttagaaaagcttagcctaaacccaggacactttattgacaccacaaagaactctgttacacaacaaataatctgtctttatttggaaagccacctcacccatgtttagcagagatgcaatctgtggaatatgtgaacagtgttacataaaacacaatgtaggagtggcttatgcctgaaatcccagtattgggaaactaaggtaggaaaattgatgcaagttcaaagccagcttgattatataagctccaggccagcccgggctacataccaagacctttctcaaataagtactataatgtatacattggagagttaatggatttttcatactgaccaaacacaacaaaaatttttcattatcaagacagtcatttacaacatttgcagtaactaaaagcaaattaatgttggaaaatgcatttcatttagggtttcttataggatctcactctagcccaggatggcttcaaacttcctctgtaaaggcagatgactttgaactcttattttcctgtcttcggttgccaagcagtagtactgcaaagcatataccagtacatccagtctgggtttaatgttttaaaaggcttacaatgtaacaatttctattacagaactgtcctaaatgcaataaatatggatcttctaatattgaaattttatgcacgtaaaccaaacttctctttccctgtctatttccaaatctaagaaattcttatagattgttcacccaactttaacaactagcagacagtctaaagagacatgtaagttctatttaaaaactagtccatgttcgttcttacctcaaagctcgccccatagtttcatagttcatatctggtttgttcttatgctttccccaaagctttgagacagcctttgagtccacaagtttgaatatgcccttttctctctgagtccatttaatatacctgggacacgtatttttatcttgaagtagatctaagagaaactcccacagataggttgtgtttccttttaaaacaaagcaaaaacaatggtaggcattaatttattatccattaatatgattacttgcaagtaaaatatccttctttgctgcttctttttgagacaaggtctcattatgcagccctgctgtacctcaaacttgtatgtagaccaagctactcttaaattcaaggccactgcctcccaaatgctaggattaaagacctgcaccatgcctagactacatgcctgttcttacaaatctatgcttttctacaaggaagccgatagaggccctagattctatactgtcatgtgtcctgtatacaaggcttcaggttcagtaaaggcaacagcataatatttagtgtaatacattgctcacctggattacacagaatcaactttcttaacttataggcatttaaactctgaatataataatctggatatataatctggatatgtttgatattctcccccaagtcccttaaaactcatcagaagtcactagcctcttctttaaagtggctctacatgaggataagtgctattaaacaaatgtcccctaaacagtggtccccaaaaacaatatggtttgcactgtcctactatagactatcccatctcttcaagacatagtttttttttttttaaagattttatttatttattatgtatacaacattctgcttccatgtatatctgcacaccagaagaaggcaccagatcgctctacagatggttgtgagccaccatgtggttgctgggaattgaactcaggacctctggaagagcagtcggtgctcttaacctctgagccatctctccagccccaaaacataggttttgtttttattttgttttgttttttcctgagacagggtttttctttgaagccagtcctggaactcactctgtagactaggctttgcctcgaactcagagattcacctgtctctgcttccctcaggctggaattaaaggcgtctgccattaccgcccagggagacactggtattttgatcaaagtttcccataatgttggcccacccttgattaagaaatactgaaatggtactcccatatgcctgtctactagaaataacccttcttacaattgcaaaaatgtcacacacacaaaagtatcttacttgcaaaacaaccctccacaaattaccttttccttctctggctttcttcttgattcctaactcaggagacccattggaaactggtgactgctgggtctttggttttcggccaactgaaaaaaataagacaacgaaatcattaactgaaaacagatataaataccagactctctaaaacacttctgaaattttaaataaaacggttggtagaagcttgactttacaaagtcagtaatttctctaacttccactatatagtcagataagcctcaatctgctacattttctgactgctgtcctagagctcacaatgtagaccaggctggcctctagctcagatactactgcctttgcatccaagtccagggaccaaaaaggtgtaccactacactcagctgttagacaagttttttagtatggtatttttattaattcttgaagaactttatacattcatagaaagtataatttgctcatactctccctcgattcacctatgtacagcagaggatctgatcatgtgaagctctgtgagctcaaatgaacaaaacgtgaaacatcacttccattgtgagccaggaagttgaccagccaattttaagctaaagtgttaacttgtcaaccaaaaatgctgaaaataaaacacactcctacaaatgactatgcatgtcctgagtattgagattacaagtatgtcaccttacactgtctactgcattttgttttcttcaatgttgattccctaagagaaaacatggtgtttgttttcctaagtctagttgttttgcttggttccacccattttcctgcaaacctgactcctttttcagagctaaattgaaatgtgcacacacacatacactgtggtagcttgaatgtttaattggccctccatatgtatggagtgtcattatcaggaggtgtggccttgttggaggaagggtgtcaccttgggggcaggctttgagatttcctatgttcaagataccacccattgtctgagactacttcctgttgctttctaatcaagatgaagacagcaccatgtctgtctgcatgttgccatgaaccctgccatgataatggactgaaccacagaactgtaagcagccacatcaattcaatgtttttctttgttgccgttagccaggcagtggtggcacacagctttaatcccagcacccaggaagcagaggcaggtgagttcaaggccagcctggtctacaagaactagttccaggacagctaaggctacccagagaaaccctctcttggaaaaaaaaagaaaagaaagagctgccatggccacagtgtctcttcactgttgttgaatagacgatttgtttaactatgtaaatatgtgttgcatttgttcatgtgcatttgcttaactatgtaaagatgtgttgctgtttcaccttgcctgcctaaggcacctgatggttctaataaaatgctgaatggccaatagctaggtagaggaaggggaggcatggctgctgagcagaaagaaaaggggagacagccagacacagagtatgcaggaaagcaggacaggacagacagtataaggataaggtaaacgagattccgggcagcacatagcttagtataaatgggttaagttaaaaaaaatgacagaactaacattcattatatattatatgctgacttaacattcctccatgtatatatgactggtatagtggatcatatcataaattctatttacaactttgaggagtctgtaatttacattactaccaaaggtgtgcaagtgtttaattcccctacccaccatggcccattcagatggtgtttttgttgtttttaattgcatttatttgtgtgtgtgcctccaacaaagtgttatatatgcacgtggacatcagaacaatttgtgggagtcaatcttttccctctaccctgaggaccccacggacagaactcaggttatgaggcttgctggtaagcccctttacatgctgaggcatcacaccaatccttgtctttttcttttctttctttttttttttttttttttttccctgttttggtttttcaacacacggtttccctgtgtagccctggctgtcctacaactcactatgtagaccaggttggcctcaaacccagagacccacctgcctctgcctctcattaaaggcatgcggcaccactgccctacttggttttttgttttgttttggagacgggtctctctctgtagctctggttgtcctggaactcacactatagatcaggctggccaccaccacctggtggtggttttcattgtttaaaaatagacctcaggctggcctggcaactcaacttccagcagtcctatcttagcctcctatgtgctaggatcacaggcatggacaccacgcccactcagttgtcttgatgaagattagacttcattcattttttttaagattttatttatttattatgtatacaatattctgcttccatgtatatctgcacaccagaagagggcaccagatctctctacagatggttgtgagccacatgtggttgctgggaattgaatttaggacctctggaagagcagtcagtgctcttaacctctgagccatctctccaaccctatgacaaagttttttagtgggtagtgaacaatagaatatgctgtagtggaaggcactgtgttatttcaccataaaatgcaaacaaagaataaagaaattacaattacacatttcccaccatgacagactcttttccctctgaagttgtaagccaaataaaccattccttctacaagctgccctggtcgtggggatatttaattccagcacttgagaggcagagaatgctgggtatctgtgagttcaaggccagcatggtctacagagctagttccaggacagctagggctgttacatagagaaaccctgtctccaaaagaaaaggaaaaagaaagaaaaaaattaaagaaaaccacccaaatcaaatttaacccttgatttgaatagtaaaggaggaatgcattgtattcccatgtccttgtgttgtggcaggtgtgctggccccctatgctttacccactactaggtttatactgagaatcttagaggtttgtgtttgcttgtttaatgtatacagatgttttgtctgaatgtatgtctgtgtaccactttgcatgtctgctacccagaagaggtcatcaaaacccatgaaactggagttaaaggcagttgtacatcagataccctggtaacagatttgtagacagctatggactgtcatgtgagtgctgggaaaataattcaaatatctagaaagcgccaggtggtagtggcacatgcctttaatcccagcactcaggagtaaaaccagggctgttacacagagaaaccctatctcaaaaacgggaggaaaaaaaaaaaaaaaaaaacactaaaaaacaagtttgaatataacaagaaagttcctccaaagagtttacaatctggaagaaagataatctgaaggactttgcacatatgtatgtatcgctgtgatgtgtatatgtatgtatacatacacagcaattgggggaattatatacacgtgtgtgtgtgtgtgtgtgtgtgtgtgtgtgtgtgtgtgtgtatgtatgtatcagcagcaattggggtatcttaggacagctgatcccctgcttcagtctccaattagtggtgattatagatcagcatcaccaggactggctacaaatgtctttgaacaacattaatatttttttaagattttatttatttattatttattatggatacaatcttctgcctgcatgccagcagaaggcaccagatctaattcaaggtagttgtgagccaccatgtggttgctgggaattgaactcaggacctctggaaggacagtcagtgctcttaaccgctgagccatctctccagcccacaatattaatattaaagtacaatcttagcaactcaatttgttctgtttctgagtctagttaagataacattaatctgcaaggagtggtggcacacacaacttcagccccaatactcagaacgcagagacaggcagatctctgtgaattcaagaccagcctggtctacagagtgagttccatgatagccagggctaaacagtgaaaccctgtcttgaaaacaaaacaaaacaaaaaaagatttctcatatctgataagtatactcaaccttttttctttttcgttggttcgtggctatctggtgaagtgggaataggcgaggcatccattggctcagactcttccgttgacacctccactacagtctctgtaatgacatctggcctcatcgcagcatggataaactctggagttgatatacaaggagggacaaacacttccactataaaaaaaagttgaaaaattaaaatttcccacccctattacactttcctatgtggacagttcaatatttcgaagaggcaaggtttactgaagaattattcaaaggaaggtgagaacttctgcccgaagaaatccacttactgaatatccaaaactatctaaaatacacaagtgaaagacaatcattttggcagtaatgaagtcaacctctttttcatacctttaggcactttttaaagatttatttttattttatgtgtatgtatgttttgctggcatgtttgtgcacttgagtgtctattgcctccaaaagccagaagagggcatcatatcctctagatttggagttaccctgtgagtgtgaaaaccaaacccaggtcttctgcaagagtacacagtgctcttaacccctgggtcatctctccaattccatttcaacttttaattttatattattttaatagagaaaatctaacaaaatggtcctttaataattactttcattgcacatatctattactattcattaactgggaaatacaaggacaagatagaaaattttaaaaattataaatgctaggcagtggtggtacacacctttaatcccagcactcaggaggcagaggcaggtgtgtctctctgaattctaggccagcccagtctacagagtgagttccaggacagccaggactatttcacagagaaaccctgtctcaaaagaccagacaggtaggtagatagtcactaaaatagtacatacagattgctatctggtattctattacatacaataatgttgcttcaacttccaggataccacatttctatttcaaatttggagatccagatactgtatgcttacatgcattaatatgctaccaacaaagccactgtttacttctcatatccatgaagaatgcagtgaatttcttaatccaatttttaatgattttggctggcttcaggaatgaaaaaatgtttaagagcactggctgccctttcaggactggaatataattcccagcatccaatggccgctcacaaccctctgtaacccgctctggcacccatgggcatcaggcatgcacacggtgcagacatgaatgcaggcaaacacccatacacataaaatacccttttaaagatagctgctgttagcaactaactgtaaattcctgcacaacgaattaataaaattagaacagaatcaaattagtataacaccactattaaaatcaacctaaaaggaaaaaaggaaccttatttcacaatctaaaaggaatatgaagcaaattcctttccctctctaccattgccaggtccatgttgttactggctgttgatcaatgaatgggtaaaagactgaaagagctataggaagcaaatggtccaacttgtgcaactcttaaagattacaactactaccttacaatttatccagaaccaagcaaataaacatgataacatacacaactgtctaatagaaaattgtgggcatttctgcattatttattaggacattaagtacagtatttaagattttagaacctttaacatcagttactgatatcaggtgtttatgtatagatctttaagaactccaggaatacctcctttgcagtaaagtcttcattctaataggaaacaatgtgacatttaatttaaaaatgtacagatcacataccaggacttcttgactccctcaagcaggtaggagattccatatgaagcagggcttcagcagcttcaattgtcttatccgtacagtgtgcattactgctatgaactgatgcttccactgtggaaaaaaagaaagttctttattaaaaatgaaaacactaacaacttattactgaattataaacaattctatataaaccaatgactacccattcattaactacttactaaagtaataaataataaagctaatgtctacacactgtaaagtgaatgtttattttaaaaacaaccaatgaagatgggcgttggtagcacacatctttaatcccagcactcaggaagcagaggcagggggatctctgtgagttcgaggccagcctggtctacagagagagtgccaggacaggttccgaaggtctgggcagggaatggatttgaggatatcctgggctacatataggcagactctatctcaaagccaaaaacccaacgacgctaattaaaaattagtgagaagttcctggatcttaaccaaaagaaaacaaagaacaaaccttgaaatataaaatttgcatccatttttagtccaaattggattgagataatcacccaaaagggtttggaaacaggaagaaaacgaccccataggtcaattatgtaatctgatgtattgtcacaaaactgggggcaatataatagccaacagaaatcagctagaaacattttttctaagctagcctaatgaattgcttcaatttttatattgtgtcctgtgagtggacactctccaggcaaggcattaattttactgtcacaacatttcataacttgtttcacaataaccttgttcttttcagaatttcaggggacttcactaggtttttctaaaagaaatgtacatacgtggatggatgaacagatggatgatcttacctgaaagccattcctgattcaactgctcttcctatctatctctcttacacatctttcatgcttttctatcaaatggtttgtcaaacagtgaagtattcaagcagaggtttgcactttcaggtctaacagcttaggttcttagactcagccactaagacaatccacttaagtctctgatgcctcagtttccattttatagagcaggacgatttctacaaatagttgtggaaaacacatacagtgtctggcatgaaatgggagttcagtatgatgacttctcattcctgtaaaatcataagctttgcattcaaaacaggttttgtttagttttgagatgttgaggatcaagcccagcacctcccacattgctaggcaagtgctccacctctaagcagtgtatgtagccctagatttttcaaagaatacatgcatttcttttatgtagcaaattaaagacaatcccatgatcttataaaagaattgccaaagaactcattatcttagtcatacatttatttcacactgacttatttgtatactgaacaatttatgtgattagaggttctgaaacataaataacagattttaatttgactgtttttctgaagatgttctccttaaggagctttgtgaatgttcacacagattcaaaaggccacgccaaattcacaagtacagacatgatcttctaaagcctgtctcaagaaactttaattgtaaaagaatcagttagaaccttcaaattcgccaaatgctaaaaccgcagccttctaaaacaaagtcatttggggagcatttgttttaaaacttcaagcctgttttagcacctgttacacaccgtccacactctcaaggcaaggtactctggtctctccagctgctctttccatttatggaaatctgctctaagctaatggacccggagaggcagccaaacctctaagtaattctatctttaggtgaccctgcttactcttatctgcagctccagtgaggcaaaggattcacccagcgtctagttcagctttaaaaacttagtagtaagtatagaggacaccgcccattcttgagtatggtcttcacagagccctataagactcacacacaataacaactctcagaaagcaaatcctcaggttttaaacatcaaaccaagagccatgtctttatagcgttgtaatttagctgttgtcttaggtgctattaataaactatcctgggtaagcgaattccttatgtaacattatgaagatatactctaaaaacggtacagtactacagttatagtttcaagtatttaacaaccatagggcaataaaattacatattttaaaatatttaagttataaacaataacaaccacaaaaatacttgcctaacagttatatattgtgttccctaaattcttaaatagcataaggtgcattttcaaaaccattatttcaaattagtacaaattaatcctgattctgttctggtctggtttgttctagaggtggagtctcatgtagcttaggctggcctggaactctagacatggcagtaatcttgaacgcccaatcctcctgcctgtgctccctaagcgctgagattacagtgttctaccacattccaattagtcttttaaagtgcattttcttgcttctacttctgacctcaagcttctcttctccccccaaaatcaacaaattataaccccaaaataatttactagtactttaaatatccataattttaagttgccaaatagaaaacccaacgttttaagtacagtcaggctgtgtcagtcgaatgtttctcatgtgcccagtgctgtgcttcagaaccaagttttgtgctgaacagggcttctgcctcctgcaacttcacattcagagtgccatcaaaacccaattgtaaatgtaaaacaatcacattactctgtaatctaccagcttgctaaagagagcagtgctttttactttaggagcttagtttgtctgcaactcaatgctaaacataaataaaaatctaaaagcctagcgtccaatgagaagttccagaatattttactcaatttataaagtatctatactttataaggagtatctatactttgttgacctaagtcaacaggtgatttttctaaaacaatctttgatagcagaaatttacagattgttgtgagccaccatgtagttgcttggaattgaactcaggacctctgaaagagcaggcagtgttcttaaccgctgagccatctctagcccatagcagaaatttcatacctctccatttctgtaattttgaaaatttcaatgatgttttattcagttttattataattatttataaataattcttaaattatttataatttaagaaattaaaactgcatatttctaaagatataaatatcaatttaacagggccttgcaacctaaaagcaacatctgcaaataaaattccttcttactactttccagacaagaatgaaatttatggtagaaaatccgcaactcagtttaaaaacagaaacaaactagtaagtaactggacaggtctcatttttctatcagttgaactcctagccaagcctctgtgaagtaatgtctcaaatacatttcaaagtgattgaattcttatcaaaacaccatcaataaatgtggtttgtgctgccatttactgtgggtaaatatgccggctccatctccatctctaatcagctggtgtttgtagtacactgctccagactcttaacagctgttacaaaataccaaacttggtaattaagtctgacaagaggcatacctcccagctttgcataagagaacgctggcaatggatctagttcataacaatgttctcaagtcagaaataaactttacaagcaatagagtttgagagcaatggaaaaatgagaaatacttcagtaggtgttagtggttttctcctaaacacagcgccataaactagtatttccaaggtcactactcaaccttgcactgaccgaccacattctctaatgtcccagagctctagtggggacagagcagaccactgcaatgaagaagagggtctattatcgttcaccattaacatctgtctcccttgaccttcaatcaatatagctctgtaagtacaaaaagacaattaaaattactttctaagccaaagttatccaattaaattaaggccataatttgaaattttctcatacccacattttaaaaagcacaaaattggtattaataccttttggggagggcatatccactaagctacaatctgaaattaataccttttgtttaacctaatattgtcatgtcagcatgtaattgtaataaatataaagaacttttaaaattcaactttccagccagatctcaagtactctatacctacaggtggctagtggctattacaccaaatgacaacctaaagccattcttaaacttaactttggtcagaagacacttctgcattcaaattactgagaatctcaaaaagacttttgagaataaaccttatctacagatagttattgtatttgaaaaataaaatttagccaggcatagttacttcacgcttgaaactccaacatttaggagttttagtgtagccagcctaggctagcacaataaacaaacttttaacctcaaaaagatttatttacccatttacaatatacatggtacttagatatgcataattatgaaaaacaaaataatcttaagtagctttacaagtaagtgtatgttatgtataaatgattgcatgtattgggtatgtatgtatatatgtatgtaggtatgtatgtatgtatatatgtatgtatgtatgtatatatgtaggtatgtatgtatgtatgtatgtatgtatgtatgtatgtatgtatgtattagaggcaggggttcatgaagaattgaacccagggcctcatatgctaggcttctactaatctatatcctttattttgtttaattttatttcagaaggggtgtcatttgtttgcccaggttagctttgatttcattccctagcctatataagccatgagcttggaataaccctgtctcggtctccagagtagctggggttacaaacctgtgccactaagtccagcctgctttatattttctgggaatcttttttaaatctttattttgtttctgtacactctggaaagcctcccggaatctctagatcagtgtgctgcctgtctttctctaatattatttgtttctttctttctttttttttttttttttttgagaagaggtttctctacataacctggctgccctggaacttgctctgtagaccaagcaggccttgaactcagagattcacttgcctctgcatcctgtgtactgggattaaaggcatacaacaacaccacaagtcccattatctgtttctaaagaaaactgctttgaattattgattgactttataccctgacattacttggtaactcactgatatataatgttaataatactagtattacaatgaattcaactggtaatttctttaacaaatcttcaaaatgaatttcttttctatactggagatcatatctagggccttacactaaggcatattctccacctccagatatttcttttaatgtgtgcatacacaaatatgtgtggggacacacatgccatggtgtgtgtgtgtacatcagaggacaacactggagttctcttcatccaccttcatctcactcctaaagactgaactcaagtctccaggctggccagacttcaacccctcagtcatctagcccacagctaggtctaagtgtctggacaaaaataataataacaataataatattaataataatgtcattcttttacttttatttcaacatatggtacctactttttctttctgttgtttttttttttggggggggggggtcaagacagggtttctctatatagccttggcttcctggaactttctctgtagaccaggttggcctcaaactcacagagatctgctggactctgccttctgagcgctgggattaaagtcatgtgtcatcaacagccagccctactttttcatataccctacattttatgattttttttttcaagactgataacaataagatccaaatctgaacttctgaaatgctttggagtttgcatatgctgatattccaaaatttagagaacttggtaagtgaaacaatcctgtctcaagtactgtggatatgagataaccaaccattactagagatttcaattttaagtacatgagaaatgagacttctgatgagatgactagtgccgatgtggcagctcagcaggaagacaaatttggtacccagcacccaaatgaagtacccgtgtaacaagccactgtaattccagtgcagaggcagagacaggaggatctcagccacttcctggccagccagtctagctaaatatgaaggctcaatgagaaattctgtctcaaatacataaggcagagcgattggggaagatgcttactgtcaacctccggtctccattatgtacatacattcacacacagagagactattctgtatttccaaagaaaaatttcctcttcatttaagaactgcactgctgcaaggtggtcatggcatttgcccatattcctagcactcaggaggcagtcagtcaaatatctgagttcaaggccagcctcatctacaaagtgagttccatgacaggaaggactacagagaaaccctgtctggggaaagacaaaaattaaagagaggaagggagggagggagggagggagggaggaaggaaggaaggaaggaaggaaggaaggaaggaaggaaggaaggaagggcaaagaaaatgctgaaggaaggaaagaagggcaaagaaaatgctgatgacctcccttctcaaaagaaatgggaaattaatgtcagcacttaggaggcaaaggcaggtggatctctgttgagtttaaggccagccttatctacatactgagttccaggacagtcttggatacaataagaaaaacttgtcttaaaacaattaaaagaaaaaggaggagggaagaatggaagacaaggagaagacgtagtcaatgactgcacactttggaaaaaagcagaatttttttgttttgttttttgagacagggtttccctgtgtagcctgtcctggaaccagctcttcagaccaggctgatcttgaactccacagagatccacctgcctctgcttcccaagtgctaggactaaaggcatgtaccaccactgtccaacaagaaaacataatcttttaaagtgaaaatcttctcccaaatcaagacagtgcatacagtatatgttcacagaaattattaggaaaataatgtcagacatttgtttttcccttattaatacacacacacacacacacacacacacacacacacacacactcacactttctctctctctctctctctctctctctctctctctctctctctctctctctctctctctgtgtccagaactgagcctcaagtattaaactacatcaaatacttcttgtgagttttcaaaggctggctaaaagaaatgaacctttatgacatactcacatggtacattttctaaaatctcttttaaaagcaagtcttacacctttacccttacatgaaatgtgttggaccactcacaattttagagctttaaaagtactcagacatcacctagtcaaatgctaaagaagttaggaggttaggattaaggttaaccaggacatagctttatcagtagccaactggagaacctcaaccctctgtgtcatggttccttaagcaagtttgtaaatatgcagttctggctagcctgtctacctctgcctcctcagggctggattaaggaaagcatcaccatgccccacccaaatgcaaatttagtaagaatattaagtcttgactacaaaacatttttaattttaagatgacactaatttgctagaagtttatttcgattatttagtcactaagttctttccaagtgtcactcattttacataactatcaggtaagtactacaattattataactactttttcatttgtacattatataaatttcatctgcgtgcctatatctgatgaattctttcaacaagataaagagatcattacatccatttacttataaaatgtgcagacattagagttggggatgtagctcagctagcagagtatatactgaatccaccagcacacacctgtaataaagcatccaggaggagcaggcaagagatcaaggccagcctcagctatatggaaagttgaaggccagtctgaggcacttgagacttgtcataaaaacaaaaaaattgaaagcattactctaccagtgccattaaaaactgtcagcaataggagctggagagatggttcagaggtgaagagcattagctgctctaccagaggtcctaagtacaattcccagcaacgagatggtgaatcacaaccatctataatgcattctgatgccttcttctggcctgcattgcaggcatacatacaggaagaacactgtgtacataataaataagtaaatctttaaaaaaaatcagcaataaaaaaattagaagcataaaatcatattttttaaaaaaaattcttgttttcttctccaggttttaactttgagtataccagcaaatcctcttaagtttccttctaaaagcctgcagagacattcaggttacatgaacatgagaggcgaaataaaataattatgtataaaacagtctttcatagcacactgtgatttaaaaacctttagttataagattttgagagcagtactcaaaaatcaagtagatctggaaaatggcatctaaagtcttagaaaaccagcatcagaagtggtgtagctctgtggtgagcacttgcccagcgtgccggaggccctggctcagatccctggcaccacaaaccaggacacctataaaaagacaaaaacatttattccaaagactatgtaatatgcactcccagcaaaatatctacaggccacattcagttttactggtaattccaaaggttcatggaaagaaacctcccacctgcagaattaagtcctgtgcctctacagtgtttctcaaggttctgactgaagaaactgtgctgtggttgcctcaagtattcacatgcactgaaaataacatctttggatttattaaattttttgccttatttacatgcaccatatgtgtgcctggtgtccatggtttagaagaggttgtatcccttggaactggagttccagatgattgtgagcatgggtactgagaaccaaatctagatcatctgcaagagcaacaagtggtcttaaccaatgagcacttctccagcccagaaatgtttgtagtatctcttgaactatacacactccacacccaaaacaccactaaccctaaccttgaaaatgtacactaacttatactgaacaaaacaaggatccaagttctcactgtgttctccctctcattcaataatagttcttatccaaaagaggtatttaaacgccgctcaataaattggtatttccatagggaattttgacatgtgcaaaatataccacagactaaccacaccattgcgttatatagtacatatgcttccattagtccagattttatttgaatttaaagttctgttaaatttagggataaacatatgttgatctttcttctcaatcgaactgagtcagctttgttagccaaactatcgaattcaagatccctacctaaaaacaatagatgggaaagactgttcagatcttttacagcagtactgcttggtgactatttctcatcttccacatcgatgatatgaaacagatccagaaaaggaccgcgtgcgcttattatttcagtaagcaacaatgttcaagcagtgccacatcgacctggggccctcgctgcactgtctgctagcaagtaaagctgctttttctatgtaacttaagtccgtgcccttccgctgcagcagtggcgcagcacatcccccacccccgcggccacttccgtgtttacactcctcttccctccaattccatgcgtacattgtcagcttcactcccgcccaatcttcattggctcggctcgggcccgtggtcccgcccccagaaatcaacgttcttatttggaacatctcagagcgcagattggaaccgcgggcctgtcaatcgcgcgcgttctgtcctctcccaggcgcttccgctatggtgggaggtttggggggaggggaaagggggctattccgagccgagacttccctggggccgggacgccctcccgcccgccctgcatctagctttcacccactgttgacaaaaataaacgttccccctcactgtcccaaagccccgggtcagcagcacagaatacaccccgtgtccttcccgtcccccctgaaacacccgcctcacgagggaaggaagggcagcagcctagtttctacaccgccgccgttagccggggcagggaggcgccggctcggcgtcccgctcagcaccgggaagtggcctcaagaccgttactccggcgcggctccgtgaggctggagacaggaggccgggcgcgttttggcgggtagctcccggggccgcggcgtccatgcggaagtggccgctgtgtgaagtgtgaggcgagggcggcgggcggccagcgcccccagccgcgggcaggggcggcctctcggccggacagcgtggcaggcggcggggacaacagccccgctcacttcctggttccccggcaactggggtgaagcgcgccactcgcccgcgccgactccccaacttagccgcggctccgtgcccggcccccgccgctgccgctgccgcgctgcccggagcgacagccgggttccgaggcaggttactctcccaggtgatcacttcctgatttgtcgcctccattacttcattctctcccccctctccgcgtccgcccggctgactgaggcggacaccggaccggggccctgaccgccccgggggacgctccccgtctgccgggcgccccctcgtcggctgcaccgatgcaccggagaaaagttcccctgcgcgtaccggcccggatgagcagatccagctggttcgtgggtccctcatgcagagacgtcgccatgttgatcccggggctggaactgctgcttcacattgacttacaccctgaacagcggcgacaggggagaaagcggaacccgcggccggagacacacgccgtgcgggcggcacacactcacgcactcgcacacactccgacgcccggatccttgcgcgtcctccgacaggaagcggcagccggcccgcctcccgccgccgggctgagcagccccaccacctaacggcaggggcggcggcggccccggctggcaacgcgatccttccgccccgcgcccagacaggaagtcccgggcgccggcagctagcggccgcacggacacctgaggctggggagccgcaggccgcccgccctcggggacgcgggcctcggcaggaagaggcgcacttcacgttctgcggaagcgaagtctgcaaatgtcccctctggaaaagagccatgaatcaaatttttcttcctagaagcgacctaataatacctagtcccgcagctgtacatgaaggtggctttttaacttgttttggcctctccaaagcttatgcagcgtacaatcagttcagttgaaagaactgcactttaaaaactcgtacctagaaaatattctaaaaacatcactagggaagtcaggagtctccaactacttcaaagacgacttggtccttttctccacagaagtcagagtacagtagacaggtatttagtaaacaacagagcagtcagccagcctcagggagactggattaaagtcgctcagtttcctggtcatgaaattcgtgttccctctcttttatttggttcacgtggacaaatgaacatattcgttcatcttaaacatatcctaagttatcctttagaagaatcctgacaaatatatactacaacaggaaagggaaatatgcggccaattagtggctataaattagtggaaatggaggggatcagaccacataaaatgccaagtaagacctaagcaaaatgccttgcttgtttcataatttcttaacataaaaactgaaacaaaaatgttaccctgaaagttttccacacacaatgtaaaatgtaactcaagtagataatgcgttcgataacaatttattgagtaaataagcatcttaattgcaggattacaaattttatctgagttagctgcttatagttattttcaacagtaatataatacaatattatttataagtttacccaacaccactgcagcatcagatgggtttacttaagactgccatgcataggacaaaaggaaccagctaactgataacttttatttttcattgctatcaacttgaaataaggatctcccattgatgggcagcatctttagcagtttccgtatcaggaaagataaagaatactaaagggtaatttgttgactttaggtggctcgtagaaactggtaacaaatcagaatttctactccagtaacatattttccatgtatttcctatttagtacaaaaatgggaaccaaagggtgggtgggtgtgtgtgtgtatgtacgtgtgtgtgtgtgtgtgtgtgtgtgtgtgtgtgtgtgtgtgtgtaggtggcatgtcaacatggcttaaaaacaataaaacagtattctcaatataggattagtttgaagtctgatacacttttaccttactgtacttcagatatatctgaagcaatgtgaatatatgtatgtatgtaagcatgtatgtgctttgctggttgtacatcctaatcatgtatccatgtctagcttacattttaagcaccaacagaatagaagctatataccttcttgcataataatttatatacttaacacatacatacacagaaagtaacacaaaaagactgtaaaacacaacattccattatatttggaatgtataaaagcagaatccccaaatttagtacaagtctgccttgccttaaataggctttcaaaagccaccaatactttactgagaagaataagtagaataggctataagtagcatatatacgggcacaaactggcattatggtgtttaccaagcatctaatatgtatacctgtgtgtatatacaaatatttatcttcagttttcaagaatccacgatcaagcagttatttataagctggatttttactaaatatgaatgcataggctttgatggtagttaccttaaaataaactcaattctgctaataaaactacagaaagacaatactgtctaaaagttacttatgtcccagcagagagagaaaaaaaggtaaataccagatctgactgcttaccaaataaaagcctgaatgctaaatactttacctcatttctttttatgtattttgtccacatccctatataataggcattactattatgttcatttcattgatgaaacgtatctaaggatccttgcttaatgttacagttggttatgaaagggtcagaatttgaacccagtgtccttactctccaccatttgccaggaatgaaactaacatccctacttatctgtcacaccaattttctcattacaatttctttttgatagttcccccttaaagagatgtagtctagtcttcctctcactggacatattcctcacagctaacaaacagaataaagctgaagtgcctcggtcacaaaccctaaaaggaagccaaataccttgtcataaataacctcagcaggcctgtgatgttggggcaggaacaatagcatgctaccaacaactgtaaaatgagctatatgggagacattctccaaccctaaccaaatcttgagatgactaacccattgacaagactacaggcagcctcatggaagaccctgagccaggaccatgtatctaagccacatcctaaccttaaacctcaaaaactgtgggaaggtagatatttggtattttaaaatgctaaattgggtgtagtttgttaattaaaaatagaaagaatgggtgggttaaaaaccattatattcttcaaatatttaacacttattcttcaaatcaagtctttatactgttgagtatatttatgtgtttgtgtgaacatacttgagtggcatattggttaaataaatgtcattacattacattttcattacattccttttttcatgaaggagctacactcaatccctgataatgtaagtaaatacagccatatgctttataaattctacaaagcatttcagtgaatgaacttactcaactgtatttacgaaatttctcctttgttagataaaacttccctctttaaaattattaatgattacttcttattattttaaattagatgtatgtctgtgtgtagtatgtgcacatgagtacaggcgctcaaagaggcagaggaattggattccccaggaaatggagttacaggtaggtgtaaccacctgacatggtttctaggaattgaactagtaacttctggtagagcaggacaggctcttaactgtagagacatctctctagtttagtttcctttctcaaagagggttttttgttttgttttttttcttcatttgttttatagtattagtgactgaacctagagcctcacacatgctaagaaagctctctggctgggtaggctatgctgtcttttccagtctataaaatgttaacatattctagattataaaacatatgtttcagatatcttctgtcagcctgctgtttaatatatatctcaaattggtcatcctaaagaagttcaatttttgatgtcgaattatacctattttcccatacaagatataataataatatttcagataaaaagtaaattacagaagaattaagaaatatttagggactggcaaagatggctcatttgataaaggccagagctaggtccatgcacgtgcacgcacatgtatgcgtgcgcgcggacacacacacacacacacacacacacacacacacaaattctaattttttaaagaaatattcagaaatgaattatgaaaatgcaaaatgtcaagctatgtgtgacacaactaaaacagtactaaaaataggcttcaaaataaatgattaagctgcaatgccttgtggtacacccagttaaccccagcactggagcgccaaggcaggcatagctctgggagtttgaggccagcctggtctacaggtgagctccaggacagccaggactatatatagaaatgctgtctcaagaaaccaaaagtaaacaaactaagcattcaattcagaaagaaaaaaaagtaaatcaagagaaaggaaataacaggaaaaattaaataattcaactttgaacagaatttttaaaaagagaaggaagattcataaagacaaaaggtgattttgtaaagactcagcaaggatcatcataaaagtaaaaatataatatttaatgtgtgtgtgtgtgtgtgtgtgtgtgtgtgtgtgtatacacaatactgaatagatacctaccaatacaacaacatggttttgttgttgttgttttggtttctcaagacagggtttctctgtatagctttggagcctgtcctggaactagctctggtagaccaggctggtctagaactcacagaggactgcctctgcctcccgagtgctggaactaaaggcatgtgccaccactgcctggcacaataacatgtttttatgaagctttatgttaataaatgtggcataaaatctgaataaagtctgtaatcactagaaatagactcatgcttaaagctgagatggtaaatttcaaaaacataaatcgtaaagaacttaaaatcttgtccaaaatcatctgtactcaaaaaaatttccagatttgaatatctttttaggtagtacaaaattctcaatttgaaataatagacaatttgttaccaaacatgggaaaaaatacatgaaactacctgtgttccttttgagcccagtttgattctaaaactacttaaggacaatgtaagaaaataaaatcatgtatgaatatacatgcaaaagtcaaaagacctccctaagaacaaagaacaatgacagtgacattgattctcagattgcaatgaggtcaacatttgaccatattcataaaggagggcacaacaatcatatatgcagcagctttaagtaagtgattagatgtatgctaagaaacatgcgtgcacattaagaacagtgcttgcttaaaaaaaaataggaaactgagacacctaataatagttactcaaggtataaagatatataatcaggcataaatgtaagaatatacactaatcaaattaaattggatgctcacgtgggagctagacacaaagcacttatatacaaaagataataaggaataaatcaccttaaagtataaaacaaatccaattttacatttctctatccctataaatccttctcccaacctcccgtgtgtgtgtgtgtgtgtgtgtgtgtgtgtgtgtgtgtgtgtgtgtgtgtgtgtgtttgtgcgcgtgcacgcgcacacacatgcacacgcacacgcgttacatcttcacttcttattttcaaatgtatgtctactaaatactaggtatggatattcatactctgtttctagaccctcaatctacctattaactattatttccctgcagtacatttttttctttcaccttttctcctcttctctcttcctctcacttgtttggtttgggggtgtttttgtgtgtgtgtttggtttttttttttttaagacagggtttctctgtgcagccctgactgtcctggaactcactttgtagactagggtggccttgaactcagagacctacctgcctctgcctcctgagtgggcatacaccaccaccacccagcttctcatttgttttcaagcacctgtctgtatctatctgtatgggtgtttctaggctctctactcttttctatggatcttcttatgataataacactttatcaccgaagtcctgccaactgatttatttttaattaaataagttaataacaatttaataaatttttaattttatgttttgttttttcaagacagggtttccctggccatcctggaactcactctatagacaaggctggactcaaactcagaaatccacctgcctctaccaccacctctgctaccaccaccaggcctgatttatttcctttttgttgttgttgttgttgtcgtttttttaaaataatttggttatttctgactttatgtacattgttgttttgcctacaggtatgtctatattgaggcatcaggtcccctggaagaggagttacagacagttgtgggctgccatatgggtgctgagaattgaacctggttcctctggaagagtagtcagtgctcttaagtgctgagccatctctccagcccccctgatttattttcttaaaaataaaatagttttaactactttctttttaaattttgtatgtatgagtgttttgcctgaatataagtctgtatacaacatgcatgcctggtatccgcagatcccagaagagggtgttgaatgccgggaaactggagttacagatagttgggaatgaagccttaggtgctcttaactgctgagccatctctgcaactccttttccccttttctttcttcttagacagaatctctctatatccacagacctcaacttatgagatgcatgaccccttgggggcggggaaagtcaaacaaccgtttcatgggtgtccaacattaggtatcctacatgtcaagtatttacaattcatagcagtagcaaaattgcacttatgaagtagtaacaaaaatcattttatggttgggggtcaccacaatgtgaggaactgtattacagggttgcaacattaggaaggttgagaaccattgctctatatagctctaagcattgaacttgccttggtctcccaagtactgagattataaaatactcctgtcatgcctgtactttctatttcctacagcttcagattcttttctccctctgtccctttccttctaagggttaaatccagggcgctatgtacactaagcacacacccttctggccagggctacaggcacacagctctttcgttctttcacagaatgtctagagcagtggttctcagccttcctaatgcttcaaccctttaacacagttcctcatgttgtgtagaccccaactgcacaattattctcattgctactttataactgtaattctgttactgttatgaattgtaatgcaaatattttggaagatagagggttgttgaaggattcatgacccacagcttaagaaccactggtttgaactctattgagttccatattttaaagtttgtcaagttctgccaaaagcacatctgcatggattctgactggaagaaaactgggttgtacattagctggagaaggaagacaagatttatcatcctccgttttctcatatatttttggaataaagattaaaagaataaattttgatccacttaggttttcaatgagtgagacattgctatggtaaacaggccacatgtgctgtcagatttattcttaggtacctaatgaagatttttctatttggtttggattttactgtcagtttatgttttatttccttactgagtactgctgttgtatacagcaaccctgataagtcctttatcagggcttaatgtatgtatgagtagtcctttagattttaattgcaaagaatgacagttttgtttttttctcaaaaccttttaatgtatctatgtagtactgggaattgaacttagggctttgtgcgttcgaggcaagcactttacagctgagccacacctcaacactacttattctcatcattaaaactttcctccgctgctggatagtttttatatcaagttaaccaggctagagtcattctggaagagatatcaattgagaaaatgtccccaccagactggcctgtgggacatttttttttcttaattaatgatttatgtgggagggaccagacgttgcaggtgtgccactgatggggtgtataagaaaacaagctaagcaaattacaggaagcaagcagagctcttccatggcctctccttcagttcctgccacttcgctcgatcctgccttgcctgagttcttgcccctcacttccctcagtaatgtatgttacctggcagtgtaagcctaaataagccctttcctacacaagttgcttttggtcatggtcaagatgttgtatcacagcaacagaaatccaaactaaagcatcactgtagtctatgttactgcagtgagtctccactaagtgatagtaatagttactgtaagttggtgttttgaaacagtcttaagcccaagctgccttgaacttgatactggttttcctgagtattgagattacattcacgagccacaataaccagtttactgtacatttctactaatatcccttgtaaggttccaattaagtctttttttaattattcttttttaaaggttttatttatttattatgtatacaacattctgcttccatgtatatctgcacacctgaagagggcaccagatctcataagggatggttgtgagccaccaagtggttgcggggaattgaactcagatcctctggaagagcagccagtgctcttaacctctgagccacctctccagcccccgacaaaacatcttttatcacaattgcttttcaaaactgagcacacagtagaattatttgaaaggcttgtaaaaatacggaatgctgcaacagagttcctaatggaggtaactgcatcttttttgagtttaagacatcaatggctgtgtcatacccgaagtgacattttgcacacagcccttttccttatctcacagttcttacattctccctacctcaaattccaaattgtttcctgagcctcagaggtggtgatgaaaatgtcttgtgtgctcaacactcatccatcacttattctcagcacctacagcagctgtgggtctctacattcaccactattctcagcaaagagaagcttctctcattaaaagtaaggatagcgtgtatctatatgtatataagcctagacattcataaggcatttgaaaaagaatagtaagttccctccccagccatgtttttatgaagtttaaagtaccatatatgggtgccctcctgtgtcaccgcctcaaaccaacaagagacaagtggacacatcttgtgtagcagattggtttggaagtgcatagcattcatgtctttgtaaaactattgggtgtcttttctccccgaagcagcctacatggtgctgtccagcacaatgaaagctagccagcagacaggaagtccctaactcagtcccagcttttctctacatcttacaaccaaagtatacagtcttcagcaacagggtcttaccacctaagtcaggcgggtaggcaagaggaggggcaaaagccacttttgttttaggggactctggagtcctaatcaaaatcactcagcagtatccacatctgacttggggttttgtttagtgaaccaaggccctaggagcagcactatcagccttgcaggacatcttcagtctttcctttaataatattattaatggtgaaaagatagcagtgtgcatatagcttttttaaaaaaagattttatttatttattatgtatacaacattctgcttccatgtatatctgcacaccagaagagagccccagatctcataacgaatggttgtgagccaccatgtggttgctgggaattgaactcaggacctctggaagaacagccggtgctcttaacctctgagccatctctccagcccaaatacagcttttttatacctttttataattaatcctcccttctgctcccacaaaaatttcatagttttagcattatctgttttataagttttcaaattccttagcagtagcctgttcataatgttgttttgacttacgttttttgttgcagggggaaaatacaacagtttactagaggagaaagaaatgaccttgagttatcagagttattagaccaaagtcccattccaaaagggcactagtgattttttttttaaactctctatcgtatacttgtattcctagtgcttatttttccttattattttgtagcactccatccatttttctggtttattttctctttcatcaattttgatgtttttgcttttatctttatttggtttgaagctttcaccatataaacattttaccctttatcttgtaatcatagcatttaaaaaaaaaaaaaaggtggaaagcagggaagatcaggagttcaaggtcagcctccattacacaggaaggttgaagccagcccaagctacatgaaaaccccctctcagaaaaaaaaggaggaaaacaaacctgtaattagttcccattggttacttcattttgttttactctgtcagtgccttattggcatctaggtataatcatatgctcatattaatcttttttatcttcaaaaatactttaggtgttttatttttatgtgtatgtgttttgactgcacgcatgtatgtgagccacttgcaagcctgggtcctgctgaggtcagaaggaggcatcagatgccctggaacaggagttatggatggttgtcagtctcaatctgggagctgggaactgaacttggtcttctgcaagaacaagaagtacttacaagtagtgaaccatctccctagctccacaaaataaatttgtagctacagtattttccagtaggttatttgcctttttattatattcattgtatggggtttgtatgtactcatgtgaccatgctcatgccatggtccacttgtggaggtcagaagtcaacttgagggtgtcaacttgcaggggatctttccttccaccatgtgggtcctgaggatcaaatccaggttgccagatttggtagcaggcactttaccactgaccatctcaacagcaacaacaatttattttatttttaaagatctttcttttttctctttctgttttttctgtctttttgagacagggtcccactgtgtagccctggaattcactctgtagaccagcttgccctcaagctcaagagagtttgcctctgtgtcctgagtgctgggattaaaggtgtgtgcaccactgcctggccagatttccttttttaaattcatgtgtctgtgggagtgtgtgccgtatgagtatgggtttctgctgaggccagaagaaggtgtcagatcccttagagcaggggtcacaggtagctgtgagccacctgatgtggaaccatgctagaaagtgaaaaaagtgcacctaacctgctggactctctctccagctcccccccaccccaaatcctattaaagcaacttgctttacaacttggttttacttcttctacttcacagctgtgtcagatgtacagaagttaatgattacacttcagaactatttctctcatctgtttaggatcccctttgtcctaattaaagatgttcataataaattctttttttgaagatttatttattatgtatacagtgttctgcctgcatgtatcccaacagtccacaagagggcacaagatcccactacagatggttgtgagccattgtgtggttgctgagaattgaactctggacatatggaagaccagctagtgttcttcaccactgagccgtctctccagaccctgataaattctttttataaataatatttccttcagttaatacttttctggtgaaatgcttgtccatttaataaattttattttttgttctgttatttatctcctgtttctactatttggtctacttttggtgagtctattataaatagcagatgtgtttgattcatactattaattagacatgttttaaacttctattatcatgatttatgatttcaatatccatcattttccacagttgttaggttggatgaagtttaatttattcccttgtcaaacccacaacttagtattttttttcttttaagatttatttatttatgtttacagtgttctgcctgtatgtatgtcttcaggccagaagagggcactgatttcattacagatggttgtgagccaccatgtggttgctgggaattgaactcggaacctttggaagagcaggcggtgctcttaatcactgagccatctctccagcccccaaacttagtattttacaagctgtctttgttttgttttgttttattttgagacatgatctcgtgttgtagcccacactgtttcaacctcctgatggacagaatctcaagcatgtgctaccacactcagtgtcaaagctacaacttctgttctgttcacagtgtatgatttcaatcccttctggccttctctctaaccacacctactgcagtggctaaactagctgaactccaactgcatagcttgtcagtctctgaataaaccacaaatttctggttcatgttgtctcctcaataattaaaaaatagtctattgtgacattatggagcacatcatacaagtttaatcaaatcaaatcaaatcataatacagctggataaaagttcatgaatgcatgaattcatgtaaattaactgttccctttgaatccaatgagttccacatccttgaattcaaccacctagctgaaaaatatttgaaaggggtgggggctgcactggactggaataaccacaaacagtcctgtatagcaactatttataaaacatctatattgtactaggttatcagaatgacatgatgtatggtatacaagagattgtgtgaaggttattcagaaatactgccattttgtaaaagaaaattgagtggcattgaggcttctaattcaagacaagagcttaatatgtagccgaggctggtcttgaactcacaatccttccacctcagtcttataagtacaggaattacagcatcacccacagaagctggtactgagggggagagagagagtcctagaatcagtgcgtcaaacagttggacaaggtagcacatgcctgtgatcccacacttgagaagtgaaaggcagggagggtggggtttcaataatcctctattacactggaagtccaagaccagactgagctacataagaccctgtctcatagagaataaaaagaaaaacactgttttccatatgctattcttgtcatcaaagaacacccataaaagcacataagcaccaccagatggcactaaaccacagccagactttgaattaatttggctaacatagagcaacttgtagaacccatcacacacatccacacattcctttcactccgcactgccattcactttccccatatcttactcctctgcacaaatgacccaagtcagttcaccaatttacattaatagtacatttccaaaaattcaaaccatttcttgtgctttggactgttgggaagtatttactgcctcatatatttattatcctagtttatctcaaagttgtagtgctagtctatgctaaaaatgccaaaacaaactggaaaaatggaaggcaatctgttccaggaagtaaacagcatatgtgggaatgaagcaatggctctgccattaagggcaactcttccaaaagacccccactttggttcccagcacccacatcaggtggctcacaacaatcagtacgtctagctctaagagatgccattccctcttctggcctccaaattaacctgcacacatgaagcttacactcatacaaataaaaaaagatacttttctttctttcttttttttctgagacagggtttttctgtggctttggaggctgtcctggaactagctcttgtagaccaggctggtctcgcactcacagagatccacctgcctctgcctcccaagtgctgggactaaaggctgccactgcctggctaaaaaataaatacttttaaaaagaaacttgggccagacaagcagtggcacatgccttaatcccagcagaggcagaggcagaggcagaggcaggaagacttccaagtttgaagccagcctaatctacaaagggagttccaggacagccaagaatacacagagaaaccctgtctcgaaaatataaataaataaaattttaaaaaaaaggaaggaaggaaggaaggaagggagagaaactaggatatgtcaagacccaaaaatctttttaaaagcttgcatatacatatttatatttacaaaatttcatgactgagtgtttttgcctgcatgtcaatgcaccaccctcaagcagtgcctatggagatcagaaaagggcactagatgccctggaactggtagtaaactgtttgagccacgatacaggtgctgcaaatcaaacctgtgtctgctggaagagcagccatcgatcttaaccactgatccacctctccagcccaacacccaacagaatttggattaatagaagcagttaaaagtgtgtgtgtgtgtgtgtgtgtgtgtgtgtgtgtgtgtgtgtgtgtgtgtgtgtgtgtagagaaggaatatgatacaattcaccagaagcttgaaggtgtactcttgagctactaactctctgggtttaaatacctgcttctacacttggagaaatgatttagcctagtgttgctgacagcaaattatgttaatatataaaacactcagaactattcctagcaatagaatgatgaaacttcttatgttcgaaagattttgtcctttatttttgttgctgcttttggttttccctttactacttctaagtatgcaaaaaggaggcacattcaagacacaagggggtgagcctaggccctatcccaaaggctatgatagactctgatgaccccctatggaaggcctcacccccccctggagagcaaaaaggatatgtgataggtagggtttagttggtggggagggtggtaggtgaagagtggagggagagggaactgggattgacatgtaatacaatgtttctaattcaaatttttaaaaaaatcaaaaaaaagaaaccttaaaaaaaaaaggaggcaaatttcagtgtcttgagctctcaaagtaatcctaggcatagtaacacatgtctataatcccagcacttgagaggcagcagccaaggcagcagggaatctgccaagaaaagggggggaggagggggagggtaactcagctctagatgcttacatagcatttacaagggcttgaatataatacccagcactgcaaagaaaaataataataatccattgaacttcatcctgtgtacaattagaactcactttaaaggtagaagagggggagacagagagaaaggaggggaaaagaaaaagacaaaggtagagacatatcacttccatcacacacacacacacacacacacacacacacacacacacacacacacagagagagagagagatgacatttaggaatgcttattccatgtggcttgttagctcctctgcccctaacaccattaactgccaaccatattctcaatgatgaaatttattcatttatttattttcttctttttcttaagactttttttttttgtctcttttatgtagctctagatgacctagaactggttttgtaggcctaaccctaaccctaaccctaacaaatgtgacctaaggggaatgggaaatggcacctgtgcctccctccactgcttgagaggaaagatccccagtttacttcagtctgtttctaaatgatatctccaaagatatataatctgatttatgacaagaagccttgaagtatgttgaacacacatgtcccaaaatgcagactgcttatctcatctgtcactgtagcctgtgccttaaagagtccctgacacacagtaggtaaccagcaggtgtttattagtgttggaagggtgcccttgccagtctgagtgtggaggtcagaagacaacttttagggacatttctttccttccactacttgggttctaaggaacaaactctcaaactcacatcttcaggggtgaggtaaagcacctttagtcactgagccaagaattaattaaaggtaataatgtatcctttcaagcacataaaagaattttaacaccctctcccaataactactgtagtaattaaaacagagtaagaaactacagtgattattgattggatttttagagtaacagcagctctcttttcctataattgttcccagcagtcaagggaggctatcaaagaatgtcttatgaccaacatcattagtatcacctaaagacattggttaagtcaaaccacagacccactaaattagaaacatggcctaccaaccaagtatggtgtgagctgctgtagccctatgttccaggaaggctgaggcaggaggctcatttgacctcaaatgttagaaaccagcctaagtaacaaacataacaagacctcatcttaaaaaacaaaatgaaacaaactctgttgcagcattccgtatttttacaagcttttcaaataattctgtgtgctcagttttgaaaagcaattgtgataaaagatgttttgtcggggactgaagaggtggctcagaggttaagagcactggctgctcttccagaggtcctgagttcaattcccagcaaccacatggtggctcacaaccatctgtaatgagatttggtgccctcttctgacatgcaggcagaacactgtatacataataaataaataaacaatgcttttaaaaataaacaagatgttttgttatacagacaaaagatgagtggcagttaaaacaacaaatggggtcagcaagagggatgagtagataaaggcaccaaacccaaagcctgagaacctgagtttgctctccacccagacttacatggtgagaaaggagtactctgagcatactcaaaaataaataaatgaaataaaaaaaattaaaagcatggatgacaactggcttctaaatgaagctcacatgtcaatttttaaattcaagcatcaacaatgatattaataatatttgtgacttcttgactaataataaatgcatatttcacaccatgctgcatttgttatcgataccaaagtagaagttacagtcagcattactttgtaatgacagcagtaaaacagaccttccgggcttgatgtgctaatggagagacacctgctctgacaccacaatggacagtctgacaactcgccttagcatgtgtgctccctggcagtgctaggtattttgcttttgatttttaaaacattctaaaagaagaatcacaggcttcaccctatggccaacaagttccacaacacaggaagactggaaaccctcacagatgttaagcagagcatcaacactgtgcctgctttcttcccagtgaagcactcctttaccaacctgaacaaacatttgcacaaagatatttacagatgctctccaccccacctcatagcaccccgaccaccttacaagatatttgagttttaaagttgtcttgttaaaaataaaacatgatgttaagtatattaataattacctgctaattagtaactataaatgaaagaaacacttttaccgttctactagggaagttttacattttagaggatttcaataaaaacacttgtcaacaattagcagagttctgagttccttactctcctttccagaacactggacattttaaatgtagaaatctgtgaatgttagaatgtgaatgcacaccattacagtttggatctgaaatgtcccacacagattcttacgctgaatgcttggtccccagatgctaggtggaactgttctgggaaagttctggaaactttagtttggtagtaattttttctttctttttagaaacctccccacgctctttggtctcggcggcagaaacaagataacgaaaggaacgtcatcctttggaaagcgtcgcaataagacgcacacgttgtgctgccactgtggctctaaggcctaccactttcagaagtccacctgtggaaatgtggctaccctgctaagcacaagagaaagtataactgagtgccaaggctaagaggtgaaacactaccgggactgggccgatgaggcacctaaaaattgtctatcgaagattcagacatggattccgtgaagggacaacacctaaacccaagagggcagctgttgcagcatccagttcatcttgaggatttcagtcagtcataaaaataaaatgttctggtttcaaaaaaaaaaaaaagaaacctcacacacacacacactttattttcctttctttcctttcctcttttcttttcttttttcttttcttttcttttcttttctttttcttttcttttttcttttctttgtgtcttgctttgttttgttgagacactcttactatgtagccctggctagtctgtaactcaccagcctctgcctcccaagtgctgagatgaaagaaatacctgaacaccatctaaacacctgtttagatttttcaaacaggaccttgctatgtagctcaggctggcctcaaacctgcaatcctcctgcctcagcttctcaactggtgggattacaggaatgtatcatcatttcagttcactttggaaacgttaggaggtgggacctagctgggggaactaggtcgctggaaatgggatcttactgctatcttgttccggtccttgtctctgcttcttgtacaccacatgctccttcctccacaatgttcgcctacacagatggagccaagcaacataatgtcagcttagtggcatttaattttaaaatgttttatagaaacatttgagatgctcaggtcccaaagtaatgttctacagcaaacagaaggaggctaccacaggaatcaacagactaagagtttctgaaccctctcaaacgctaactcaactcaagcctagaccacattatcactaaaattgcctcctactatatattttttaaatctctggatttagccaggagttgtggcagatgtctgtaatcctagcaactcagaagactgacaaaggagtttgaggctcatgaactacatagtgagttccaggccagattgagctatgtagccaagaccctaactcaaaattacatacatagagacatacagacatacatatatacaaaaataaaaaacaattcaaggaattctaaaggctaataagcacgccccaaaacatcagggcaaggtgagagagagaaaagagatgtggcaaattcagaagggaaatggagcgtgtgctgaaacaagcgtggctttattaaatgggtgaatgtctatggacagacagtgaggggccatagaaatgagaaccggttgcttaaggaaggtcccaaaagactcacaaatgagtaggatgggacagtcatagtcattcattcgaatgttttaatataaacataacaggaccaaataagtagacatgcctcatgccctagtacctgcagctgtttcagtaacagtgatgcaatgaaagaaaaaggaagcatcatagcaactcgtctttatttacagaaaagcatactgttaaacatctgctatgggagctgttaccccccacccacccacacacacacacacacaaaagccttgagacaccatgaccaaggcaacttatttaaaacatttatttgggatatatggtttcagagagttgaagtccatgaccatcagggtggtaggcaggtaggcgtggtactagaacaatagctaagcattcatattctgagacagaaccacaaggcagatagactccaaatagtggcagtcttttgaaacctcaaagcatccccggtgaccaaacttctccaacaagaccacacctcttagtccttcccaaacagttccacactcaaatatatgagcctattggagtcatcaaaccaccacaggaaccatcctaaacaagccttgcacataatggcaagcacactatcacagagctacatctgctactgctaatactgatatttttttctagtgaacattttatgtacctaccatttcaaccactaaggaaaattctctctctctctctcactctctctctctctctctctctctctctctctctcgcgtgtgtgtgtgtgtgtgtgtgtgtgtgtgtgtgtgtgtgtttcaagtcaaggaagaaaaaattcttaagtttgaaaactttatagccagagaaatgtgtcactggaataatggaagaaaaggctaccccaaaatcagtaataaaactgattcttcaggtgccaaaatgaagcttctaaccatcaacagagaacagaattaagtcctaaccccctggccaatatgaaaggctcataccacatttgtagcccagtatctgtctgcatgtttctacagacaaatgtaaggcagatgccaacaacatctgcatatgccaggaaataaaagtaacatgaagttaagcttggatactaggataactgacccttcattttcatagaatggcgttctagttgggagaaagaatgaatacacactcagtcatgcttatttgtacttaaacaagatgtcccaattccctgtacattttgatactgccctgcttcaaggccctaatttttatcatatatatgtatgcagtgatatattgtttatggtctaacaaagccaccggggatgcaaagatagtcaccgccatagagtcaggcagtggggatacacacctttaatcccaggactaaggagataggcagatggatctctgtgagttcaaggccactcagggttacacaagagtgagtcagtctaaaagaggaacagagctcacacctttaatcccagcactagagaggtataagaagcaaagggtctcatgtgagatttagtttacagacacagagcatttgcctctgagcattcatatagagagcattgtctctgaggattcatggagacaggattgccatttcagcttagtagaggtaagagctactggattggctgctttgctttttctgatcttcagtttgaaccccaatatctgtctctgggtttttattattcgtattacatatctaagtccctattaaaaaaacaagtgatacaataaatataccactttttaattacctgaataaatgatactagatgtctcacctatatttttcagtaagcactgttcttaccgtgtacacttgatgcttagaatacatctaataagttacttcaagctgctgcataaatggttgttgtgataaatcatgttttccccatctctaagaaattgctgttgaactcgtttgctcacttgcttttggcaactaaaatggtcatataagatcccataccagtgatgtagtgactccatcccacggttactatgagaaccacagtacaagagtagaaggcaccagactgagtgagtttacccacaatcatgccaaggtttatgaattcccatggcaaatcaatgggcacttgttttaaatattgtaagttatatgtttttaaattcccaacatttttatatatgtattttattgtacgggcccttaaaaatagccttttcatatataattatccttatagcatatagtatgacacaaggcccaaaacaccaactcttcatcatgccagtgaaaatataaacatgtgattatttgtataaagtgctaaaaaatacgagaaagggtctcaagataacttttatttatagacatcagaatcaaaagattaacttagctttctagcccaaatgattaaaataatgtccctattacgtaacatagaggccaacagccctacataatcccgacagttcaacaaacagaatggttctcagtcaggccggatgctgtgtctcctgtgtctcaggccacagtaagacctacactcaacagtgtgcaggaggagattagggcagtggttcctcctcttgtgcatcagccctgtacacagcacccaccttcttcactccgcctatccaaccatcatcttagctgctaccactttcatggacctacaactgtagtccaaatctgcagaggcagacaacttagggaaagtgcttccttgtcttactatcttttcatttattgtactccatatgttgggaacaactaaaattgtattgttttaattggcctaaaacttacaggcagttctctatttccctttagtaaagttccgtccttggatccaaagctttaaaagcccattacttcccttctccccacaccaaatctccttctgccacacagaagccatgttcctccagacaccctttacaaaccactttcttggggaggcattccctgacctccctggcaattcccacattttatattgccataaactacactaacttgtttaatctcttctataaagctgaaagctcagtgagagcaaaggctcctgtatgcctcatgaaagtcctctctgaactggccagaaagaagatggaaggggaaagacgggttaaaagcatgaacaacataaagactaaagttaataaaactgacttatattaggattttcatgaaataagcagattttagcttttagcttttcttgtaacaaaaagatatgtctgagatgacagctgtattattctgctccaatatagtaaccattttcctactcacagtgtatgtatttcatagcataatgttgtaaactccaaaaataggcagtaatttttaaagtgcaaataattcatataaaagcctctcctcaaccaaattaataaaacttgtaatacatagatacactgttttatagtaacatttaaagtaacagctttatctttactaacactttctgtccgtgtatgatgtgtgtatatcctgatgtgtatgatgtatgtacaaacattcatgtgtgtacatgtgtgcctcagtatgtggagttcagaagacaacttcagatgttggtcctcaccctctatcttatttttgagacagaatctctgctgtttttctgttgcatgaaccatctctccagcctccttaactagtgtttttgttttttaatatcttgaatacaaaagaatgttatcatttctgaaacaaaaaattcttttaaagtgacctattttctaacatacttttcattatttctctataaaacagatttctataaaaatagtacttaaagtaattctttttcattgctgcttagcaattggcagagcaattatttgctttgggccatttttcccattatgtatgtctgtatgtgtatgcacacttgtacttgagtactcagaagccagactaggctttaaattatctggagataaagttacaggtggatgtaagcacctggatgtaggtgataggaaccaaattcaggtcctttgcaagaatatcaaccttgctattaaccacagagcatttctcctgcccatatgttttgtttctaagatatggtctaacgacacaccccatggtagccttggactaatgatcctcctgcctcagcctcatatgtgctggatttaaaagcatgagccatcacacttaggaaatttttggatttttagtatcttgtcttaaaagacagtgaagaattctaaatggaaaatgagcatacataacgacttccacactacagcttgcccccatttttcataaactggacattttaatatctaattccaagtaaacagcaattggagatttggggaagattcataataataacatcatattcactaattctccgatgcaatttttcacattcgacatgtctgaaactggattgtgtcttataatcaatgacctcttactgcatataactagaagcatcttcctcctccactggtataaagtaatggtttttaaccactgatagcctcaggttaaatgaaacttaagatattaaaatactaaagactttctccaataatgctttcgagattattttagtcacagtacaattataattcaattattccagaaagaaaactcagtaactttgaggttcatgttttgccatttctacgaccaaccccaagaaaacagacaattgaaagaaaacattttaaaggatttggaaaaacatctgtattggaagagggaacagaaggaaagggacaagaggtcttgagtgcagcttcaaggcatcacaggctcaggcctccctggaactttacccagggcaaggtaaggggacaacgtggacagcaaactgcataggtgaagatactactttattatctcttcttaaggaggagtctgtcattctttaaataaaaatatgacataggtagatgaaataattgtaatgaaatacaataccataaacattcttaataaattaaaagccaacctaccagcattgtcttcctcctggctcaatctgtttcaccttcaggtaatcctaggactggggctccttttcaggtccccaattctcaagtcgatcttctacctccctgtggcaacaatattttctaattaaaagagtccttttgtgccacagggaggatttctgatggtataacaaatacagaagttatcacagctcattataaagtcagacctgtcctgacattcaagacagaaatccggtttctgatatttcaataaagaaatctgactttattctttcaaactgtgtttataaatctcaactttcatttgctaaaaagtaacctttagctttcttactgaattatgtaaaaattcttattcttctttcaactaacctttaaaccaaatttttgttgctcactaaaacagttttaaggttttttttttacatttttacttattgtacatttgtgagtgtgtatatatgcaggcattcatgtaccaggacaagtgaatggaaatcagaggctaacctccaagagttattctctcactccaccatgtgggtcccaaagatcaaactcaggttatcaggcttgtggttgcaagcacttttacccactgagccatcatgccagcccataaaatacagattagattttttaaaaagttttcttggtaattaaatacaagaataaccttttatacttcagtggctgcatacaaagcaaagtcatgtgatgacttctcagaagagatgtaggaattgtaaaaagactgaagatcaacatatctacttgtgatgcattctaagaccaacccaaagaagatgacatgacaactacaaaaagcagtgctcagatgagtatggtagcacaggctagttgctccagctacctgcaagactggggcagaaagacagtttgagcccatggtttaggctaacctgggcagcacataagatttgcatcaaataataatattgattttttaaagattaaaacatgtcaataccaaatttgtgttatttgaatttcttaaagaagcaatcatgcctcactgatagtgatgactttcagtttgttcattttttgtaatacttcccaatttttccattgatcatatactgctttcattgtaaggaaaaaaaatcaaacttaggtattataaaagttattaaaatgacgggcctggagagatgactcagtggttaaaagcactggctgctcttccagaggtcctgaattcaattcccagcaacaacatgttggctcacaaccatccgttatgagatctggtgccctcttctggcttgcaggcatatatgcagacagaacacaatacataactaaataaatattaaaatcaacagtgagtataaaatataactcatctacataagacaacattatagattggttataatgctttgtatacaagcatgttcaggtatttttagatgactttcaaagttccgagtaatattaggttattcaaaaaagaaatgctgaagatttcatataaatgacaacctttcctctctccctttctttccttcatttatctgaaactaggtctggctccatgtagcccaggttgaactcactcaccatcctcctgcctcagcttccccagtactgcgattgcaggcacacatcaccacacttggacagaaaatagttcttaactaactacaatagtaacttcagaacctaatggtttgtttggttcgtatttcctcactatcacacattcaacacaaggaaacacagacacactcacacaattccaaggttacctttctcctcactgaaaaagaaatggacacatataagacataagaaagtagggctggagagatggctcagaggttaggagcactgactactctttcagaggtcctgagttcaattcccagcaaccacatggtggctcacaactatccgttatgagatctggtgccctcttctggtatgcagatatacatggaagcagaatgcagaatgttgtatacataataaataaactcttaaaaaaaaaaagacataagaaagtaactaaacccagataatatcctggaagatcagaagagtgattaatgttggctacaatagctgtacagagtttcaggtacctggacctagaatagatatttctgagtatattacaaatgaggaaacagagaagaagctcagtatgctttgaaaagtccttgtgaaaggcagggaaaaaagagcagggagagtagagttcccagagtagagttcccacaggtaacaccagatcatgaaggacctattctgggtggctcaaaggccactgagcttgccagaagagtggcctttgaaatctagcaattagctatagaaggattgacaactgcagtgaactgtaggctgacagatacaatgagctgtaactgacagacagacacagtgagctgtagactggctgacaagtgcagtgagctaagaaagaatgacaaagaaaaaaatgcttgctggaggtatgagtttgctttgttttgttttgttttttccttttttaacatggaaatgaaaggaaaacacaacagatgtaaacaaagttaaatattctgactgagtgcactgcagacctgtcaaacatgaaggcatacagaaggctgctcatgaagtcaagggaagacttgttcaagaactgtcctttaagttatctttcatgacgtccttacagccttgaataaacattcttgaaaagtttaaatatcgccaaataagtgatgaggagaaaaactgaaggcagaacaagctaagcaaaggcacgctttcctgccacagaaagatacttaaaaggctaaaaagaagctgagcagtggaggtgcacgccttaactcccagcataagaaggcagaggcaagtggatctctatgagttcaaggccaggggggatctgcaaagtgagttccagggcagccaggacacagagaaatccagtcataaaaaaaaaaaaaaaaaaaaaaaaaaaaaaaaaaaaaaaaaacgacaacaacaaaaaaggctaaaaagaaaatgttaaactcagtcacccaggatgctctctcaaatttgcttttacaattctttatgtttttcgaaatacatttctaaactgtttaattctgactcattcttacccaacacaaatacagccttgaagtatccactccatagagacattctccaataccttttccctagaaggtctagcttatttccacagcatcaagtgaggatgatttccacatctgtctcaaccctgttgttactgtgctgcagtaactcagcagcttccatctgcccccaactcgtttccacactactctccatcccaggagaggagctgcatcaacagggctcacatagcttcagactgagcttttcagtggaggggctttgcagggggactagaggagagcaaggttagaggacttaatccctggctcccttgctatggcactgctatctaactaggtacatcctttgatcaggggcccacattttcccaaggtgattccttttccagggcaactgcttccacatctgagtggctaaggaatccctcccctgagcgctggagcccagaatagaatcatctctgttacagagtgctggagaactgccctccttcccctcctttgcactatgcttactttccttcactaaaaccacccagaaattagcctaatttgagtatgccatttcctttgtgatggaaccctggctattcctttatgcatctgtaaaaacctaaatattccttcttagttcatttaaactcaaaatcaatgttactattgacaaaatcatctgcttctcaagacagttctttcctttcatgaacctctacaggatgtcacggtctcttactgtcttaatgtgggtgacagttttggtgaatatgcccctccttgtcttcaggttagaatggacatgggatggtgtttatgtagccctctgttcctatggccactactttaatatttcttaaatcacccttcaagtcacaacagccagacttcctgcctctagtcccaacaatttctacttaaatagcatttgtttgtttatgtatggtacttcattcagattgaacataaggccttgggtactagataagcactttacctctaggccacatcccagtctatatttagaatctgccctctatccatggtactgcttcctgcataagagcctctaagtcttgtgcctgctttatctgcttaattactaactcttaacattcaataaaacttattttgtatctatttattttactgtgaacatgaaaaactatattgtcaaatatctgtaaagaatccaataaactactggctcccgtcacatccagctgtgagcaggcccggtgctgggtaagtgcacagccctgtgagttatttcatgcctcctgagacaagctcaccctccacagctcactgctgcttttaaaggctcttagtgatgactgatctgaagcatcctcgccgcaatgtatcagcaggttaggttaatacatctctttacaacttctacagaacatcattttccttcgatatttaagaggaagttggtatcacccctaagctctgagaggaaaacacagccttctaaaaaaagataaacgacatagacaataactactatcaaaatgagaatcctcggacatacaaagtaatgaagggctaggatcctagcactcctgcctgcttaacaatgaggacagtgtttctggcacggatatgtacaggggaataaaagaagaaaaacttcagtgtgaccaccagagcttatagaacaagataaactattattttatgctgacaaaatgtgaattataaaccaggtgtagttgcacacaactttaatcacaaacactcaggaggcagaggtagttggagatctgtgacttcaaggctaggaggtctacataccctgcctcaaaaaacaaacaaacaaacaaaaaagacacacacacacacacacacacacacacactatagtttaaaacaagtctaggaaatatttcctaaaatttcacaaggaaatcctattcatatatatttttaattgtatgtgttcctgtatttgctcatggtatgtatgtgcatgcattcacatgccagggtgcatgcacatctgaggtcaaaggacaactgtgaggagccagttctttccttcaactcagcagaggtccttgggatcaaacatgttgccaggcttgcaaagcaagcccgaataaccactgagccttctcaccagcccttcattctagtcttaattccctcagttcatcaaataaaaactgagacatcgtattcctttccttttcatctcagtcagtttctttttaagcaagtttagaaattcatttataaacttaacatcacaaggaatgaccctcccatcctaatccatcaccaaatggaaatatagactcggctaagcaatggcaacccttactcatctgtatattacaaatataagaagtaaacccacttaaagtgtgtggctttcttaaaaaaagaaacaaaataaagtttgaatttgctaatattaactatttgggggaatgaggtaggtacataaaacaaaaattaacctatggactattaattatccttgtagagtcatttttaaaattcatgttcaagaatggaactacatgtaaaatgaagtcttgaggtactttttacattattagaaatatgtaagtgatttgtctaacatttccaaggaaatgcttaagaaatatcaatctgaagaatagtactgacaatgggtttggtagaacagaagcaggaaggttgtaccaagttcaagacctgccaagggtcccagagagaccctcaatataaaatagtattaaatactttaaaaaccacttgtcaaaaacaattacaatatatggttataaaggcataacagagtcattacaatacaaaagtaacggtttttttctccacatgggtcatactaggcccaggctggccctcaatccacaacctctggaggttaatctggggctgtgaagtagccggaagacacacgtgcaccacggccagctccaatcctccttttcaatatcagtcactaacatctgtcctgagaatggagccacactcgatgccgtaactgggttacattcatttcttactcaaaactgttctacatgaattactttattattagttatacaatagtatttgtcaacctgctctggcattcaaatacactaaatgtcctaatatatctacttatgcaaatcctgcactgttgttttcattttttaaagtttccaacttgatgccaaaaatcaatcgtttttagttgttttttgttttgttgtgttgtttagacttttgagacagaatctctctatgtagctcttgatggcctggaacttgatatgtagaccaggctggcctcaaactcaacagatagatctgcctgcctctgccctgcaagtgctgggattaaaggtgtgcagcaccaccatgcctaaccccaaaattatctagaaatttaaaacaagctctctttttgtacattcagcttaagctatcatatttttttactgtgcaattagtgttttatctggttataatggcataacagaattactacaatatctactccaaaatgtcattgtatttagtacttttacttcttttacctcgataagaaaactcaggtctagagatgacagtgcgctgcctgctcttccagaagacccaggttgaagtcccagtactcacataccagctcacaactatctgtaatgtgggcatccatcaatcccaaagcatccaatgcccacttctagcctctgcaggcaccgggcatacatgtgatacacaaatacacatgcaggcaaaatatccatacacatacaatttaataatgataataacattaaaaaaaaaaaaaaagaggaacccggcagtggtggtacacacctttgatcccagcactagggaagcagaggcaggcagatgtctgtgagttcaaggccagcatggtctacaaagcgagttctagaacaggctccaaagttatacagagaagccttgtctcggggaaaaagaagaaagaaaggggggggagggaggaatggagggagggagggagggagggagagagggagggaggaaggaaggaaggaaggaaggaaggaaggaaggaaggaaggaaggaagggagaaagaaacaagtgttacctacaagaacaaggcaccactgcagactacagtcacgatgtcagataaagcaatgcgcacttcacctgagttctgctagcacatgatcttgctcagaaaatcaaggcagcttctaatctttaagctcaaaaaacacatgaaactgaagaaccaaatgagtctagaagttagcagtacttagaagacaccatcaggcctcacagaaacaaaacacaaagagtcaaaacttagctggaagtttgaaaaaaaaaaaaagcctaaatatttaagaaattttcagacagtgagacggctcaatgtgtaaaagcactaatgacctctgagttccctccctggaacccacgtggtggaaggacagaactgattcctactagttgtcctctgatctacacacatacacacacacacacacacacacacacacacacacacacacacattcactaagattgtaaccagtaattgatttttaaaagaacattaacagattgtgataatttttattactatgtaagtcactaaaatgatatagggaaaatattttcttcatggtcatagcaataaaaaaaagaaaaaaaaaagattgctctaagaattgcacacactaacccccaaatacacagatagctaacaaaatacaagctgatggaaacaacaagatgttaaagaagacagaaaattaagaggaatctgacaggcaaagttgcttcaaattgaagagagaaaaaaaaatgacactgctgcagcaatgctgacctttaggaaggctcaatcattggggggggaggtactatccttgtttggttttttattagaaaatatcactcgagtactaacccactaacttctataattaatgagtatttgtagtcccagaaaaaaaataaataaaacaacttctgtgtcagataccaaagaactgtaatgtaagactctattatatttatataaactctcttaaacgaagattttagaccagtttccagcctatgataataaatattttaaaataggttcttcagtataagatttcccagcaatagtaatactgaaacttacagaatgagttttggggctagagaaatggctcagcagttaagagcactggatgttcattcatccagaggacctgggttggcttcccagcacccacttgatggttcacaaccacctggaactccagctccagagaatctgacatcctcttctggccaccattggcattgcacacacttggtgcagacatacaagcaggtaaagcacccttacacataaaatacataattttttaaaataaaaaatttgtaggtgaaaaacactttttgccatgtctacctgtttctgaattctcggtctcaacttcttgttcttccgccacatcctgcatcatgtaagtctcatcgtcatacaccagaacctgggcagcgtagccctgctctaatcttgcactggggactggctccacaatcactgctggatattcagggacattgtcacctccctacaaaagcaaatttaaagaacaatcaagctttttgttggaaaattctggatttagttctgaattttggttcacaaaatcccattaagtccacacagtgtatttcaagaatacatacatgaatgtagaaaaacaaggaaatggtaaggctggctgtgataatcttcaagtcttaagagaagatgaagtaagtaagagaagaagggcttttggataaaacacctgtacttcacttttttgtgaaagctcactaaaacaaaggtaagacactttgttctatgttttacactaaggaagacactgaaacaaacaaaaagagacaagagcaacacaccctgaggagaatgaaaggtgtgtgaacaagtatcaaatgggtacctaagagcgccaaatcatagcctaacagcaaacaacccaagatcagcacaccgcacagtggcaaggccacagacagtgccagacacttttgttcaaaaagagcatccacagaagctggggagagcaccttgagtcaatcaaagtataaaacatgtgtcagacaagaagttcttcttttgttttattatagtgccaggatcaaactcatagccttgagtcattaaaaaaaaatgctgggtggtagcatacacctttagtccgagcacttgggaggcagaggcaggcagacctctgtgaattagaggccagtttcctctacagagcaagttccaagaaaaccagagctgttagacagagaaaccctgcctcaaaaaagcaaacaacaaaaaataaacaaaacattaaattaaagaagagtttgagctacaagacagagtcaatctaacaaaaaggaagacaacaggaattttcaggaagacagaagataatcataaaagtaaactggtccgttttgcatcaatgtgttttattaatcttgactgtcaacctaactaaattgggagacatgtaaaagactattaataaagctcatgcctactgtctgtgcacattcttaaccctttgatggatttacactttgaatagactacagaggaactggaaggaggtatggcactgcagaggatcagtgtcagtggagacacaccattgattactaataccacttggtcctggctcctgtctgaaactcctctgcttcccagccaccaagagacaaacagctctgctatgtcataccttaaaccataacattccacctccccacaggatgctgtgaatgactggaaaggctcactatgtaaaatgtaaagggttgtatgtgaaatatctcctgtgacacaatgagttgttaaaaaccagtgacattcttcctgaagacacaacacctgggaaagtctgttccagcctgttatccatgtttgtttgcctcaccctaataatgtactctttctaccttgccctgatgtctgagaggagtgatcaacttctctgaactgagaaaaccaccactatcctatgcacagaaacaatagaacagaacctgatatctgactatctgctgaacagacaacagcagaaccatgctgaagcactttgtcaaaagctcaggatgacccaaagacctcagcaagagctcagaatgaccaaagacctcagcaagagctcaggatggcccaaagacctcagcaagagctcaggatgacccaaagacctctgcaagtgctcagaatggcccaaagacctcagcaagagctcaggatgacccaaagacctctgcaagtgctcagaatgacccaaagacctcagcaagagctcaggatgacccaaagacctcagcaagagctcaggatgacccaaagacctcagcaagagctcaggatgatgcaatgatctgagcaagagctcaggatgacccaaggacctcaacaagagctcagatgaccttttgacctcagcaagagctcaggatgacctaatgacatcagcaagagctcaggatgatccaatgacctcagcaagagctcaggatgacccgatgacctaaggagctcctatccagctacttctccgagaagctctgtgatggtataactcagcctgaaacgaagtcatattttacaaaacaaataataaactgcttaagagtattttcataaataataaaaccctaaagaaaggtacaaaaatgacaacacatatgaggatggcacctctgaaaacaaagatgggatatagaggaggggcacagtctgtatactctaaaacatttgaaattttagcccaaaatggtgatatatatatatatatatgcacctataacactagcacttggaggtggaggaagaaggataaggaggtcaaagtcatcctcagctacacattacattcaagaccaccccggactacatgagaccgtatctcaaaaataaatggatgaatcaatgaatcaatgactgaaatactagcagttactccacctcaacctgaatgataagtaatatggtttacatttttgtttttttttttttttggagacaggatttctctgtatgtagttctggctgtcctggaactaattctatagaccaggctggcctcaaactcagagatccacccgcctctgcctcctgagtgctgggactagaggtgtgtgctgccaccaccacccagctttatcagttaatcttaaaatatgcatgtactttatttgtgcttcattgtctataatacatttcaccaaaaatttaacttgcaaaatacactgcaaaaaaatttttttggctaacaatttctctatttcagaaaagactataagtccagctttttaacatcaaggtatgggggtatgcaaaaaaatcgctgctccacaactggacaaacagctatatcttcagcacttctagctgcacagtcacaacaacatcccctgactgtaaagcagatgctatggagaagcatgggccaagtgaagacgcaagttttctatttgccaaaactaaagagcaacatgctaagtagcactgaactgatgctgacccaagcactggttgtttatacatggagttaacaaattatttccttcctctaaatttatacaatagtcttttcattcagagaacagtcacactatgttgctcaggctggtctcaaaacttctggacttaagcaatcctcctccaaatagctgagtctacaagtacatgccaatggtctcaactatacaattttagaagcaaatttagcaccagatggcagagacaggcaggtctctcagggctatatagtaagacttgtctaaaacaaaaaaaattcttaaatccctggattaacctggattccagtaccttaccaaaactattttcgaattatcaataatggagggtggcaagatgccttggacctgcctcaacaagatgatgggccaaacttagtagacttcctaggggccttaccctctccaagaagcagatgggggggggggagtaggggagcaggaagagaggaaggggaactgggattggaatgtaaaaaataaaaaatacatatactcataaaaaaaatcagtaatgaacatcctgctcccccattttcctagccctggccatgtccagtctgcttccttttctctctgctctagactcttccagtcgcctctggatgttctctcttctcttcccccaatggatcagtcattccggcaatttctttattgggcccctcacatacaatctcaactttgcagcaagcccactgcctcagcgcctcaagtgatgggatcacagacacgcctcagtatgtccggattacaattttaaattttcaaatctcagacaaatagtatttaacaagcttgaaaatgtctactgcactgaatcaggtcattttacctcacatacagacactcccatatgcacacagacacacacttttaaggtcctctttggcagagttgtgttaagaaatgtagtcaagggagctagagagaggaatcagcaactgggaggaataatgttcttgcaggggacccatgttctgttcccagaacccacatcagacatttataaccacctgcaatccagctccaggatttgaatgagtcttcacaagcacctgaacaggatttacacacacacacacacacacacacacacacacacacataaatttttttaattgaaaataaatctttaatcaagccaaacataacatacagcagggcatctagactaacatgtagccctgtctgtgctcttaaacatcaaccagtatctcctcctcttgtttccggcacccactttccttactactgaagttcaccctgagtcctcttcatcaccactgaatacacactgcccagttcaaagctctcttctgagcattttcactttaaccctttccctccttaggcaacaccagccgctttcatcatttcactagcacctctatactgctgagagttatcaagtccctgtccttcattcaaccatatgctcaacttctcaacctagccattttcaacttaccctaaaatataaaactaacatcttaaaataaattatcaatctcttccttttctcccattttgcttttctctaaacctgttgcttcatattcagataataagtcataatactatgtcgttagttccttgaaaatcaagtattcgaggagcacttggcacagtgcatatcacaggaagaagcagttactggcccaggctgtcattctacaacagcagtaatggtcttcatatctattttggaggcacattgtcactcacaattggaactgtcacttttttctttgcacaaaaatctgtaatgatcctgtatttgtctaaaaggttaaaacacaacaattttcacacttgttatgggttgaattatgtcttcttatgtattgatgtatattttcaccccactgcccgtgactatgaccttatttgggaatgggtctttgcagatgtttgagttaagatatgatcagtaggacataccctagcccaatctgaccagtctttatagaaaaggacaacttggacactcagtgaaggtagagggaaaaccactgaagacacagaatgctacctccacaccaagcagagtgtgaagctgcacaagctaccggcgcataaggcagatgctcacagctctcagaagatgacaacacagccaatttctggattctagaactgtgagactataattttgttttgtgacaccactgagcttatgggatgttttacagcagccccatcagactaacctaccacctttaccacctttactggcttttttgctgacataactacatacaagatgtgtgacttagttcctatatgaaaaccttcccataatttctactgcccaaatagctttcctaaaggcttttcatcccattctagggagtcctttttaagcccccaaaaggtatttttctattcaaagtccttctgacacaagttatttgcctaatattaatgttacttacggcattctattataattaaatatttacatattcaaatccttgactggacagtgagattattagatagcaaaagttacacttaagtccttgaagatccacacatcacatgatgaagaatttaagtacttgctgatgagttcagagaacacaacatgatagattccacctttatctgacagcaagtaacttcatgagttttgtactaccaaatgatggagaacagaggtaccaagtacagatatgcagaattttatttagagattattttttactggagaaaaatgaggcagagtaataacacatcgactatcttcttaggattactttaaccaagatactagagtatgcatgattaaaatagatgaaccccaaaatcagtgggtcttgacacaacctagctagttctctataggctagggttgccagatttatcgaagaaaaacataggatacctaattagggctaaattcaattaaacacacatatgaacaatccacgtttggggaactgttacttatctgaaattcaggcctaactggctttcctgcatggtggagggggctgcaggtacacatacaggcttatgtgtgtgcacatgcttgtggaggccagaagtccacactggggggtctttatccatcttcacctgatttgtgtttgtgtatctgtgtatgcacacacatggaggtcagaggacaatgttggtccctgctcttttgtaattcaggaaaccttctgtgtctgaccccaatctcaccacagaaacaggattacagacacacaaatctgtgcctggctctatgtgggatctgaggattcagattcagggcctcactcaagcttgcatgctacaaggtctacccctgccccatatctccagcccctgcctcctcactttctgagacagggtctcccactgaacctagagctaacatcaaggtccatcaagcactttacccagtgagctgtcaccaggcaactgtactgtaagttctaacagtgccctcaaaacctctgagatccacctgcccctgcctcccagagctgagagtaatggaatacggctcaacagtggataagaaatcttgtgttcagatttaattgcttctaatggacttcacccaagtaatacggtcacttgaagtatgcaatccttggattctcataaacatagttatctctgtaaccacaacagtcaacagaatactcaaaatctcccctggtacccttatcataatcaccaacctatacctctggatctccagccctacatttcttttctgaagttttctaaagttcattttacatgcagtgtacccatgcgcccacatgcacgcacacacaccattgtgcacaaggaagtcagaggacaacttgagagagctggttctcaccccctatggaggtcccagagacacagtcagaaagcacctttacctgccgagccaccttattagtctataccttttctaaaactgtatatggaaatcaataaattgtgttttctgtgctgatgtctacacatgctctggctcagtcttgacccacaagcatgaggatccgaatttagatccccagcatccaaatggtgacctgcctgtagccccagggttcaagaggcagatggtatccagggacaagctagctgaactggaaactctacactcaagtgagagaccacgcctcaaatataaggtggagtctatcagacaagatgacaatctacacttaattttaaaagactgtcaaattattttccaaaatggttcttagaacattcccactagaaatgtatgagcattccaagtgctcaccctttccaacatgtggtaccacggtgcaagcagcaccattccagtgtgcggcacgatcttagccatttgaatatgcattttttgatggccaaaaatgctgaacagttctttgtttattagccattcatacaattattcaaagacaggagacagaggacgaaggaaaaggggaagggaacaagggagaggaggaggggatatctgccctagagggacaaaggactgcctctaagtaaaggagacagactgaccatcttttttattttttaggtgtgcacacacagacatgggccagggtctttccctaaacctggagctcatgttttcccagctttctctggaagccaacacatcccagtgagcctcctgtctgcacctccctcagagctggggttacaagcatatgtgctagacacagtacgtgggtgttgggggctgaacacaggtccttgtgattacacagcaacttcccagtccttcttcctattttaataggacacctttgtcttactgttttttatattctgaagatgtttgtggcttcaataaggtttcagtgcatcctcaaaggttcaagtaatggaagcttggtcctcagtgtggcaacatcaagaggtagaaagactgtgtgacagtggagtctgctggaatgttttcatatcattaagagtgccactcttggggctggagagacagctcagcagttaagagcactgactgctcttccagaggtcctgagttcaattcccagcaaccacacagtgactcataatcatctgtaatgagatctggtgccctcttctggcctgcaagcagacatgcaggcagaacgctgtatacacaataaagaaaccataaaaaaaaaaaaaaaagaatgccactcttgaaaaggagtgaagtagttctgtgtgacacaatggaattataaacaataagcctttgcaggcggtggtggtgcacacctttaattccatcactgggattaaagtacaggtggatctgtgacttcaaggttagcccactctacagagtgatttccaggacagcccgaactacacacagagtagtgtgtcacaaataaataaataaataaatgaggaaaatatttatgttgtaaatattcttctgttccattcactgggtctccttttcacatttttttttttaactttttcaaggcagagtttcgttctgtaacagcctggctgtcctggaattcactctgtagaccaggctggcctcgaactcacaagagttccacctgcctctgcctcccaagttctggattaaaggtgtttgccatcacctccagaactattaagttttaggttttgttgatacagtcatactatgtgatcaacactagccctcaagttcttgcctcagcttcccaagagatgtaactacagtcttgcatcatatccataagtttctatttttattgtttttacacatatgattagggttaaatttatcatattgttctttgcttactgtcctaaatattttaagttccaactttcttgccttagatacatgtttttacttcaatttctcagtgattgctttatattttacaccatgcttttttttaaattcatcaatatatattatatggctttatgtttaatataaagatctcataacagtattactctaattctctactgacattatttgttctgctgtgatgcatttactgccatgcattttcttcatattataaattgcacaataacttttatttctgctgattttacatgctgggtataataacacacacctttaatcccagcactccagaggcagggacaggtggatctctgtgagttcaaggccagccagggatatgcagtgagacactatctcaaaaaaaaaaaaaaaaaggatttcatataccttaacacattacatattgtttaccatgagccttatttttcaaaataaaattttggtttacctcatagtaaccatttctccaggcctcttcactttgcatagaaccaagtttctagatagaataattaactttctgcctaaaaaatgtatttgtaatatttcacagtgcaagcatattgtctctcagcctttgtctggggtaaaaactcattttgatgttgttttattactattacatttatgtgagtgtgccatgcactcatggtgcagatgcagaagtcatagtacaatctgcagaggttggttctttccttccaccctgtgggtcccagaattggacccaggccatgaggtttagtgatccaatgggccatcccaccaacacaggtatttatttttactagatgtgtaactaaaaactgagagttttaccctctcagcatttttttaaagatttatttttactttatgtgtatatgggttttgcttgaatgtatgttttcattccaggtatgtacctagtgttctgggatgccagacaggggcacttgatcctgtgggactgttatggatgcttgtgagccaccacgcaggtgctaagaaccttacccaggtcctctgcaggagcagccagagctcttaaccccagcatttcctcagtatcttgaaggttctgttgtcctctgcaatgctcatcttcattttgtactgactgagcttcacctttggctgctcactgccgggcagtggtggtgcaagcctttaatctcagcactcaggaggcagaggcaggcagatctgtgagttcatggccagcctggtctacaaagcgagttccaggacagccagagctgtatagtgagaccctgttccaaaaaaagaaaaaccataaaaccaaaaaacaaaacagaaaataagtattatggagaacagttatgtatagattgttttttttcagggaggtgagcagtatccggggatctagcatggtcttgcactggcttgacatctacaacccaaggccctgaaccaatttttaaggtccatttttaaaacttttcatggtagacttcaactatctttaattctagagctaatttagccctgctatgtaagacacaacccttatgacggtttttagccgggcattggtggcattcgcctttaatcccagcactcgggaggcagaggcaggtggatctctgtgagttcgaggccagcctggtctccagagcaagtgccaggataggctccaaagctacagagaaaccctgtctggaaaaaccaaaaaacaaaaacaaaaacaaaaaacaaaaaacaaaaaaccttatgacggtttttaatgaatgccctgagctttcaacaaggactctcttgcccggctgactggaatgccagtatctaccagcacaaggactgagtcctgcctttctggccaagtctttcttggcttcatggagtccgagttgcctaaaccactgagtgttccagccagtcaatgggagccccggcaatacatacagctctttctttgggaagggtgcttcttcgccttttggatagtatattcataagagttcatttgaacctctccaagatttgtttccttggttcaaggaagatagctactttgttttctattcctttttacttccaattgtttccctagtagcagatgtcatctagaaagttctattcaaagtttttaaaatatgacttaaccacataagcagaacttgtagccaacatgtaaatactttcaccatgagcaactgcaaacaaccagcacggcatcagtgaatgcagacctgggaggagaagacagctggctctcatcctggctgccggaagaaagctgccaactgcaggtaactgattccatgttttccacagaatttacctgtctttctattcctgcctctcagcactatagaatgcaactaaatagcacacacatttcttataaaggctctaatttaaattttcaaaacttaggggctaaagagttggctccatggttaagagcattgtttgttcttgcaaaggacctggttcaaatcccagcacccacaactgtctgtaactccagtccctggggattggataccctcttctggtctctacatgcacagtgcacaaacatgcagacaaaacattcatacgtataaaacaggtgctggagctgaggctatgactcaggtgtcaggtatgcagtgagccctggactcatacccggctccacatgagtggtggtgcatgcctgttatctcagcactcaggaagtagaggcagaagaaccggaagcttcagatcatcctggctacacacagagatcaagaccagaccgatctacatgggaacctgtctcaaataacaaaaataaaaaccaaaactaaaatattttattccagtgtgtgcacatgaataacagcctaaactatactttttcttaaaaagattttatttatttattatgtatacagtcttctgcctgcatgccagaagagggcaccagatctcactcaaagtggttatgagccaccacgtggttgtcaggaattgaactcaggacctctggaagaacagtcagtgctcttaacctctgagacatctctccagctcctaaactatacttttaattttagagatttgtaaattacatttaattgtgtgtggtggggaggagttgtctatgtagaagtcagaggacaacctgccagtcaaatgtcaaatcccttctaccttgtatatccttggcattaaactcagtcatgaggcttggcaaaagcgcccttcaagctgggacatctcatcagctctgtaaaaacttggtgttagcagaaataaacgactattttacttctgttatcagcttttatgtgtataatagctagtaaactggcattctccacagcacagatcctcccatccatcccatccaagtgaaagtggaatttctttattaaaggtttggtgttttcttttgttttgctttttctgttgtttgttttgagatagtatctcaacattgttattcaagacactgattttgttttgttgtgtcctgagttctttcaagacagggtttctctatgtagccctagctatactggaattcactctgtagacaaggctggccttgaactcagagatttgcctgcctctgcctcctgaacgcatttgatttttgagatagtgtgtcattatttgagtgtctctggatttgaactcatgagcctcctgcctcagccttcaaatgctgggattacagacgtgcgttaacacatctgacttttaaagtcttatcagcagatagcttgttacaactgttaagtaagaaattttatcaaaaatgtagatggacatttataaaatcccattttactaagaatcttctctcagagccagagaaattgctcagcacttaaaaatcacttgctggctggtcagtggtggctgtacacacctttaatcccagtactagggaggcagaggcagtaagatctctatgagttagaggccagcaacatctacaaagtgagttgcaggacagccagagctgttacacagaaaaacccgtctcgaaaaaaacaaacaaaactatttgattcatattaagtattgattaacatttgttaaaaggatagaggaatagatgtgaaagttgaacagcaagttgttcccacactggtaccacagcatttcaaatacccactaagtacactggcttcttctgacctccttccataaaatataactacccttttataccacataaaccattattagtaacaatttgataaattcataatgtttttcctccgtgctaagttctaaccaggaatccctgtgattccatgtgaaggaggaaaaactaaaggaggctccagacaaaccttggtcctcttttccccatactgctttttttttttttaacagtaaaatgtaaactactctgaagtacactcttcatggcagttctcctcacaagataaaaacaccatcactacaaagttatagaagacagaaaaataatttgaaagagaaacaccatgtgctgggtactatcaaatgagagagagagccttcatctctgttgactcatacccagaggtgatatacagaaagtgaattgggcttttgttttgttttgtttttgagacagggtttctctgtgtaacagccccagctgtcctggaactcactttgtagaccagacttgccttgaatttagagatctgacttcctctacctcccaagtgctgggattaaagatgtacaccaccacccaactaagaaagtgaatcttagaggaagaagctgactttggaagtatgttctactgtggtggctttttctaatggactctgcatgcatttaagaagcagtctttaaatacaaagggaacatgtaggaatttgcaagcccactgacggtagaaaagtacatcctataaacatgcccacagcagatctgagtcttacagactgaacagacaccaagcaagcaaggaaaataatccagaccacagaacacacactagtgtgtcctcactgtcatcaggcatctccctgttccattatcctggcaccaaccccagtgacagtagcatctttcacagagagaaaagaaacttccatgatactgaaaactgtccattttcccaaggtgtctctaaccaaacatccacatgacagcactgctataattttgtttgatatccacattcagtcccaaacgaatggtaggaatagaaaccaagactcaaaatctgtttcctgttcccaactcttattcttccgagttttctttctgtgacaagaaaatgaccagatacactgaagactcaaaatcctaccttcaatttcgaattatataaacaattgcacatattagatctgaattagacataacagaacaagaaagaaagatgatacagaaagcaaagataagcttctaacttaagatgacagcaatttaggtatttagatacaatgtatttctcattctccattatctaagaaaatgggcaatatcagaaacttaattttttgtttccagtcagaatttctctgtgtagccctggctattctggaactttctctgtagatcagcctggcctcaaactcacagaaatcccgccaagttctgggattaaaggcatgtgccaccaccacccagccagaagattaacttttatctaaactaacataacatcattctttccatctctttgcttcctccaaatccatcctaatatacacatcttatatcacccaggtgagcaaccttctcacccctactaagttacatgaaaatacatggacaattttctgcatggtacatttctactctcaaatacctgttttgtcattcatttcaagattaattcatgtactgatttctatgatttctattaacaaaaccgagatgaaatacattaaattcctaacctcttgattctctactccattgctggaaagctccagaacagaacctccactgtcaaccactgccgatgtcattgtttattccctgaggaagttgtgtatggctggaaagctccaaaacagaccctccactgtcaaccactgccgatgtcattgtttattccctgaggaagtttcaaatgctatgaatcagtgtaattaggactcatagatgatggccagggttataggtttcattttcatggtttaattcaatagagatggagtagattagacatccagaagtccagtcttctaaagttgattaaccagagggtctaaaaagagcaagaattggaattgttaagaatatataggaaagagagaaagcaatttaatatttaacattgtttaattaaaaaggatataggctacttaagagcttaatattcaaattcattaactggtcaaacaatattttactaagctattgtatatgggtattatattataaaagatataatgctaaaatttccttgggccagagacattcctcagcagttaagaacactggctgctcttccatgtttgattcccagcacccatatggcagctcattaccatctataactacaattccaggggatccagcaccctcttctggcctccacaccaggcacacacatggtacacagacatacatgcaggcaaaacacccatacacaatgttagcactcctctcttatggagatgcaatattatacatggaatattttaacagattttgttatttgagacagggtttctctgtgtagccctgtctgtcctggaactctctctgtagatcaggctgtctcaaactcacaaagatccacctgcctctgcctcctgagtgctgggatttttattttaatatgggctggagacatagttcattagttaagagtgatgagtttggctgagcggtggcacatacctttaatcccagaacttggaaggcagagacaggaggatttttgagtttgaagccagcctggcctacagagtgagttcgaggacagccatggctacacagagagacactatcttgaaaaaccaaaaagaaaataataagagtgatgagttaactaaagaatagtggcacacacctttaatcacagcactccaatccaatgctctcttctcccttccgttgacacctgtgatcacaatacatactctcacacagacacacacatgtaattaaaaataaatctttatttgtaacgatttatttattatgtatgcaatgttctgtctgcatgtatgcctgcaggccagcagagggcactgggtttcatgatagatggttgtgagaaattgaactcaagacctctggaagagcagccagtgctcttcttaacctctgagctctctctctagcccaaaataaatcttttttaaagaaacttttaaactcttttaaaccctgcacacattggagctaaacttgtgttgtagggattacacagctgctgcttttagaaacatctccctagaggggcttcttaagtctttttcttcctcctgctccttctttcttaaaatgtatttattttatgtgcatttgtgtgttagcctgcatgtatgtctgtatgagatatccgaatccctggaacttgagttacagacagttatgagctaccatatgggtgctgggaattgaacctagatcctctggaagaacagccaatgcttttaacctgtgagtcatctctccaatccctctctcttcttatgaagatggattattaatgtgtcttatctacatttaatccttacgttactttttatttgattttgtgttgtatttcatacagagaaaatacaaacctttctgacaggattttcttttcttttctttaatcctggttttttcaaagcagggtttctctgtggctttggaggctgtcctggaactagctcttgtagaccaggctggcctaatactcacagagatccacctgcctctgcctcccaagtgctgggattaaaggcgtgcgccaccaatgcctggcaggatttttttctaatgtcaaattttaaccatgcagaaaatttaaatacattgaaagaaatatatactttgccgggcagtggaataggaataaataataaggaatttctgtaaatgtttacacaaaaatgaaaaagtagaaactttatcttaaacatatttattttatttaatgtccacctgattatatgtatgagcaccacatatgtgcaaaagcatgcagaggccagaagagggcatcagatcccctggagttgccagctgccagatgtgtatgctaagaactgaacccaggtcccttgaaaagagcagcaagtattctccaggaccttctttttcatcttacacagaaagttaaataggaagtgtttatatcttaagaatattaaaggggctttcctatttatgagcacttggctgctcctccagaagcctgagttcaattcccagcacccacatggtggctcacaaccatctgtaatgagatctggtgcttttttctacatgcatatctgcatacatgcagcaggcagaatagtgtatacataatttttaaaaatctttaaaaaaagaaaaggaaaagaaattcaagaaagatccacaatcccatcacattaaagctcccttttacttttcctaaaacctgttttccaaacatatataaaaacaaaaataaactttacttacaatttgaatgttaagtagtctaagcatccttcattgttttcgcaactcgtcaagagctaaaatctaaaccagcagttctctggaactactagtggaaagaaaaaaaaagaaagcattaacataattttatttaaaacaaaacaaaacaaaaaaacattttgccttaaataagtatgactcgaacagtaaatacttaataaaacaaatcctctccagcgcagatggcacacatttacacaatgtaaattcacagatgactaaggaatcagaaactatttaaaaaatcagtgctgcaattttaagttaccactaaatgattaagaaaggtcagatccaacatacacagactatgctccgtgttatggagtatattacaattaaccaaaaggctttttagttatttttttaaagggggagagaatgcatcccctgaaactagagttacagaaggttctgaggcatcatgtatgctaagagtcaaacacaggtcctcttggaaatgttcttaactgctgaaccatctctgaagccccaaccaaaaggttctcagagcggtggtggcactgtgacttcttgtcctggctagttagctctatgtcaatttgacacaagctagtcactggacaggaaggatcctaaactgagaaaatgcctcagtaagatttgggcaggcttgtagagtatttccttaatgagtgactgatgtgggaaggcccagcccattgtggatttggccacccctgggcaggtagtcctgaattctgtaggaaagcacgctgagcaaggcaggggaagcaagccagtaagcagcacctctccatgtctctgcactacctccaggtgatgggggatgtccttctgtatatatatttctcttattggttgatgaatacaacactgattggccagtagccaggcaggaagtataggtggagctaccagatgagaattctggggagaggaagcagagagaggccaccagggagaccccatatagccgccaaaggactaacatgctggagtattctccagtaagccaaaaccacatggagatacacagattaatagaaatgggttaataattaagcagagctagtaaataagaagcctgagccgttagccaagcaatttataattaatataagtctctgtgtgcttatttggggctaaacagcagcaggaccagacaggacagaaactccgtttacatccaggttcctgtcctgtttgagttcctgtcctgacttccttcaatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaggcgggggaagcaagccagtaagcagcacctctccatgtctctgcactacctccaggtgatgggggatgtccttctgtatatatatttctcttattggttgatgaatacaacactgattggccagtagccaggcaggaagtataggtggagctaccagatgagaattctggggagaggaagcagagagaggccaccagggagaccccatatagccgccaaaggactaacatgctggagtattctccagtaagccaaaaccacatggagatacacagattaatagaaatgggttaatatttaagggagagctattcaataagaagccagagtcatgggtcagacagtttataattaatataaatttctctgtttatttgtggctaaatggatttgggaccaggcagaacatctataaattgacacactgaaacatgaaatttggagtcacctaaatctgtgtttccacatcatcatcacagtcctttcgtctccaactggctttttggtcatgatgtttcatcacagaaatagaaaccctaaataagacactcccctttggcagcaagaaataaagtttaaaaaacaaaactagggagctggagagatggctcaacagttaagagcactggcagctcttccagagggcctgggttcaattcccagcacccacatggcagctaacaactgtctgtaactccaagattttgacaccctcatatagacacatatgcaggcaaaacaccaatgcacataaaaaaaataaaataaattttaaaaactaaggctgggtgtgctcatgcacacctttaatcttattaaggtccataggcaggcagatctctatgagctcaggacagctaggattacatagttcaaaccctttcatagatagatagatagatagatagatagatagatagatagatagatagatagatagacaaaaaaatttaaggatgggtatggtggcccatgtctttttgttttgttttgttttgttttgttttgtttttggaagacagggtttctctgtatacgcctggttgtcctggaacttgctctttagaccaggctggcctagaactcagagatctgcctgcctctgctcccaaatcctggaaataaaggtgtgggctaccaccacccagaagcggctcattcctctttaatcccagcatccagaagccagccaggtctacacaactcagaccctttctcagaaacaaagaaatttttcaaaaaagccaatgaaccaagtaaactgaactcagagaaccacacaataacacaatatataatcatacttttaaaaacaacagacatggctggaaagatggctcagtggttgaaaactgtatatgaccaaggttcagtttacaacacatacatggcaactcacaggaatatgtaactacagttccagggatccaacaccatcttttttctggccttgtcaggcattgcatatacacactgcacatacatgcaggccaacattcatacatttatacttaaaaattataaatcctagcctggtggtggtgaaacatgcctttaatcctagcacccaggaggcagaggtagttggatctcagtgagttcaaagggcagcctgatctataaaatgagttccaggacaggctgctacacagagaaaccctgtctcgaaaaaccaaaataaataaatagataaacaaataagtgaaaataaataataaacctttaaaaattaaagacaaaaatacaaataaaaaataaataaaaattaaagacaaacttggaaacaagagaaatgatttgtcacacatgacagatcctcaaaaaaagtaccaggaaatatgtcatcagatttgtgatcacaagactagcaaagatattcaaagaactcaaagaaaaaacactgttgacaaagaacccttcatcatgcagaactgtccttcaaaagcagaggtacgaaaacgtcgtcagcaaatctaacagagttcatcactagtaagcagggccacacttcaggaactgctccagcgagccaacaagatagagcaggaggaccctggacctgaaggctctgtgaagaaatcagggccaggacacagaatgcagaacccgcactgtagtgaagtgctgctgcaaatggtttttattcacttttgtttttctgtgtgctttgagagactaacaaacttgttcaaaacatcttttgtcgaagagctaatatactactataaattccatttaactacaggttttatttttcatttaatttaatgagaaaattcattttaaaaattagtttgttttggagcacacatgcatgaaggcaaaaatcctgtggcatccaactgaaagagatggaggaatataaaggagtttttgtttttctggtgttggagactgaacacagggttttgtgcacaaggcaagtctaccactgagctagctctatcaccagcctagaagtagagggcttttggttttttattttatgtgtattggtattttgcctgaatgcatgtcttcgtgagggtatcatatcttggcgttacagaaagttgtaagctgccatgtggatggtgggaaatgaacccaggtcgtcttgaagagcagccagtgctcttaacagttggaccagctctccaggcccagacaagagtttttatgtcactaaaaatcacactgccaaaattcaagttactattcaaatcggattactacagattaaatgtaattccaatagcaaacagaaagaaaatagctataggatatataataggaaatcagaagcttgaagattctactaaaaaaaataattacatgcaaaaggaaacaatggtacaaaaaaaatgaaggcccaacattctgctgctgcatagacgatatgcaggaaaattactgaagtatctctttattactaaacactacaatcttgatggttactctaaagatttaatgagcacagagtcaagaggacaaaatcaacatgacatggctgccagtatttaccatcagagctcaagatgaagctactgcctggcttttagcccgcctaacctttcacatatgctcaaactctggggcagaagggctgagagtcaggaaaaatacatggagaaggtgcttgataatgtgaccccattacaagttaaagtttctcatttatttggtttggtttttttcaaaacagggtttctctgtagtggtagccgtcctggaacttactctgtacaccaggctgtcctggaactcagagatccacctgcctctgccgcccaagtgctgggattaaaggtgtgcaccacccagcaaaattaaagttttattcaaaatggtatttgatttttagtaaacttttttgatttttagataaagtttatggaaatttccagaagaaaacttatttttcctgttattccttataagaccaaacaccatttacatgaaatcctattatatacaacatttacccatcctctactaaaaagaagaaaaaaaaaatcctgctataaattaattctctagcctggaatgaaaagtcactacactacttttcctgtggctttctcaacacttggaaaaaaagaaataaacaaatgttccttcaaagctctttctcctcctgtggccagctgacctctgacctcacagtcccctcctacctgggctggctgatccaggcacagagcactcacacaattccccacaagcactgggttcttggggctcttgctcccctgcctggctcttccaaattataacaagatggacaacatttccttcactttccaccttctctcaacaccccttccccccaattacatttcatttacccgtagccctcttaccatcccctatttaaaatcatattttagattcattcactgtttaatgcctgtatcctcttccaaaatataaaacccatgagaacagtaaaataacggttacttcatctatgtccaaaaaacctaaaatgctattttgttcaaggatagttttatttttaataaattgtgggagccaggtgttggtggcacacacctttaatccaagcactcaggaggcagaggcaggtagatctctgtgagttcgaggccagcctcatctacagaggagtttcaggacagcctccaaagcaatacagagaaaccctgtctcaaaaaaccaaaaataattaattaattgtgggtatgtgtccacaagcgcaggtatcgcaccagccctgggttccctacaacagcagtacaagggctcttagtgtataagtcagctctccaaacaagtggacagttaggaagattttgacactttagaacaaaccccattcatgttctcttcagcttcttcagtctcattattcctctggtttgctgtgcctaccttatacaggatactaatcaacagcaggaagtagggagcaacaagtggctacatatactttatttccagttcaaagactgatgagattgcaaaatgacctatcttctttttgtgtttgttttgttttgttttgttttgtttttcgagacagggtttctctgtggctttggaggctgtcctggaactagctcttgtagaccagggtggtctcgaactcacagagatccgcctgcttctgcctccctagtgctgggattaaaggcgtgcgccaccaatgcccggcggacctatcttctttttagattctttgttttatgtgtatgagtgttttgcctgagtgcatgttaaagggggcattggatcccttggaactggagttaagaatgactgtaagccaccatgtggatgctgagaactaaacctgggtccatttcaagagctacaaccgttcttaacagctgagccatctctccaggtccctgatagatcttttaaatctataagggattctaagggccaagacaagtctcagaggctagaaatgcttacagcaaagtctcacttcccgagttctatccccaggaaccccacagtagaaagcgagaagcaatgcctgcaagttgttttctggcctccacatcaacgcacacccattcaaaataaataaaggtaactaaaacttcaatgttttaaatatatatgctgttcctgcctatcaactaccatgagtaattatataaaagctgaaaactgtttttaaaactatcatgtgagccaggcaatcatggcacatgcctttaatcccaacactgaggatgcaaaggcagtcggatctgagttcaaagattgcctggtctacagagctacatctgggacagtaatgcatatggagaaaaccagtctccaaaacaagaaagaaaataaaattcatttccaaataaataaaacctatgtttaaataatcaaagcagagtaaaacagctatgcattaaattaggcaatctcaataaaggtcctgaagttataaaaatgaaccaaatgaaaattatgttgaaaagcattacactaaaattaaaaattcatgccaggtgtggtggtgcatgactttaatcatataactcaggaggcagaagcaggcaaatctctgtgactttgagatcagcctggtctacaaaaagagctccaggatagccagagaaatgctgtctcaaaaaaaaaaaaaaaaaaaaaaaaaaaagaaaaggggggggggctcccacttttaatcccaggactcaggaggcagaggcaggcgatctctgtgagttcaaggccagcctggtctacaagagatagtaccaggacaacctccaagccacagagaaaccctgtctcaaaaaaaaaagggggggggtagaaagaaggaaagaaaattccttcaggctgaacaactcaaatccatgaacagaaatgcatacaaagaaatagatataaacctatataaagaaataaacatgcagtaaatataaaatgctcttttacaagacatacaactgaaagagcaaacagcagaagtcctgaggagaatgacagagctggtgatacctgactaggggttcagctgtacaggaggctgacttgagggtcacacatgcaacagttcctgactaacacaggccctgcacctcaagacaacaaagggaaaataaacacagaagactgtactattgtacattaactactgagaacagacaggatgggagggttgcatctagactgaagccaagtttctatgtcaaaataaagttgttcttaatctgaagtagttataataaattaaaaactatattgccgcatatggtggcacacacttgaagtgccggcactcagcacattgagacagtaaggttgtgctgaattataagcaaacctaggctacacagtgagcaacaggtcagtctggagaatctcttttttaaaaaaacaaaaacaaataacataggaaaagagactgttaggtataaaaaaggttgtcctctgatcacctacgtgctctgtagcattcgtgccctatgcatacacaaatgtaagtatcactcgattgctgattggtatgaggactcgcccactaagggtggaaggatttcttgcacaggcagttctagacagcataaaaaagctatctagagtcagttcttggccggcagtgatggcatacaccttcaatcgaagcactcaggaggcagaggcatgagttcaatgacaagctggtctacagaaagaattctaagacagccagggctacacagagaaacttgtgggggacgacccccaagtttcagttcagttcccagcacctaagtcaagtggcttacaaccactataacacagacacacacaaagaattaaaagtaaaaataataatactaaaaaaatgacacaagtagaagtcaagtagagaacaagcctgtaagcagcattctcctatgcttctgcttcaagctgctgtcttgcctttcctccatgaactgtgacagagtaagaccaatcctcaaattaattcccaaagagaaaaacccagggaagacagtaaaatttcactggtaaattctatcaaatgtattcaaacagtaacaccagtccttcacaaaccctcacagtaaatgagaggaagaaatactcaacacacccctcaaggttagtgtaactctagaaccaaaccagaggaaacatcacttctcttggctaaaattaagcataaatcaaaatatatataaaatgaaaaaaatttaaaaataagtcaaaatcactaaatcagaatccatcaatgtataattgtttgcattgactaagggagacttatcctggaaacccgcttcatacttgaaatgtcaaatgacataatatagcatgctactggaataaaggacaaaccatactatcttatagtgaccaatcatactgatttgtgtaggactgaagggctttccaagatgcaaaatttttgtgctaaacaagggcagacccaggtaaactgtcacagctggtaatgccaatatcagtctgtgactggtctaatacccatgcatgtttaaaaaacacaacagaggagcgcctgctacaaaacagccacggccagcctcctatgaacctggcaaatgccaccaacctagaggatgccatcaatctggcagatgccatgcaggctctcgcccacttctaatcagccttggacttcctggtggttctactcaaaggaaggaaagaaaagagggaaaacgagaaatgtattctgattagacaatgcaaagctaccttcactcacaggctatatggtattgtacgtaaaaaatactgcagagttcgcccaaaatactggaagaataattacttcagagagatgaaagtatacaagatcaatatgcaaaaaaaaaaaaaaatcagtgcagcttctatacaccagcaataaaactggcacaacattttaaaagacaactacatccatgcacccaggagatgacttaggggtaaaggcacttgctgccaaacctgatgccctaagttccatccctaggtcccacatggggaaaggagagaacttagtcccaaaagttgtcacacagtacatcatggcatgtgcacacacactaaacaaatgtgaagaaaaagaactaagacaattccattcacagtatcacctaaaagaataaaatactcagaaaatacactgaaaaagaagtataaatattatacatacatataatggaatattagtgagcctttaaaaataagaaaattctgctatttgcaacatggataaaccttgagaacattatgctaaatgaaataaggcagacacagaaaggcaaatatggtcacatgagttatctaaaatagccaaattcaagcagagaacaggggtcaccaggaactggcagcttaagagggagatgcctagctatccatcaatgtacataaagtttgagttttacaaaatgaattctagagatctgctataccacattttgatcatagtaaacaatactgtattatacacttaaatacagctacttttttttttcattacaaggtagccactcagcttgtaggttctcttttaaagtatgaggtttattcactgaaaaatataaattctaaatactacttaagatcagtaaatgaaattctcatgttcaatgtggtaagaagggaattcttggccaggcattgctggcacatgcctttaatcccagcactcgggaggcagaggcaggcagatctctgtaagttcaaggtcagcctggtctacagagttctaggacagcccagtctataaataaaaaccccatctcaaataaacaaaaataaattttaaaagggggggtgggggctggaaggatggtttgtttattagcatgtttaaccaagaccatgagaaaaaagacaggagaggacaattatgattgccgactatgaaacaataacatcactctgaatcgaaaggaaaactcaaaacttcaatgagctagccactccatatccattaacatgaccacatcatacctactataactgaaaaggacagacagtcataagtattgacacagagctggaaagatggctcagcagttaagagcaccgaatgctcttccagagagcccaggttcaattcccagcaaccacatgtcagttcacaactgtctgcaactccagttcctgaggacccaacacccttggcaaacaccaatgcacataaaataaaaataaataaatttaagccggacgttggtggcacatgcctttaatcccagcacttgggaggcagaggcaggcagatctctgtgagttcaaggccagcctggtctacagagtgagtatcaggataggctccaaagctatactagagaaaccctgtcttgagaaaaaaaatgaataaataaatttaaaaaagtaagtgttgacagtatgactgtttgagcatgcaacttgttactgccactttgagaaacagtttggaagtttctcagaaagctaaacaagacacagtagttccattcccatttgtttactcataaaaaggaagccatacatccatataaagacttgtaatcaaacattcatggtgtatcattttaaacggtctgaaactgcaaacaatccaaatacctatcaaccagtcaactgacaaatgtagtatatccacaaaatatatattacttctcagcaataaaaaggaataaagtcccgatacatgctacaatatagaaaattctcagaagtgtgctaagtgaaagatgtcaaatctaatatatatatatatatatgattccattatgcaaaatggccagaggaagcaaacataggaacaaattggtgacagcctaggtagggctggggctttggggtttgaggccaacaacaaataagctgaagaaaattttgggggtgggcataaaatcatattctaaagaaagtctgggatgttctcaatcccatacatttattaagaaatactggattatacactcaaaatggatgaattatttttgctattgagccaaaaggctgatttctttaaaaaataccactccaaagagaaatgaaagaatattactcataatagccaagaaatggaagctcaagaacctaacagctgatgaatgggtaaatatcaggaagcctatgaatgcaaaggagttattactcagcaaaatagtaacaataaagtactgccacatgctacaacatgcatattttaaaaactttatgctatgtgaaaaggaccaatcacaaaaggttacattgtgtactcgtgtacttacataaaatactgacagatgacagagatacaaagtacatgagtggttccctagagccagaaggatgggggcagaaaggagtaggactgctcgtgggtatgagagttggtcggttagtttctttgactggtggcactggggatcgaactcaagacctcccccatgcaaagcaaacactgtaccactgagctgtaccacatgccgacccatgtgactgttttagaggtaaagaacatgctttttaaatttgagtacagtaattgtgcaactctgaatataccctaaaacctccattgaacttgtacattaataatcaactaaatggcatgtggttagtatttcaataatgcttctacctctccccaccccgacccattcacaaaaaaaaaaaaaaaaaaaaaaaaatacataacctgtgaactggtaaaactatcaactttaatttggtaggcccactacaaccactgaagagacttgggattgaaaaacctccaaattcttcccaagcatactctgggtatgttgtaattatttatgccttcaaagtacaatgattaattcaagcaatcaattttttaaaaaagggtaacattgcaagcctttaaacccagcgcttgggaggcagaggcaggcagatctctgtgagtttgaggccaacctgatctacaatgcaagttccaggacaaccaaagctacagagaggccctatcctgcctcgaaaacaaaacccccaaacaaaatattaaatactgaaattttaaatgttgaagacgctttaaatttctacttcttgtatttactaaatgtatcaactgcggccacatgaatgaactctatacattgtcttctataaaccttattcccagtctcacatgaagtcattcaaccctatgaagacaaactgtaacccacaagtatacaatcttatctcagtaaggcccggacggacattgttccgattctggcacttagggaaagtaagtaattcgactcttaaccaggcctcggagaaaaaagaaaagcaaaaatctgaagatcaaaggagcgctttctattatagtttctcactgccggattaaaacagaaaccacagagtaatgtcatcaacacgagacagatgccccagggttccagggacgcggccccatcttactctcacttgataagagtactaagaacttaaataaaggctattctgttgaggacgtggctcctctgaggacagcccagcaagttggcccatgaggggcatcggaaactgcactggggctgactcccggcaccgtgggttatttttctgtcctttgctgacagagtgaaaatgtcccactgaagccctgagtgggtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgcgaagtaactcaagtcccgggatcttcggggccagggtgaaggagcgcgtgtgagtggagaagggagactatgttgttccaagtgtccgcgaattggggaggaaaaaaaaaggaagccagcagaagctgcaggcttctggtttgcacactttcacacaaaggggagcctctgagcagggcactctcacgcgccttccagggcacaaaagccaatgacacggtgcccgggatgtcctgcgttttgcagcggctcgctaatggtctttcttaggctcagttatgcatgcaaacgcccgggtctctcccccccaccaccaccattccccgccgccacggctggtattcgtttctttaacaaagagcatcggcggctgtcccggtgcgcgcgggggctgatcctgctgtgctcagactcttgcagcctccctgcgggagactcagctcttggaacagcatccaccaggttaatttctgggctccaaccggactgtttttgatgctctacaaccggtttttacggaaacgaaatactgagctgtttgatagctgtttaaatgaacgtgggaaacgtggaaatgaccctggaatagggctcaaatgttggagacaaacggaggctgctgtgttttaaatcccttgatgaacgtaagaatttaacctcatttaaaaagctgttaatgcctagttggaggtaattctttcgaatcataaaaagcaactttttaacaagacattctctctctgagctgtagtagaaacctgaattcgcagagtggttaatcagtgatcctcttaactcgtgggaagttttcagtcttgagttcaaaggcttggtgaccattgacacccctctgaactacatgtatggagtctcagtaactttcagaccttaaatatataagagggtactgcacacacagcatgcttttctggaggacagtgtttctcctatttcttataaaatcagttatcacatatgagaaccactgcccactttggcactttctgagtaagaatactgtatctctcacatggcaggagcttgctttctttagttaaagataaatcttacatgcaggaacatcctattcctgttagctactttcaaaagaaatgtttctcccatttcccatctagagtaagctggaaagtcccaggcaaaaaacttcctgctcttgatttttttttttttcactgttaaatgcgcgcatatacttttgaaatgtagatctgagagctgaagagatggctcagccaacctcatgatcttcccgaaaacctgagccccaacacccacattatgactcacaaccatctgtaactccagttccagggtatccaatgccatttttttttctagcttctgtggataccaggcatgcacatggtgcaaagatacacatgtaggcaaaacactcacacacataaaataataaaacaatgctctttaaaaaagaaatgtagatctgttgtaactcagatttaaaacattcctccaccctgttgatgttgaattcagataattttatttgcttctggccaaagtaacatgggcagaagttacagtataaggattctgaaggtcctggcctcaagagttattgcatgtttctcctcgcctccctagcacttctggcttacacaatttgaagaacatgtctggggagtctgctggtccaagaaagattgattacacacacacacacacacacacacacatacagggaatggcccggaacaattctgagcttatagccaagaacctgtatgttgtgcaacagttgaaaaactccatcctgaagggaagctccttaagcaggaagattaacaactcaaaagagcttcaggaagtccctgaaactgaccagattcactaggcccctccctgaaagagtaagcaataaaaggtaagagttcctctcagaagagcaaagccaagctgcagagaagactcttaacaccagagcagctgcctggaagaagcagaaagcagctgagctgtctggaagagatttagcccaaccgaggcacctggaaaggacacgctccaacctgttgagctgcctacaggctgtgcagtgtgctccaagttcccagctttgtgagctgttacctctgctggggtgggctttgctgatacagctgcctttgagtcatttctgttcttgtaaagaacccctcacctatccttctctaagtaacccaataaaactcattggttcaccagattggactttggtgatagctatactttggtctgtgtaggttctctaactcaggtggtttgtcacacaacattgaggaatataaggttttttttgtttgcttctttgacatggtccttccaggtgtgtttcttagcataggccccaacataaaattcctaagattatagatatgcccatcaacacacctatgtagtacaccctgctttttgagtatgttgagtatgccagatgaaatggtctgctgtctttgtactagccaacatggtaaagaatgaggatctctgagagagctcttaggaagcaggcattcgaaagacacaccttttgtagaaagaagcctagtaagaaatgagaaaaatttaccacaaagggttttttaagaccccagggtcagggggaaaggttgtctgatgaagccaggaatcccagcagcaagctaaggatcatgcaacagatagctatgttataattgcattgattttatttttttatatcacataattcatttcttgattctacatgtgtgccattaatatattgtcatcattgtttttcaaatactatacaataaacatattacgaattcaagtctaagacaggaggtgatggcacatgtctttaatctcagcccttaggaggcagaagcagacagatctctgtgagttcaaggccagcctgctctatagagcaagttccaggacagccaggactacaaagagaaacccagtctcaagaaaccaaaaaagaataaaaaggaatccaagtctagggagatagttcagttgttaaagtgcttgctatgtacgcctcggggacagggtttgagccccagaacccacgttggtttttttttttttttttttttttttttttatgatcattggtattctgcctacatgtatgtcagaagccctggatctggatgtacagacaggtgtgagctgtcatgtgggtactggaaattgaacttgggtcctctggaagagcagccagggctcttaactgataaaccatcgcaccagcccccagaatctaagttttaaataaaaagtcagtcatgagctaggcatggtggcacctgcatttaatctcagcccttgggaggctgaggcagcaagagctctgtaaattcaaggccaccctgtctacatattattgaactgtaggccagccaaggtgaaaccctgcctcaaacaaacaagcctggttgttgttggtggcacaagcctttaatcccagcactttggaggcagacgtaggcagatctccatgagtttgaggccagccagcctggtaagttccagcacaactagggctgtcacacaaagaaaccctgagtctcaaaaaaccaaaacaaacaaaagtcaggtaatggggacttgtaactccagcacaggtcaagatctggtctaggcctcctgaggaaaaacacctgagggtgacccctctagctggctccacgtgcacacacaccagagggggagaaaaagttgaatccaactccctctatacttagcctttcatacttttccagtcattccacacctctcctctttctcagatgcccataaaaatagtttagcatgtgccggagtcctctgaaagagcaaaaagtgctcttaggcgctgagccatctctccaggcccagtttcagatgttttacgtgcacatatatacatatgcatatgcgaaggcaaattaaacatacacgggattatataacatgtgctggtgaaatatttttatatcttttctctgtgtttatttcccctctgttctctttaattacacagaaagtctttttaaattttagcctgtcttctgtaggacaagctgagcaaaagaagaggttttcctgctttaatatcagtatgttaaacgggagaaggactagttagggcccattgtgggagtagcagtgacaattgtcaggaaaacacaagaggaaactaaatcctcagacttggccaatagactagttccctctactaaccaggatatttgcttttgggtgatcagagttatttttaattaaacaaagctatgttattttataaccttcaaagtcagtccaagaacaaggtataggctattctgaccttgcctgggcactcacacacggtcacttctaacacattcagttagtggcctacctcagtgtgggagaccactactcaaatatcttaataccaaaagctgagagtggtcagggaccatgcacacaacagtgagtgtgacttaagcagtgtttaaactcatgtctctttcatctcaggctgggatagtcctggatgtcagtgaccacacacactttataaaatcaatcagaaaaaactcttatttggcccccccttaaataaatggttctgagtgaccagccagttgaattctggtgttgacctaccctgcctactgtggacaggtatcgatacccttcccactctcctttctgagcttctgcagagaagataggattccttttgctcattgcaaaggaattcagtctctgagttcattttttgatttaggtattatctggccttttttttcttttttttttttatgtgtaagagtgtattgactatagggtgaggggaagtgggaggaagtggcacctccctttaatcctagcactcagggaagcagagtcaggaggatctctgtaaattcaaggccagactggtctacagaatgagttccaggacagcaaaagcttctcaaagaaacctgtcttgaaaaaaaaaaaaaaaaaagtgttttgcctgcttgtatgcctgtgtaccacttgcacacctattgtccaaggagaccattagaatgaatgcatcagatcccctgagtctgagattacagacagttgtgagttaccctgggggttctgggaattgaacccatgtcctctggaagagcagccagtactcttaactgctagagtcatctctccagccccttttcttttataaagcagaatcttttaaaacctatgtagtgatcaaattacaaacacagctaggcagtggtggcacaagctctgctctcaggaggcagaagcaggtgaatctttgagtttgagtttacagaactgagttccaggacaaacagggcatacaaagaaaccctgtctcaaacaaaacaaaacaaaaacaaaaaaaagatctgtctcagatattcacaaaaccaaattgcttttgagaggacatgttaaatttctagactacaaggagaaacaatattttttacatttatttattgtgtgttcctgttgtgtgcaaacagatgccaggacacacttgaggaggtcagaggacaacttaagagactcagttctctccttccaccatctgggattgaactcaaatcatcagacttgacagcaaatgccattacttgctgaaccatctcactgaccttaatgaagcattttttttttagtttgttcatacccttctcccacctggaatttcctatgcatacctggctgccctccttcaattcatagagacctcctgcctctgcctctctaagtgctaggattaaaggcatgtgccaccatagctagctcccaatgaagtaatctttcaggatgaaatgtgtagcatcaaatgccatcagataaaatacgtaggaagtataaagtattcgacatacaaaagaagttaggtcctcaggattatgtccacataatgtcttctactaaaacaggctgtcatttcatatttgttcttggtgttcttcatatataaatacacacacacacacacacacacacacacacacacatatatatacacacatatatatagtacaacctatagtatataacatacaatatatatcatatcatatatcatttgtttataatataatgtatacctatattatataatatgtacattatatgatgtatatgtatcgtataattatatacattacatgataatatatatacacacacagggtttttctgtgtcaccaaccaccctggcagtcctgaaacttgctcagtagggcagtctggtctcaaactcctccagaatgctgggtttaaagatgtgcgccaccatggcccggctcccttttggtttttgagacataattttactctacatcctaggctgtcttaaactcacaatgaagcccagggttgctgacctcatattcttggcaatcctcctatctcggcctccctctggagtcctgggattaaaggcttattttatctgttcatgtcaaccaccaaggacaacagatacggtcctctgctccagccttcacactagcatcacattccattcttccaaattcatgtatggtgctacccaactcacttctgccttgcctgcctgctctgcctgataatccaagctctgttgcaaaggccaggctccctagctccagacatcggtatttgccaacagagtcctctgcctccgcctctggcttctgtatcctgctcttccttcgccccttcctgtctgagcacattcttttctgtaactgctagttaactgttactagggagagacggggagtaggaggagtggcagagagagtcaagataagccagccaacatggtggttaactgtgctccctggaggtccaggattaaacatgaattcccaacaagaaacagttggaagaaatgagaagaaggcttgagagttgtaaaatataatgaaggccagtgaggtagctccatggataaaggcacttgccactgagcctgaagacctgagacccacatgttggaagaagagaaccaaattattctccttcatatatgcactgtgtcataaactcccctacccatacacaaaataaatagatgaggggcagtggggacccacaactttaatcccagcactgaggaggcagaggtaggcagatctctgtgagtctgagaccagcctggtctacagaagaagttccaggacagccaaggctacacagataaaccccatctcaaaaagaaaaaaaaatgaatagacagatagatagaagcatgtatgtgtgtgcctggtgcccacagaagtcagaagagagtgtcaggttctctgggaatggagctcaggtggttgtgagccatcatataactgctgggaatcgaactcaggtcttttatcaaagcaacaaaaggtgttagctgcagagccatctctcaagccccactgtgtaatgattcttttttttttttaaagattttatttatttattatgtatacaacattctgctttcatatatatgtacacaccagaagaaagcaccagatctcataatggatgtttgtgagccaccatgtggttgctgggaattgaactcaggacctctggaagagcagtcggtactcttaacctctgagccatctctccagcccatgattctgcagcagtatttcctagacagactagaaggatagctaattaaaatttgggttttgttattgttggtctagaaaagcttgtatcggcctcacaatttgtaatctataatatcttatgaactcttaggtttatcgttgatttaagaaaacatctgtcacatttcttttatctagaagtatttggggagctggtgaaatgtctctcgaagatcactggctgctcttcaagaggatcggggtcctattcccagaagccacatggaagttcacaccagtatctataactccagcctgaaggattctgatgccctaatctgaactgtagggtgcctttacggtacctgtatgcatacaacatacccccacagagacacaaatacacacacatacacatacacacacacacacacacacacacacacacaattttttgctgttgttgtttttgtttttcaagacagggtttctctgtgtagtcctggctgtcctggaacttgctctgtagaccaagttggcctggaactcagagatccacctgcctctgcctccaaagtgctgggattaaaggcatgtgccacccaaagtccaacttggtgagccaatgagttgtattaggaatatgggtgagggattacttacaaaagcaaaaatgactcaaagacagatgcatcaataaagcttaccccagcatgggtgacagctcacagcctgtaggcagctccacaggttggagggtgtcctttccaggtgcctcatttggtgtaacatattccaagtcattcatctccttcctgcttcttctaagcagctgctctggtgtccgggtcttctctacagtttagctttgctcttctgagagggactctcagagcttattgcttacttgggccaggaggggcctagtgaatctgataagtttcagggacttcctgaagctcttttgagttatcttcctgcttaaggagcttccctgcaggatgaaatgttgcaatctagataacactgttacacaactctggtgcaaattactgcaatagtctaaaacctcaaacatcgaggaagcagattttctcacttcaaattccctcccacgattaaaaacaaaaataattctgtgtgtgatgttaactcttcctgggaatgagtcaacaaatatctgtttataccagttagggaaccaaggacagctcaaggtaatgattccaccaaagtccaacttggtaaccaattactttgttggccttgcttaacaaacatgagtaagggtttacttagagcctcatgggtgaccccagaacaatgtcaccaacaaagtctcacaccatcataatatcgacctctgggaacttgcatcattaaggaccaaagttaaccttcctcttcctttagaaatgctaatgtttccctggatcccttgcagctggcaggaggtaggaaaagtgtagtcaggaggtggtagggctgtaacgtttggaattccagattccaaccctgttaacattcacttcccttcctaactaaagaatgtcaatagctccatagcattgtcagaggcctacctatctccacttatttcattgcttgaattatgaggaaatcttataccccagtatggcaatgggatgcccatgttatacccacaaggaaaagctatattgcagtatactgtcttgcacagacttcaggaatgtgcaactagagagatggaagtcggacacaggctatggttaaaaaaatctcacttcacagtttatggaaatgctttgaccactcgcatagacagatttcaagggcccacccacattccttccctaaagtcatcagtttgagaggccctgatgttcaggttcaaactgatctgaggctcatctgtctcccaagggttctccagatcactttccggtaatatactgtcatttcctacttagtttagatattcacaacccaaagtgtctcattcaaaccagtattagatagtgtttgcagattgttgaattagaacctgcagcatgggaacagagactggaaagcctactacacctggtgcatcttacaaccctggggaagggggttgctgtgcaatgatttgtaacgcatgggtctcatgcccaactactatttaagcttttctttttttattaaagatttatttattgccgggcgttggtggcacacacctttaatcccagcactcgggagacagaggcaggcagatctctgggagtttgcagccagcctggtctccagagcaagtgcaggataggctccaaagctacacagagaaaccttgtctcgaaaaaccaaaaaagaattatttattttatgtgaattgtttgtctgcatgtatatctatctgtgtgagggcgtcagatcccctgaaaccgagtgagagatagttgttctaggtgctaggaattgaacccaggtcctctgaaagagcagccagtgctcttaaccacttaatctctgtagcatctaaggttttcttttagctcactagccaactcccattctcagtgttctgtttctcaataaactgtgagggttttttccttttttttttttttttttttgagacagggtatctctgtacctttggagcccatcctggaactcactctgtcgaccaggctgacctcaaactcatagagacatgcctgcctctgcctcctgagtcatgggattttgtttctaaccaagtgtccctagtctaactcttgctgtggtacctatacacagatggaccactgtacatgatattattttcagcatgaatgcaaaaccacaactcttaccccaaaggggataaaaggtggtataatttggagccaaatatgaatgaccacagccctggaatttaagttactccaaattctatatttcaacatggaagctgtttaggggagtttttatggtaacaaaacaaagttagacatcaagacacttaaaaacaaacagaaacaaaatgaaaaaaaacttttaatttgttttctaaattaaagtcactcattttattttatggtgttttcctgtgtgtatgtatgtgcaccacattcatccttggtgcccacagagatcagaagatgtctttaactggaggtagaagtggttgtgaaccactatcagtgctgggtatcaaatctagctcctttctctccaagagcaacaagcacttttaactgacataccacctctccagcctgactttgtatttcctatttatgtggatatgtgcctgtgtgaggttatgagtaccactggggtgcaggagcccacagaggtcagaatagagcactgaatcccctggaaccacagtagagacctttgtttactgccatatgggtgctagaaccaaaacctggtcctctgcaagagcagtaagttctctaaactgctgagccatctctctggcccaaaacaccttttaaataccttggtggaaattaagtaggcacacagcagagaaatctcagctctaaccctcagatgttacctgacaacattcttaggttttattttgataaaagctagtgtctgctaaaaaaacatattgcaaaaggtttttttatttattaatcacaggatgttaggaccaacacttaggtgggtaaggaagggctatttagggagcctaaatatagcacaagataaatagtagttagtttctggacttgcaatattccaacctctcattattactgcagttctcattgaacaaaacaaccccccaccctccaccccccacccccgccattttggcagccatgacaggctaacgtgcttgcctgaccttgctgggcctgccctggtcactaggaggtcagatgccctcctcatggcaatgaaccaatcagaagttagctggccgggctatgctttatgactctgggtgtgctttatgtacaagtgcactacagtgccgtgcagagcataacaaccaccctaggagggcctatggggcataaaagcagttgaccaatcaacacagggcaggttgtcctggaagcacaccaatcctgagactgttgcatacccctagacactgccctataagatccctgtctcgtggtttcttggagtcattctccaaccatctgccacagtggatggatgaaaggtccaagctaatgaggttagctcgttaaacaactgcaataaaagactctttgcttttgcattgaaatgggcctcttggtgattttggggttcagaatttgggcacaacatcagacacagctgctttccaagaaacatcagagcaggatgccttggtttgagctgatcctgccattgaagatgtctacacacagtttaagtcagccctagcctaccaggcagacctcccaagacttttcttcctcccttccttgctcttttttgagggtctcactatgtatcactggatagccttgaacttggagtctttctgcctttgcctcccgagaactgagattaaaagaggatgcttctgtgctggagagacagctcaatggttaagagcactggctgttcttgaagaggatcaggttcagatcccagtatcacatggctgcttacaattgtacaattgtacaattgtcagctctggagactccaacacccactctggtctctttgggtatactgcattcatgtgatgcaggctcacacgcatgaaattttttgttgtttttggttttgatggtttttttccgagacagggtttctctgtgtaacagctctcactatctcggaagtaactctgtagaccaggctggcctcgaactcacaaagatctacctgcctctgtctcccaagtgctaggattaaaagggatgcgccaccaatgccctccggctgaaaaatggatgctgccacttgtctcactttttcattctcattctctctctctctctctctctctctctctctctctctcccttccccctcccctccttccttttccttttctttttgtcttgttttccgagaacagttccagctgtcctagaactcactctgttggccaggccttgaactcacagagatccacctgcatctgtctcctaagtgctggaattaaaagcgtgcagcaccactgcccggcccttcctttcttttctttttttaaattaatttatttttgccatttgaatcccagttccccctccctcctctcctctgtctacccccacttccccctcaccccacctcccatctgctaccttaggaagtctactaagtctgtcccaacatgtcagtgaggcaggtccaaggcaccttgccaacccccacacccctctatgtcctttctttctttttttttttttttttttgttttttttttttttttttttnnnnnnnnnnagaatttctctgtgtagcttaggagcctatcctggcactcgctctggagaccaggctggcctcgaactcccagagatccacttgcctgcctcccgagtgctgggattaaaggagtgagccaccaacgcccgactatgtcctttcttttcttatcttttctttctttaatagtttattgagtaactcttttattattatcattattaattatatgtattgacttttcatctgcaggtatgcaccactagtgagactggtgcccaagaacaccaggagaaggtatcagagcccctggaactgggtgctgggaattgaagccagcggagccacctctccatccctcaagagttttctcaagggagtctaggcgcctcattggtcacaccttggaccttcccatctgggtgccctttcagaaggtgttcctaggcaaaattccctcccttgccctgtctgtcagaggtacttgtcttttagagtcaactatctcaaatatcacacccagaaagcctttctggtttctaaacacatccctcaacttcccttggactcaccacagcttctggtttttgcttacccaccagcactgtattttaccttagtttataattgttgtaatcagtagccttaaatctcagtctctaaaggcagcaagcaagggcaagggtggatgggatatgttcaaagtgattactggaaatttcttaagaaggtactaatttaaggaacaacttactggcctgcactctcctgtgggattgaagacagcactgccacagcctacatgaaagggtctgactccagggcctggagagtccatttagcctttaaaatctccactgttcttgcctcggatctgtgctggttcccagcacccacgtggtggctcccacatgcctgtaactctagttcgagaggatttaacatactctctgatctctttaggcatcaggtacatacatggtgcacagacaaaacactcatacacataaattatatatattaattaaagatttaagatctgactgcacagagggccctagtatactaactgcaaaatcttcaaggcagagtcacagggcccaacacaccttaaccccagacatgtgataagattgctgatccatttaaattcttctctccttctcttagagaatgcaattgaacccatgtactctaaaagcatttacaatgggattttacagtacctaaagtagatttaggagtgactaagacacagactctgacaataaactaagttgttcgattcctagcaccagcacttactaagatgtatatagccttgctgaggtacttaatcgcctgttttcttacacctccacttatgtctacaaaatggaatagtaataaggccaagttaataagcttgtttgaaggataaagtcagttaatccataaaagcatagtacttaccctctaagtctctgtggctctcttctgttggtagtgaggtccttttgttctgtagtcctggctgtagcctggaactcagcctgtagctcactcaagctgacctcagattttcagtaagcctcctgaatgctgagattcataggcctacaccatgcgttgccagaccctttatattttgaatgaaagttacaggagttaatatatacatatattatacactcggtgcctgtgttgacactcagtagatatgagctggtattacttgtcctgtcagtgtctcagtgttctcatctgcaggaggagaagatagtaatgagacctctctcatttacttgtgaacaactaaataagaagtactacataggcctgctggctttcactcacagcactcctcctgtctagcctcctgaatgttaggattaccataatagctttcaagttcccaatattcctgatttagggaatgtcattgtgtggtatgtgtgtgagtcagacagagacacacagagagacagaaagaggtatgcacaggtgccctctccatgcagggctcatggtggccagaggctggcttccagtgtctttcacaataaggtttctatagcttattttcggagccatggtctgtccctgaccctgaaacttgctgatttggctaggctggctggccatggaacccggaggattatctgctgtctccaccccccacctccagcagtaggattgcaggtatgttctgctgtgcctggctcttatgaagatgctaggggctgacggaagatccttatgtttatgtttgtgcagccagtactttacccatggagccatctccctagccctcaacaccctttttaaaggtcaaaaaaacagaacaaacaaagaaaccaaccaagtttgcttgctttctaattagagcatatcacctgttttgttatgtaattgctggcatcttttatctctcctttctcaatgggagtcctaagagtctaattcaggcttggtgccaagtgcttttccttcacggagccatctcacctcaagttttgggagacactattgttagttcagggaagcctgaggaatgcagtccatagtcaggcaagcacagtgaactgtatcctgctcttgacttccttcctgtgaatgggaggcaggggtacaggtgagtagtgggttgcccttgctttcctggtttccctgatgggcatggctgcctcttgtccatcatgccagcttccagacaccccacactaccatatatgctactgtgttccaagttagctatgaaatagaggatgaccttgatgtcctcttaggtcctccttgctctacttcccaagtgccaccatgcccatcacaaagcacatatatatattattttaaaagcttgagcaggagaaggagagagactaaggtagatataggtccttgctgtactttgtttggatacctgttcatcattttgaaaaaatgagctgggcagtggtggcgcatgtctttaatcccagcatttgtgaggcaaaggaaggtggatctctgagtttgaggccagcctcaaggaagaaaggaaggaaggaaggaaggaaggaaggaaggaaggaaggaaggaaggaagagaaaaaggaaaccgtgtaaattctgcacttccctttgtgctctctaacataaccatgcctggaaagtcagccacttttctgacatgtccgaccatctgtactgtacactaggtaggtcatatgagactggaaaaatcgtgggctcagcagctcattcgtttatgcagccaaattaacaaaccctagaaatccgatgtgaattgtggaatctgtagtaattactgaactaaccagatgctttttatctcattgctggcgggtggggtggggtgaggagagatttcagtctcgtggctcgttggtctaggggtatgattctcgctttgggtgcgagaggtcccgggttcaaatcccggacgagcccagtttttttactctccatcttttggaaaaagctgtgaagttcctcctgttaagaccccagaaaacagcaagacaagagaagagaggatagcctttccgtgaaagttgattggttagaagtaccctaggaacttctataattggtgcctttgaactacagatccagagactggtcgacccagatctactggatattccgaggtcaaccacacctgcagcggagaggaatttccaactctgaactgagtacccggtgccgcagagcggctaggacacagtgactgtcctgggggagggaggagaatcgcaggccgggaccagggagtacgacctgctgggtggtccatctgcaccacccgtgtgcaccctttcgtcgggcctgaggtcacgcgtgcgacgagcggctagtccagtcagtaggctggcggctctcagcagctgcctcttatccaggttttggcctttctggtgggcgaggagggactcacaagcgggaaatgctacagcagcttcgctataccacaggatgcctcgccgccgactccgtggccgggatcttggaaggaccgtctgtcttgagcagtgactgtgacctctagagcgcgggcttccacgtggcagcgagaatcgccagccaagcaccaagtagcatccgcgggcccagatcaagggaaagcctcacccgcgaactaagggtttctcaatttgtgcgtgatggagagggaccagagcgatagagtccctcttaactacaatctgaattcaaactttcagggcgtgtctgaaatctgactctccttccagctctgtccttcaggtcccgcccctagacgtctgaatggtcataaaatggaccaggagggtaggtttgtgtggctcgttggtctaggggtatgattctcgcttagggtgcgagaggtcccgggttcaaatcccggacgagcccatacttatgtaaattgtaccaggctgcgaacctactatactaaccttttaaagacctaaaactctgcggcccagtggtacttcatagaaaacagctaagtcttgccaggtgatggttgctcacttctttaatccccacacgtaaagtagaagtggtgaatctctttgaggtttgaggccaggctgatctacaagagttccaggacaagaaatgaaagtaaacaaaaacaaaaccagcagcacgtggctcaggaggacaaagttgtaacttttgttttgtttttgtttgtttgtttgtttgtttttcaacacatggggtctagatataagagtcccggctctaataccggctataatggaactaaactgtagaccaggctgtcctcaaaccacgatccgcctgcctctgcctccaaagtgctagaattaaagatgtgcaccaccactgagggtttaacatttaaaaaaaatatgttttgttttattatttattgggggtggggggtagaccaaagaacacatcatggaagtgggttttcccttaccaccatgtgcgtccctggggacggaactcaggtggtcctcccagggaaccagagctgatgaggggagctggagcttggatagaaagagtggcatgttagaatgagagagccctagttccacaagagggtttatttaggtttaatcataggggaaagttgggctagggaaagcctactggttgttagttttgttgttaccagactttgaatctaggagctcaagtcaagcactacttcttccagcagttttctcttcttccttccttccttccttccttccttccttccttccttccatctttccttccttctttttctttctttctttcttcctttctttctattacatttatctatctcgtgccagcgtgtgcatgtgtacatgtatgtgtgtatgtgcatgcatgtgtgtgtgttcgtgtatgtttacgcatgtgaaagtcagtgggcaactttgaggaactggctctgtcctccagttcaccatgtgcagtctggggactgaactcattcatgcttggcagcaaacgcctctaaccacagagccatctcaaagtccctgttttgttttatttatttgtttatttatctatttatttatttatatattttgaggcagcatttctctgtgtagctctgactgtcctggaacacgatttgtaggccagactggcctggaactcagagatctacctgcctccacctcctgagtgctaggattaaaggtgtgtcactacactcaggtcctattttttaagtagtacattgaaatattacctggtacatttgggagtcagaaaagtgattaactaataagttattaatttatattttcttgagggaaaaaaggttctttgaagggcaaagctttcgccccatactctagctatgtcatttgtaaggcttagtgtaaaatgaaaatgcagggcctttcatataacaatttagagattgtcagaggggggtgggaggtggagggtggggaaaggaggatatgggggtgggggtacatgcctttttttcctcagcactcgggaggcagagacaggatctctgtgagtttgaggccagcctggtcctcagagtgagttccagaacagccagagctacacagagaaaccctgtctcaaaaacacacacacaagaaagaaagaaagaaagaaagaaagaaagaaagaaagaaagaaagaaaggaaagaaaggaaataccttgcaaccagattttatggcagcattttctcaattaaagttccctccttccagataactctagttcatgtgtcaagttgacataaaatgcgccagttgcaaggcagtagtgacacacacctttcatcctagcactcaggaggcagaggctctcagatctctgtgatttcgaggccagcctggcttaccgagtgagttccaggacaggttccaaagctacagagaaaccctgtctcggaaaaaaagaaaaagaaagaaagaaagaaaggaaggaaggaaggaaggaaggaaggaagaaagaaagaaagaaagaaagaaagaaagaaagagactagccagcacagcacagcaggtgccagtgatggcaattatctcctcaaagagcattcaagggtatacctctctgcaagagaatatgcactgctagggcacaccctgcatgccaccatttagagtttcacctgagagtgcaaaatgtaaaggcagccatttgtgaagccatggtaaagatgggaacgtgtaaggttcctgccccgatagacctataaacatcaagtagtactgactgcctgcctggaagtctaggctgaaatcacagaaactttcaaagagctggaaacattagaggttacttgcccaacccaagggcctttctacagctggtatgtgacctgtggagatggcagacagatcccagagaagactctggatatagagagttaaataaggtaagcacccccatttataccactgtgcccaccattgttcttttgacaggacaactgaaaaagtcatgatatcttttcatgttgtgttggaccttttctttctttcttttttcttttttgtattttcttggttgctcaattcccaaggctaatttgcatttagaggagcattggggcactcatgcaagattaccttcatacactatctatttggcaagggaagaaggcccaggacctcgttttcttctgcttcctctcctttttgaaaaagtttcactacatacagtatagtctctgaaggatttatggtgtgcacctcaaggaggcaggatgagcagtcagcccacaaaatgcacaagggcagagctcagctgtgaaattcctaggagtatttttttttcccagtaaaatgcatatcacacccaacaacttagctaaaaggtactgtgtgtgtggttggtgccaaaataaatacataaattgctcaagaggctactgagtaagctaagagcctcgaaagatcatttgtgttagaaatcaccagaagttcaggagactatgggaaaaaatgacctgagcaaacagtcttaacagggtttgggtcccagacatggaaagggaaggaagcagtacaccatgctagaacagcaattgctgacgaatgtgaaacacttcaaaaggtgggacccgccaccgcaataacagtgaaggctgcttatctgcctgaaggccacaactcttactccagtggcacagaatcaaacttgccaaagatggcatgcctagttacagcactgtgagtgtggtgtcctgtctctaataccatgcaggctgtgctaggaccagtgttctttcgagcttctgtacctcccccagtgattgtcccaagagctaaaacagataaagtgctaagagaaacaccatctgtttgtacatgcctgctacatggatggcataggtaagggcactaaacaggactgggcagctgatgaaatgcaaatgaacactgacaccgtgtggctggagagagaaagaaagcttagtcagtgggctaaggtaagagcagagtgggtaataccagttcatgagctttaccctgtgacaatctgtattgacagttgttgggctctattcaggaaggtctgactttatggatatcccagtgggaaaagaactggcaagttctggttctaccaccatggggacagcagatgctgaagtttataatggagtttggccagagtcagtagttttccatgtggcagccggtagctcattgagttttggaaatcaggacgcagacgcacttaccaaactatacgccatcttcccccacagaccactggaggcgctttacagcgcttgtctaaagtctggtcacaggctggaaagtagctgaagctaccaacattcccatgaaatattctgatattctgcatgataaccaaaaatgtgaggcatgttccaaattatgacatggagagactatacagggcctgtaaatgtcagtaggtctgcaaatacgtgctcacctgaggacactgccacaagcccactgaaaacatttttggttatttgttgtggaagcagtcagtggggaagcacattggtagtatccaaatcagtattacataagacacaccccacacccagaaaatggataacaattaagggcagtcatttcacaatcactggtgcaaagaactgagttaaagacaccaggactaattctactttcatttgttttacaactctacacaggctatattgattgaaataaataacgggtaattgaaacaaaagttaaacagggccaaacagatggctcagtggctgaaggcacttactgctctttcagaggacctgggtcacttcacaaaaccaacctcatatagatcacaactgcttttaactccagccccatgggtccaatgccttcttctggcctatgcagacactgaatgtacatggtacacatacatgcactcaggcacagacacgcacacattgaataagtaaatgaatacttatgaatacttttatttttactttatttattttgttttttttggggggggataggatttctttgtgtaacagctctaggtgctcaggaccttactttgtagactatactggcttcaaactcacagagatctgcctatctctgcctctccagttgttagtatgaaaggtgtgtaaggtcagtatgtacctttttttttttttttttttgagacagggtttgtctctgtatagcagtcctggctgtcctgaaactcactatgtagaccaagctggcctcaaactcactgagatacacctacctctgcctcccaagtgctaggattaaaggcatgagccaccacctgggccagtatgcactcttagccattgaaccatcccaccaacccctagacaaaagtagtttttaaaagaaggcactcccggaggtcataaggttattgaatgaaaaatcccaatgtcagaagtggacttccctgtgggttgtgggcccctgaggcttcacattctgtaaaggctattgccgttgatatgggttgtatgctggagctggacattacattcccattgcagaagacagcacatgcttttgttgcagagcatggagaaatcaagctgagacggagctagaggtgccttctccactgattggctttcctggttctggaaggcactacacaggctgctgagcaaaattggttgttgacagtccaatttaatgacggacactggactctgtgtgctacactattgtattacttagcatttctattgctatgataaaacatcatggccaaaacaacctgggaaggaaagggtttatttctttttacagctcgtaatccatcatccagggaagtcagggcaggaactcaaacaggcaggagctgatgcagaggccatggagggtgctgcttactggattgctcctcctggcttgctcaacctgcttgcttgcttcctttcttccttccttccttccttccttccttccttccttcctttctttctttccttccttccttccttccttccttccttccttccttccgtccttccttccttccttccttccttccttccttccttctttctttctttctttctttctttctttctttctttctttctttcatttgaattagaaacaagattattttacatgacaatcccagttcccttctccctcccgtcctcccctaccacccccccccaactaaaaccctgcctatggatggtgaggccttccatggggtatcatcagagtctatcatatcctttgggatagggcctaggcccacctgagtgctgcagctggtttggggcaggaccatttctccttagtgttgcagcaagtgaggggcaggtccaactctatacagacctatcctctcccggtaccaggagccacagacatcaacacaaactgcagcagggccatggacccagagtgggtcccagcttcagctcagtactccctccccataatcaccatggaggggggaggagcaagccactcacctcagcctgctccttactgctttaacctcttcacatatgcctctttccgcaggacatgaaccattctgtctttctttttatttatttatttatttatttatttatttattagtatacaacattctgcttccatgtatatctgtacaccagaagagggtaccagatccagatctcataagggatggttgtgagccactatgtggttgctgggaattgaactcagggcctctggaagaacagtcagtgctcttaacctctaagacatctctccagcccttttaaattacttcttttgtgatttttatgttgcttttttaaaattttatttatttattatgtatacaacattctgcttccatgtatatctgcgcaccagaagaaggtaccagacctcataacagatggttgtgagccaccatgtggttgctgggaattgaactcaggccctctggaagagcccaacccccccccccattctgtctttctttcacacatacatttgcttaccataatagttaccagttgcccttgttttctcctctgctcccagggcagactgccaggcatgcatgtgtctccttgtcccactcagtcatagtcttaagatttattttattttatttttatttttattatttttggtttttcaagacagagtttgtctgtgtagctttggagcctgtcctggcactcgctctggagaccaggctggcctagaactcacagagatccacctgcctctgcctcccgagtgctgggattaaaggcatgtgccaccaatgcccagcaagatttatttttttaaggtgtgtgtgtgtgtgtgtgtgtgtgtgtgtgtgtgtgtgtgtgtgttgcctgcatgtaaatacagatgctaccagggaagagggcactggatcccctggagctggagttacaggtagttgtggaccggctgatgtgggtgctgggaactgaactcaaacccatggagagtggaaacagcaagggatgcttggaatttgttttggcatttatacttaataattgctttatggcatgatatgtgctcattttaacaaatttgaatgcaggaaaaacacaaaatccaaaataaaagtcatctagattcttactacccagacactgtgctaatcatagatatatggaaacgattttgtataaacaaattcatgatttcattccgtgacctactgtaatcaagcacagcatgaatcatgccaagtcaataaatatgatgggacgtggtcattatacttgattaacagtgcaattctgaatatatgtattataactcatttacccagttctgtttgctgccaacttttgatgctactgttctagttagctttaaccatcagctttacacagcctagagacacccaagaaaggaacatcaattgagggattgcccagaccagactggcctctgggaatgtctataaaggattgtcttgattgttaattgatgcaggaaagcccagtccattgtgggcagcatcctcccacctaatcaggtgacctgaattggagaaaaaatctagctaagcctgaatgagcagtcagaatgtccatgttttccactttaagtccctactggagttttgctcaacttacctcagtgatggactgtaacttgtaagctgaaataaaccctttcctcccctgtggggggggggcgctaaaaatcaattatggtattttggatacagggcctcaaactctatcccaggagctcgaatctcacattgccttttagatggcagctggttaccaccagatggcttggcctcagtggagaatgtctcctagtttgcctaacaacagacctaggccctgggtgagcccacacctattttgagggcttgtatacatgcctagggactggtgagaggctggtgaagacatgcagttttaggggtgcctctaggattaaaggaaatatttgatatcagctttatacatgataatagatgtcttctgatatcaccccccccatggttggaaagctatttaagaggatgcttgaataaaccatggactccagtctccagcatggactgagagccctcctgagatgacaagatatgtctttgtctcatccttaacaccgcgaggtagctaggagtttccccaggtccatactctcccactcagggatggacccagggctgtttggatggctccaattgcagccccaaagacatcagtccagaatagatggcctctgtaacataggactgatacaggcagaaccctggctctccccttcatttctttttgtcagagtgtttatcacagcaacagaaagcaagtagtacaggtaccaatatgtgttatcctcaactcatagctcacagctcacaattgttcagctatttgatggtgcagaggtagtatgctttcaatagaaaccacttctggattttgatctttttcccaggtgtgatagctttctgacaaggtgttgtgaatgtaaatcatgttaggatttctgctgctatagcaaaatacatgagtcgtatacatttatataaatgtacacagagagaagtttcattttggtccacaattctggaggtttcagcccatatctgaataggccctgttgctttggacttgcagcaagacagcacaccgtggcaaggagagcatggcagagccaacctcttcatgatggaaagaaaagagggagaggggcctagcttctttttagccccttcaagtgcacaaatgaaccaaaagaccccattgcataactcccacctcttctaagtagcatccagttagaggcaaagcctttaaaactacatggacactcaggggcattcagcatcaaactgagcaccaagctaagaatatgtgatagtgcttgttcactatgccgagtggcagctctcaggcagcatgagatcaagatcaataactgatgctgtgaagtatgctgtgttgtcagaccatgaggttggtgggtgtattagttatatgtggttttattggaatatcttacaggctgatgtccaacaatgactattgtgaatgggaagtccaagaatctggtagctgctctaggcccacagggctgggtgtctcagctggaatggatgtgctgacaaggcgagggaaaataggagaagggtgagcacatccttccttcttccattattcttatataggcttccaaaggtctacatgcatgtctgtgtactaagtgcatgcagtgtctgtggtggccacaagggggcattagatcatctagaactggagttacagaccactgtgagctatcctgtgggtgcaagaaaacaagtctgaggtgctcttagattctgaaccacctcttcaggccctaaaagcatttttgtttctttgagacagggtctcactataccgttctggttgtcctggagctcactctataagccaggctggccttgcactcatagagattcacttacttctgcctcccccaagtgctggggttgaaggcatatgccaccactgccaggcctttttttccagcagtttttttcaggatacaattcccacatttacataagaacactgagataaatacttttgtgcatatatctgtcaccatttttaggtgtagaagccatgacggaggtctcagtgctcacagatgagcactaggggaaccataaacactcagggttgttccttgaaaggaaggaatgcagtatatgttatctgcccagaaagcagagagtggacatgctctctagcttgctgacttctgctctacttgagtggtgggagattcttccagcaccatcagatcctctccagatccttcttgcaaatttgttttccccagaatttatagaacccatctttatggactttaaaagggttttgatgcagtcatgtctgttctatatttagctttctttgttccccaaagagatttatgtatgctttgttgtgaaccagggatggagctaatcatcactagaataaattttgctaaattgtgctatgcttaaatagccctaaaataaactacttggggtcagactcccaaagtttgaaccaatactggcatctgagtcctgttaaacctaacttcattcttgcctaccttggatcatcacattcctggcctcggaggtcacagggagagacccctgcatttaagaacattcatatatgccaggagatggtcctgcataactttaatcccagcacttggaaggcagaggcaggtgggtctctttgatttcaaggccagtctggtctgcagagggagttctaggacagctagagctacacagagaaaccctgtcttgaaaaacagctcttaggagctagagacaaagctcaacagccgaaagtccttattgctcttgcaatatggatatagcctcagttcccagcacccacaaccattttaactctagttctagagaatttgacgacattttctggcctccaagctcaccagacatccacatacatacatcatttatctatttattgctttttttgagacagagtttctctgtgtagtcatggctgtcatggctgtgtagtcatgaactctcattgtagaccaggctggccttgaacacatggagatccacttgcctctgcttctggagtgttgggattaaaggggtgtgctaccactgcctggatagattttggtttttcaagacatggtctttctgtgtagtcctcgctgtcctggaactcactcaacaccacatctcaaatatgtataacttttaaaataaataattatttatttggatggctggcatggtggcatacacctttaatggtggcagcacctgggaggcagaggcaggtggatctctgagttcggggacagcctggtctacagagtgagttccaggacagccaaggctacacagagaaatcctgtctcaaaaaaccaaataaaataaaataatttgtgtattttaactggaaaataatatttgtgtattatctggggtctatttgtgttttttatctataatgacatggtagaaagagtcagtcaagctatttaccttgcctacttttatttttaaggtgagaacaacaaaaaactattgtagcaatttagtcctggccactagggggaagagtggaaagccaaaaatttcagatgtcttccagagatgtgtcctgtaattaagtggtgttagcttctcctgtaataatagtaccatagagacattcttctctgtttctttcatgaaagattgattttaaataaagtccattccccatgcacacacatttctctctgaaaataatgtagcatgttgagtcaaagaggtagatacaagagatcatatattgtgtaattttgttaaatgagacatccagagacgacaaaactgtacaggcataaagtagattggcagttggatggtccagaggctcaagaactaggggtcacagttctctctctctctctctctctgtgtgtgtgtgtgtgtgtgtctctctgtctctctgtctctctgtctctctctctgtgtgtctctctctgtctctttgtctgtctctgtgtgtctctctgtgtgtctctctctgtctctctgtctctctctctctgtctctgtctctctgtctttgtctgtctctgtgtgtctctctgtgtgtctctctctgtctctctgtctctctctctctgtctctgtctctctgtctctgtctctctgtctctgtctcttgtgtgtgtgtgtgtagggttgctagagacgtagctcagcaattaagggtatttattcctcttacagaagacttaagtccagtttccagcatccacgtagtggctcataacaatctccaactccagcttcaggtgatccaatgccctcttctggcctctgcagacgctaggtacctatgtggtgcacagacatacgtgctagcaaaacacccatacacataaaataaaccagaaacaatggggcctggagagatggggtggtgttatgagttctggatgctcttccagagctcaggctcagttcccagtacaacagcagataatagtcttctgtaaatacagctccaggagagatgatgccctcttctggccgccacagccaccaggcatattcttggtacatgcacacaggcaaaatgcccattcacataaaataaaagtaaagaaagttttaacataaaaataaaaatgattcgaggccagtctggtctccagagcgagtctaaggataggctccagagctacacagagaaaccctgtcttgaaaaaccaaaataaataaataaataaaataaaaataaataaaagcatgttattttctttcgtaggaccttacaaaatgtggggttttgtttattggtttgcttttgtttttttgttttgttttgttttgaggcagggtttctctgtgcagctttgtagaccaggctggcctcaaactcacagagatctgcctgcctctgcctcccgagtgctggaattaaagttgtgcaccaccgcctggctcaaaatgtattttagatgtgaaatgttccccgcaaggcttatgtgtttgaatacttggtccccagctaacgatgaagtttgggaaaactgtttgtagttgggaaactgtagttggagcgctgggagaggaagtacatcactggggctaggctttgaggtcttgtagtccagactcacttcctgttccttgttctgaacactgactgctgatacaacgtgacaagctggcctggtgtgatagactgtatctctatggaacggtaagccaaaataaattctttctcatttacattgctttagtcagaatattttttaatgatttatttatttattacgtatacagtgctctgtctccatgtatgcccgcaggccagaagagggcgccagatctcattacagatggttgtgagttctattgaactcaggacttctggaagagcagtcagtgctcttaacctctgagacatctttctagtcccctagccagaatattttatcacaacaacagaaaacaagacaagagtattacttgtccaaaatccagatcttactttattccctagcctatattttacattcctgatgattaaaccggaaattacttcaaggaaatccctggaataaaagagaatatgttcaaaccattcaaaggaatggaattttttaaagttaattagaattggccagagggggaatagaatcaagtaatatctgattcttaaaaagccaaacgaggtgaaaggaaatagttacgattcaactatccatacatcatgtctggacaccttgcagaactatttattatttgtatatgggagaacaacagggcttcctctgacctcctgtatccaggagaccaatgagagggaaagctgatggcttcctgtggtttttgttttctttagtttttttttttttttttttttgaagaaagaagggcatggttgaactcagaacctcatgctttgcttgctaggcaagggccctactactgaatcagagccccggcatttgctttttagtctgggtcagggtcttactaaattgttcaggctggccttgaacttagaatccttttgcctcagcttcctgggtaactgggttggcaagcctgtaataccaggcccagttactatgttcttctgtgatctgactgtggagtctactttagctgccacattctgcttccaaatatccatgctgactggaggcaggccttactgccttaatctttcgtggatgtggagagtgcagtcctggattgtataccaggatggcctcaaatttagagagctctcctggcaggtctttaatcccagcacgcaggaggcagaggcaggatgagctctttgagttcaaggccagcctgatccacatagcaaattccaggcagccaaggctacatagtgagaccttgggaagagaaagggaaaaaaagagagagaaaatacatatccaaatatgttgcccttctgaccgctacacttattgcacacatacactttggcacacatagacacacatacatacctaacaaataaatgctttacaaattccataaatacaggcctttaatcccagcactcgggaggcagaggcaggcagatctctgtgagttcgagaccagcctggtctacaagagctagttccaggacccactccaaagccacagagaaaccctgtctcgaaccccctcacccaaaaaactcaataaatacataatgcaatatatgataattatataatgcaagtttattttatttatttggggataataatgaaaaaacagaaatagattatagtaggaggagtaatttattttcaaatattcagaatatcctctgaaaaaagccaagaggataaaaaggagaggggaattgaggcagactatgggcgggagtggtgactgtggaaaaaaaattaaagctaacccctgatggctatgcatgtctgcaaaaacagcacttgggaagtgaaggcaggatcaggtattcaaggctatcatcagctgcacagcaagttaaaggctagccttggctacatgaaactctgtttcaacaaaagaaaaactaaggaagtgggctggaattgtaacatatacggtagatcatctatgtagtatgtgcaaggccatgggttcaacttttatcactcctttccccaaaggaaacaaaaacacccactggaattatagattgtgggtcaacaaataaatgatggctagtggaaaccattaagatggccagctggtggaaagtgctgaagcctgcaagcatacttttcttcattttgcttttaaattctaattacacttatttatttatttgtgtgtgtgtgtgtgtgtgtgtgtgtgtgtgtgcatgtgccacagtacatgtatggaaggaggtcagaagacagctttcagaagttagtccttttctcccgctatgggagtcccagagatcaaactcaggtccttaatggtaacagcaagggtccttctctgctgggccatctcatcgcccttttattttccccacatatttttagctagaaaattcatccacagccggggtggggggcggagaggatgcagacagttgcgatgatggccaagtttgaacaggagaaattctgcttcagattaataggtacaaagaaacaggaaattaacttttggggagaagcaggaaatacccggtagccgaaaacagtcaacaggaaagtaagaatgaaggcagccttagaaaaccaggcctcattactgtcctcacgaaatcctcttttgaagatgcctaccattggacaaaaaccaatgggcttgcaagaacttacgtaagttctcacagtaactttattttactgatttttcttgaatgcgttttaaggtatactatgacacggggtgtttgttcaactagaggagagctagtcactctgatatgaagagtcagttttgaaaatagctgggaacatctcttgagggacagtgaagctaaactaattcgaagcggcagatgtattcacactgggatgcgcctggcctgcgggcagcagcagctcttacataagctgattaggttgagctgcttgctggaccgttcagagctctgctgaacccacgccctgcatttgccctctctggtttagtgaagacacatcaagggcagtggactagaggagaacaaaataataatacatcaataaatatcatgtctctcgaaaataagtgaaaatcccacttagaatataacaaatgggctttctactgagaggggaaacataggctcactctttttttttttttcttaaatactcagtttgaaaataaattctatgtatattggtgttttgcctgcatgtgtatatctgtttcaggatgtagattccttaaaactgatgggtgctgggaactgaacccagatcctctggaagagcagccaatgctcttaaccactaagccatctctccaatcttacttctttaggcaaaacgtttgtatttgtatttgagaattctttagttgggcacctgtataatctgaggaaagtttatactggaagttataattattttagtgaagttattttttttttcaaaatttaaccttttcaaatagatttaggttgaatgccatgaaatttctgatttcttttttatttctacttttactttttctttttaccaatcccagttccctctccctcctgtccttccattcccccccaccatctctccattcctgcctccccattcattcctcagggagggtgaggcctgtcatgggggaatcatcaaagtctttcacatcatttggggtgggactaaggccctccctcctgtatctaggctgagagagtatccctccatagggaatggactcccaaagcccattcctacactagggataaatactggtttcactgccagcagccccatagactgcctaggccccccagctgacacccacgttcagggggcctgaaatttctgattttgtagccaataaatgatgatattattcagtgttctataacagaccagaattctaaattaagtcctataatttcatccaacaaactttattttctttttttttttttggggggggttcaagacaggatttctctgtggctttggaggctgtcctggaactagctcttgtagaccaggctgggcttgaactcacagagactttgttttcttttgaggttttgtttttcgagttaattttgttgtttgcttgtttgtagacaaaaatctcacagtgaagcccctgctggcctcagacatgagttttcctgggatgagattacaagcatgggccattatgccccaattcaacaaatgtttttatttgtgtctcagtgtttgtgtgtatgtattcttacatgtatgccattgtggatggagtttactgttccacctggtcctgttgccatttagccccaaataaacacacaggagactttaactaatggttcaggcttcttattgactagctctctcttaattgttaacccatttctatgaatctaagtatacccacgtggttttatcttatcagagaatgtccagacctgctactccttcctctcttgcagcctctctctgcctcctctccctagaattctcgtggtctggtagcccagcctatacttcttgcctggctactagccaatctgtgttttattcatcaaccaataagagaaacatatatactgaaggacatcccccatcatgctacaacccatgtgtagtagaggtcagaggacagcttgcaggagtcagttctctttttccatcatgtggatcccaaggatagaactcaggtcattgggcttggaagcaagtggctttactcgaggagtcaggttacttgtcctcaacaatcatttctgacagccttaatataatctttattctttttttttaagattttatttatttattatgtatacaacattctgcttccatgtatatctgcacaccagaagagggcaccagatctcataacggatggttgtgagcctccatgtggttgctgggaattgaactcaggacctctggaagagtagtcagtgctcttaacctctgagccatctctctagcccataatctttattcttgagcaatttccattttaatctcggcactcgggtggcagaggcaggcagatctctgtgagttcgagaccagcctggtttactagagctagttccaggatagccttcaaagccacagagaaaccctgtctcaactgcccccccccccccgaaaaaacccaaaatgtaaatgagtgcaaagcagaatgataagtgctatggtagagacaagtataagatggcacagtaggagatgtggctgatttcactatgaggagaagaaaggttttgcagagcagaaggtggctagctgtttgatttctgttgtggtggtaaaacactctgaacaaaaagcaactggtgagaaaaatgtttagcttgcaggttatagttcattgtctagggaagccagatcaagaactcaaggcaaagggctggagagatggctcagaggttaagagcactgactgctcttccagaggtcctgagttcaattcccagcaaccacatggtggctcacaaccatccgttatgagatctggtgccttcttctggtgtgcagatatacatgaaagcagaatgttgtatacataataaataaataaaatcttaaaaaaaaaaaaaaagaacttaaggcaagaacttggaggtagaaacagaaaccatagagcaacccttcctggcctgtttccaggcagccgcttcttttctccttctattttgtttttgtttgtttgttttgtttttgttttttcaagacaagatttctttgtatagccctggctgtcctggaactaattctatagacaaggctgaccctgaactcagagatctgcctgcctctgcctcccaagtgccaccaagtctggctttcagcaagcttttttctttttgtttgttttgttttgttgagacggggtttctctgtgtagccttggctgtcctagaactcactctttagaacattagcaagctttcttatatggctcggacctgccaattgggagtggctccacccacaatggcccaggcctttccttgtaaattagcaatcacaaaaccatggagcatctttccagccccccacatatgcacaattgaggcataaatagggtgtcagtttcagaactcatgtgaaatcattttggatgtctacattgtggggaaggaaaatggttgaagactacagggaaacacaataaccaaaataagaggttttatttacttatttgtgtgtgtgtgccactgctgagaggtgcatgaggtgatagtggggaggggtgcatgtgtggagatcagaagactactaggggccgggcgttggtggcgcaggcctttaatcccagcacttgggaggtagaggcaggcggatctctgtgagttcgaggccagcctggtctacaagagctagttccaggacagcctccaaagccacagaaaaaccctatctcaaaaaagactactaggtggagtcatttctcttttaccttttcatggcttcctggtattgaacttaggtcaccaggcttgctcagcaagtatattcacttagttatcttgctttctcggatatatcttgctgtccagtgctattaaatagatatggagcctgccacaaaattttatcatttcaatcacatagtatggaagggaaatgaggtttttagctgggagatatatgatcaaatccacactttaggaagtattagttgctttgatatatagttcaaatttgttatgttttggtttttgagacagggcttctgtgtgtaacagctctagctgtcctggaactcactctgtagaccagactggcctcgaactcacaaagatctgatccgactgcctctgcctcctgagtgctgggattacaggcatgcggctgccaccaccacctggcttaattttttaatattagttactttccttgtagttgtgccaaagtaacaaatgtaaaatgaggaaagaagggtttgtttggctcagggtttgagattacagtctggcattttagggaagttaggaagccagagcttgaggtgattgatcgcattgcatatgcagccaggaagcaggggagccagtgctgtcaactgctgagccatctctccagccccataaacaccttaataacacaatacagtcactgaaagactgaatcagtccctgcccatcttggctcaaaacaaatttaacaatcaggataattggtcatgctagttggtttctgcttgagatagatttgaccacaaccttaataaaattttctgttctaatggacgagtgaaaacatttctaacatgtgaagaaaagttctgggcaagcaatatgacttagtaggtaagtgtttgcaaccaaaacctgatgacctgagttcaatccctaggacccacatacggaaagagagaactgactcctgtaagttctatctgacctccacacatttagtgtgtgtgtgtgtgtgtgtgtgtgtgtgtgtgtgtgtgtgtgtgttgtgttgcagcacatatgaggtcagtgggtatttcacaggaatgtttggctttatgcctggcagaagcaaagctgtgggtttgattgccaacactgcaaataataatacaataatttggaactagagagatgatggctcagagcttaagagaactggttactcacccgagcggtggtggcacacgcctttaatcccagcagaggcagaggcaggcagatctctgaatttgaggccagcctggtatacagagagagtgacagaacaggatccaaagctacatagagaaaccccgtctcgaaaaacaagagagagagacagagagagctggctgctcttccagaggtcctgagttcaattcccagcaacacatgtggctcacaaccatctataatgagatctggtgcccttttctggtgtgtaagcatacatgccagtagaacattgtatacataacaaataattaataattaatttttggggggcggggtgggttttgagacagggtttctctgtggctttgtaggctgtcccggaactagctcttgtagaccaggctggtctcgaactcacagagatccacttgcccctgcctcctgagtgctgggattaaaggcgtacactgccaccaccatccagcaaataattaaatcttaaaaagaaatacagtgatttgttagtgttagtatttatctcatcagtgatcaaatctctcagctaatctatgaggggtttcagcttgtgaaatgtctctaacaagctcctgtttgtacagttggtctcccatcactggtgctgtattggggccagtgtagcctctgtgcaggaagtgtgtctctgggaaccagcctcagtggacctacattcaaatgctgcttcttatgcaatgcagccatccccagcccaagtctcattgtcgttttacatacataggtttcatgttgttggtttgactgtagaaccaatctcacatctggtattagctacaggcagggcctaagacagggtggttgaaggcaatgggggaagtaggaacagaaggtttaccacgagtttacagttggtaaatcttcgtgtagggcacatgatgttttattacactcttcttttgtttgaggtttttctacaacagagtattgaaaagagaagttcacatttaaggtttgctttctaagacaagagaacttccttttgtgaataggatctgtagcactttggtgatgtgtcctgtgactattaggaaaacttgctatgcacatagcactggctggcctggagctctctatgtagagtatgtagagtatgtagagtaggctgagctactcaaagagattctgcagcctctgtctcccaagtgctgagattaaaagtgtgcaccaccatgcctggcttgccaaacattcttttttaaaattttatttatttatttatttttcctctcagtccttcattttatctttccctagattttttttatttaaattagaaacaatcttattttacatatcaatcccagttcgctctccctcccatcctcccatgctcccaaccaaccttccatcccatcccccttctgcgccccagagagggtggagccttccatggggtatcatcaacgtctgtcatatcatttggagcagggcctagggcctcccctgtgtttctaggctgagagagtatctctctatgggggaatgggctcccaaagtccattcgtacacttggaataaatactgatccactaccagaggccccatagactgcccaggcctcctaactgatacccacattcagggggcctttttaaaaaatatattttatttatttatttatttattgagacaggatttctctttgtacccttgactgtcgaattcactctgtagatcaggttgttctcaaactcatagagattcacccgcctctgcttctcagatgttgggactaaagtcatgcaccaccacccagctttatgttttattatttttatttatttatgtatatgtgtatctgtctgcatatgagtagggacagagggatgtcagagcccctgaagctggagttactggcagttgtgagctgccagatgtgtgtactggaagtagagttcagatcctcggtaagaacaatactctcttaaccactgaaccatctctctaggccaggtgccaaacattcttgattgatagcataatgataaacatcccggctcttgatttctgagtcacagaaaccagccctggaggctttgttgtgtgatgacagcctctgtccctgaatcattgtcaatcagtgtctctcctttgcagaagaaattatcccaactaaaatagtaacaaagagttgtgcagaggtggtgcataccggggacagaggcaggcggatctctgaattcaaggccagccaagcctacagagtgaattccaggacagtcaaggctacacagagaaaccctgtctcataaaacaatatgataaaaataaaattaattacaaaacaaagcaaagatagtttctgtagtgcttctgtgtgtttgtgtgtgagtgcactaaggagtgtgtgtgtgtgtgtgtgtgtgtgtgtgtgtgtgtgtgtgtgtgtgtggtaaataaggagtgtatctgtgtgtgtgtgtgtgtatgcactatgagtgcatctgtgtgagagtgcactatgagtgtatctgtgtgtgtgtgtgtgtgtgtgtgtgtgtgtgtgtgtgtaccggggagtacttctgttacatctcagatgattcagtgaatgatcacctctaatccatcaggtctcagatttatggatctcatgaagaattgatactgagacaaattaagaggcaaatacaaggtgtcagtcggtcctcaaagtcgtgattaagccctgtagtttctgtgtctctacctttcaaatcccaggggcattagctggtcagtctataaatttgatccatctattcctttctaatctagacacacccaccgccaatcatccgaggtaaaattccttggatgcagaggttcctgagcaccgttactggaagaatggagaatggggagagggaagcaggaaagagcaggaaaacgtgttaagcaggatgtaatctctcccagggactagcttcagttctgaaagaggtagagctctggggcactgtacttgagctggtcccatcttttatcctgctatgatggtcagtcattggttaccaactgcctggagtgagggagggggctggagagggacgtgaatagtcatagcagctgggagcaaatgttcccagttaaggggatcaaaaaaaaaaaaaaaaaaaacgtcatcagctgccgcatttaagtctagtaatgccccaaatcttgcataactctgtgttatctaggccatctccccctaccccacccgccttctctcttgaagcaaggttcttctatgtatgtagctaaagctgaccttgaactcatgaacatctatcctcagactctgagtgctaggataaaacgcatcatcattgtgcctgggttcacccactccattcttttctgggacatctccagaaaaggacttactcctcttcacgcatactggtcacctcaaaattccggaatttcccagcatgctttggctgcagatcatttgtgcttttttgttccctcacctggcatgacttcccctccagacaccttcataaaaagacttgctctggctggctatggtggcacacatctttaaatgtagcacttggagagaagctgctgttgccaataaagggccacttcccaaccccggtgcagtacttggggctgatacccaaggactgggtgaaggtcatgactgtgaactacaacaggcacagggagctgggagaaggtgccagattctgaggagcaggtgctggtagttgtggagaccaagagtcaaaaagagatcatggagcacgtaaagaaaatttggggcaagaaagaggagaccctgagggaggaggagctggagaagcagcagcaatctcattcagccagccttgctcccccaccctccttagtactgcttgcaggaatgccccgtgggaagtggaaggtcaggtacgctgccctggcctggtgcctgctctgaaagctagcacttaggtctgaggaagatcattgggatggactgatggagctctgcaatggaaaggcctgatagcacgcccatttaaaggacatagggagaaggccagggtcaccagctgctgaacagatgtccataaaagatttagtcttcctgtttaaaaaacaaaaaacaaaaagcaaaacaacaacaacaaaaaatagcacttgagacactgaggcagggaaatagaatttgaaggttagccttagagctatatagtgagtttgaggcaaaggctgtctcacagaataaaataagactttttttttactgtcatatctaaaatgacaatttcacttccagctgaaacttgaaaactctacttaatccttatatctaattttatttgtcttgttatctagtctaaataatatttgtattatctaaaatacaagccgaggatcactcaaaacagtggctggtaggctgaaggcactctgtgagtatttgctgcatgcatacatgcatgaatgattcctggcaggaagtgtaaatcctcagtaagcactgaactgaaccagaaaagcatgtaccctcccttatataacaaacagggaaagggcagagctctccagagccttgctcttccttcagtaatattacaaagcttggtctctttgtgagaggatgtatgcatggaggttaatgtgtaatatatgtacttctatatgtacattgtaagaatagaaactccaggcctggtgagattgcggctcacacctataagcccaatacccagcaaggctgccagcctaggctaagtagtgagctctaggtcagcctgggtcatagatatcgttatcctaaccacaagtctccctcccccaacaataagaaagaatagaaacacttaagatattctaattttatttaaatgagttcacatcaaactcaatagtccagtcttacacataacaaagagaaaggcagagcagaagtcaaagagatacaggttgcacagataactcaatttctaaaaaggaaaatttaaacccaaagttaatcctgtttaagctctttacacagcctgatcttagagggtagaaaactattaagacatgtaaaatatcaaaccccacccaaacatctattagtaaaagccaaattctttaaggtatattaaattctagaaagaaggtctaaggctgctaaaaatacaaaagcaactatggaattttacagatcagccttggggtgaggctgcttctgctgtgacctcggtttcttactgtgaatcacactgggcagagggttctgagcccaagggagggctttcttctagttcagcactctcttcgcagctctgcttcccatcggtatcctcggtgctgacatcagcctggtcctgagctgagctctctgcctctgcagtggcttcaggagctgtgctctccacctctgtagtgggttcaggacctgcgctggccacctcttcagtgggttcaggagctgcgcactccacctctgcagtagattcaagagccgagttctccacctctgtagtgggttcagggactccctcagtggtctcccacgggcaagtctcggtgatcttcagctcaggctcctccctcaatatggacgtctccactagggcatcctcgccagggatcagggaggcccctgaggcaggagactcttctggaggcccagctgccaactctgggacttcttcagcatataccaattcaatttccttttcagaaatttctccaactcctgaacgtgctttcccagcttctgccacattctccttttcgcctttaggatgtggttcattaagcaaagtattaattggaagaacatgggaatagagtggaataatgcaatcagtttattttatttaaattcaggagaaggggacattttttgagacaacatttaaaaacagccttgcttagtcatgaatctgccatgtaacctgggatgaccttcaactcctgatcctcctgctccattttccaagtattgtgattatctttatcctcccaagccatcctgctggctctaatactgtttcctagtaccaaaataaaaaattaaaactgaatgcccggccttgtggtgcacacttgtcagttccagcactccagaggtggcggcaggtagatttttgtgagttcagggccagcctgacctacatagtgaaagtctgtctcaaaagaaccaaaccaaaccaaaccaaaccaaaaatccacactaccacaacaacaacaacaaaaaaaccctcaaaccaaacccaaacaacctctcccccgaaacaaaacaaataaaaccacaaagcaaaacctgactcctgagctgctaataactctgttcctaaatagtagtgaccacagtaattgatagtaacgtcatagtctagatagaaaaaaaaaaaacgtataatttaaagtaattagcttggcgctggagagatggctcagtgttaagagctcgggggtggggggaagaggtggctgctcttacagagaactagggtttgttgccctgcacccacatggtggctcacaaacatccgtaattcggctctgggggttctctcttctgacctcttcggggagagggggagggatgcagaagggacaggacaggacactatgacaactgggtatatgatatgtagcatacatatctccatgcaggcaaaacacacacacacacacacacacacacacacacacacacgcatacataaaataaaaatgaatcgttaaaaatttaaaaaatttaaagtaagctgtttgaggcaagaaatggatgttagggtaaaactgtaaagtttctgttcccacggtggccattttccaggctcaggggctcaggaatgattcaactcatgtaaagcatactttgagaaagacacatggatggtgctggccaaaaccagaaaaaaaaaaaaaaagcttataatttaaaacaatatggggggagtgaaacgtcaaactgctgagacagatgctaaaattatgcttgcatgaatgggtgtctggtagtagaaataatattaccatacagaagaatggaaactgcctctcagcaagcagaatacagagaaactcgctcatttaccaaatgcactcatccatagctagtaactctaggggactgtgatcttccttcctgagtgaatccctacacatagcaactcttgattaagttactaaagaaatgaaagaaagaatcaagtggtggttcatatctgtaatcctaggtcaagaagtggaggcaggagtatcacaagttcttgggattcatgagacctgtttctaataagtaaacaataagaagttcactttacctgcaagtggctgtaaccctggttttgtctgttctctcacatctgtgacacgttctgtatgtctgacttgctttgatgtgacagccttgtaagtctgaaagaaaatgtgtgcttagctttctttctccctctctaagattcatcatattcaattccctatgcaaccaccattagaagtttcaagaacaatttcagtatcgcacagaagagaaatcaatgcctgctcaccacttaaaccaaccccctcttttggagacaaacctgtctccataagggtcctttgctggtctggaacttggaatgcaaaccagaatgaccttggactcagagcattggattaaagctgtgagctagcaagccaggcacatgaattctttaataggtctttaagcacttacataatatccaccagcactgactgtcacacctacaaccaggtaataaatcatattggacccagatgttccagggaatttgctggatgacactcgacgaagagatgctaggaaaacaaattttaaatatggttaccttcaccacataagtatgggcgtcttcagtaattacagtttttggcatttttttccttagtgaacttggaacctattaacacagtggattttcactttagggaacacagcattagaggtgggggtagtaatttcatccaaacagcctctagtctatttgaggaaagatttcgaagcctgccatcttgatattaaacatcagtatgggaagatgcagatgaggagacatgatagagaaactaaacaagcttagtggccaaatgaaatgcaaaagaaatacagtctcccatatatatcccaaacagacatgagtagaagtaattattttccttttttcctgttctttcttcagctgtccacttgagaaagaaggaaatgattgctttaaaaagttaattaagtacacttatacctaaagataaagcttgcacttaatgatgggtggaacacatgcttagaatgcactcgaccctaaggcttgtccagaaaagatctcacttcttggctgaagccagtcaaactctcttgtctcagccccctgaacacagggatcacagccacatggctggtttgcagtgagactttctttggcttaaaaacaaatctgtgatctggatgtgcatgccctgagcccacctgctgaggacagtgtggcgggggatgtctagaatctgcctctaccccataatgaaagttcactttttcttaagtttaatttagcatgtgtgtagaggtcagatgacaactcctgggagttatttttctctttctgtgtggatcctggagataagattccaggtcatcaggtttgataatgagcacctgtacctactgagccaacttactgacccaaatctcattgctaaaagaaacaacccccccaagccccaccacacatatggtagatcatgtgtctaatatgcaggaggcctgagttccatccccagaaccaaaaataaataaataaataaaataaaaccaaaccaaaccaaaacaaaacaccttacaactttcgagccaccatgtggctgctgggaattgaactcaggatctctgaaagaacagccagtgctcttaacctctgaaccatctctccagcccacctcacaactcttgacacttgtttcttatttgttccaggattttttttttttttttaatactaggagtcaaacccaggggttcttgcttgctgggtaagctatttcgcatgtactccagacagatcttattaagtagggagaaataaaattatcagtaatgggatgtggtggcccatgcctttaatcccagcatttgggaggcagaggcaggcagatctctgagttcaaggccagcctagcctacagagggacttccaggttagtcagagctacacagagaaaaacctgtcttgaaaaaacaaagaaaacatcagcaatacaagtagacttaaaactgtttcatctgagttatttaaaatagtgataagagaactttccaataggaattaattaaacatattttagtagacttatacaatgtacagactaggatttgcttatatgcgaaaaattttatttttttttagatttattattttatgtgcatgagtgttttgcctccatgtatgtatatgcaccatgtgtatgcctgatgtcctcgaaggtcaaggtgggcttcatgttccctggtaactagagttacagattgtttcaagacatcttgtggatactgggaattgaatccagatcctctgtaataacaagtcctctggattgctgagacagctcttcaaactacaagaaaattctgtcatacattatgtgaaaatccatagcaatataccctgtggcagatcttagatctaagaagaaaaagatcttcagttgttgcatgtgctgactcacaccttagtgtcagtacttgggaaggtgaggcagggggattgtttcatagcagtctgggtatctagaccttgtttctataaagcaaaaacaacacaaatctctaaaaccaagtagattaaccataaacaatgatatttactgaatggaagaattagaagtgatttatatattatatttggtcttcctggtattttcccaatgaactagtctaagcctaagctattcattaaaaagctaaatttttgaaaagccaaaaaagttacattttgcagcaaaaagcataatcaaacttaatgatagttaaaacgtgtctttcaacaacaacaacaacaacaacaacaacaacaacaacacactgaaacaaagctattttttaccaaagtaggaaatactaataaaacattaatcaatgcccacaaaggaagacacgtttaagattccagtcaatgccagattggtggtgcacgcctttaatcccagcactgggaagcagaggcaagagaatctctgagtttgaggccagcctggtctacagagtgagttccaaggcaactagggcaacacagagaaaccttgtctcaaaaataggtagatacaaaaatgaatgaacaaataaaagtagtgattatggctgtggctgtagctcagcactcagtagaagcaaatttgcctagtaaagtgatgggccttagattcagttcttagtaccataaaaaatgaaagcaattaagtgaaattagatcagtacccttgcacccaggacttctaacgcaagtttagaatgttaacactgccattaatttgatggagaatggggggataggggattaaaaaggtgtggtgcagatgacaggactctgtgggtataggtgtctgcagccaagcctgaagacctagttcagtccctgagacccactgactcttgcaagctgtcctctgaacacatgcaggctttggtgagtgtgtgtggtgtgtgtgtgtgtgtgtgtgtgtgtgtgtgtgtgtgtgtgtgtgtgtgtgtgtggtcagttgactcatctttctccttctctgaatatcagaacagccccatcaactttagcttaaactaaacagcttcttcctacctcatcagtgatgaaaatggctatcttacgaggtatacagagaggggaagtcatcttaatacgtgtgtgaagacttctttcaagtagcatttaaaagaacaggtggatagatatctccctctcatcctccaccatcaacacaggcctaatcaaagctggggagacaagtggacaaaccaaaccagaacaaaaccaaaaaaaacaaaaatcaaaccaaaacaacaacaacaagaaaccctgtggctcatgaaattttttctatctctcgcttaaatcctcgctctggatgctgcctcggatgcctcagggagttgggtgaagcacagcaagaattaactttctgtgcctcagtcagtgatggacaaggggtgggggtggggtgggggctgaggactggaactgactctgagaggaactgcaaacagttccagatccacgggtgcgacacttattaagcacctactctgttccaggaggcattactcggtgctttcctcttttgaaaatttccacgagcccttcctcatgaattccctaatccaaagttgatgaagctgtgagcttctcagcaacgccagaacaatgacccgaggccacccacttcggagggatgctcaggactgggagatcccagtgttcagcaccacctgtgttcactgcacccagactgcgcctggagcccacttgctagcgtgtggacacctggtgtccacaggtttctttacctcctccgggagcctagagattcattgaatagtcaacgtgggaatctaggagtgagtcagaccctcttcaaagtgatttttcactttacaactattaattacaactcacagccactgtggtgctctcttaaaaaatgaagaaaccttacttgacagagataagactggaacccaggaaggctaatttggattcagaggccaacctggaaaagttccctatttccaaagtttccaaggacttcggagcgcttgcctgagaccctccctcactgttcttcaccctggctcaggcgtctgagactgggtgctggcgggttcggggtgctggttccagcctggacccacagagatatgcagggcactcaccgtccttccccagtggcgtagggcaggggggcgccctcaggggcagcgccagagtcttggatacagccctgcggagatacatcgcccgacgtgcagggatgcagcggcggagcaagcaactcaatctcagggggtagagcctcaggagtgccccgccctggggtggagctctagatcccgtgcctctccgaccggcggcacgtgggagggggttctcggttagtcgccagcaccttggtctcctaatcctgctttagtagtgctgctttcccgcgcctccagcaaccacctcccggcagccgcttaagggctgtatctcggaagagggagagggaatttagaagtaattgttacgtgcatgacccgctctgttccatggagtaactctccttcagaacacgctgggcatatttaggaaatcgcaccagattcagtattcagacacggtttatcctccaggtggaaagccatttcatcccacccttttctaggataaggtagcgggaaactttacaggtgacaggcttatgcctaaagacagcgtaaggtttccccctggcgacggctgagttctaaactaactatggtttccaagaccttaaatacaaggtaaagtgcttacctagcgtgagatcgatacccagcagtgtgtaaaaccaagcaagctggctcaattgagcagataatcccagcactcggggggaggggggcaggaggatcggaagttcaagatctttggcaacataaatttacggacgccgtgggctatatgagaccctgtctcaaacgaacaaacaaatcactaagggtattagttggggggaaaaaaataaaacaaaacctctaattaggtaaaggttactctgcagtagcaagagcttttaaacaccaagccatctctccagtcagagttttgaatcttagtttttcgagacagggtctctctgtgtagctctggctgtcctggaactcgttctatagaccaggctggcctcaaactcaagagatccacctgcctctgcctggaatgaaaggtgcaagccacaaccatcgggtcagagttgtaaatcttgcaggaccgagtgaagtaactgacgacctctgaagcacagtggacgtgaaatgtgctcagccagatgggagaggcagtgtgggcctcaagctcacgattcctccacaccctttcagtctggtgtatgacaatattggttatatctgcctcacctggccatcccaaatgccagtaggctatatctcagggcaaagggggtttggtgggttcttttcctattttaatgagttagtttcaaaaaacagaacaaaaattcaaaaaccccatgccctttggttatcaaaagtgctaaatttctagctgcttcctcagaaccacagcgcagcattttaacgttagttcttgctttagctgactgaaggctcaaacatttccctgaggctcggcttcttcactgcccttgagagaagccttgacatttttctggtctgtttaggaaaacatctagggtcagagatgattggcttagctcagatgacctccagcaaatctttgcttgctggaaaagatactaattttgaaaatattgtaagggttcagtgccaacaatagttattatttcatggcttatgtacagggttgattttaaagtatttcagcaccctgtgtgaaggttcacacttttaattccagcacttgggaggtagaggttagacattttcctgtgagttcaaggccggcctggtctagatgctacataccgagagcctctgtctcaaaaagaaaaaaaaaatgtttttttttttttgaaaaaatgacagccaggaagatgggaaagtagctggcaatcctgaactcacatggtgtaaggaaaagaactgactcttggaggttgtcttctcatctccacatgcccagctatggcatgcacccaaacatatatcctcacacctaaataaatgtacttcaaaaaaatcatttctcaaacaatacagaatgctggaaacgggttggagagatggcttagtggataacagtgcttgttgctcttccagaggactagagggtggttcccagaaccccctctttaactcctgaacacatacacacacagagaaacacataaacataaaagaaagctagaaacaattgaaaagatttttggaaggagggaaaggattttgttttttgagaccaggtatctgaaaccacagtatggatggaaccatgccaggtttgctagtttctgttctccagtaacctttggcttgaagatacccattatcatcacaggtggatctgtgagtgcaagggcagcctgttttatataggagtctctggccagccggagctacacagtaagattctgtgccaaattttttttctcaaaaaatcctttgatctaagtccttttttaaaagatttttttaaatttattatgcatacaacattctgcttccatgtttatctgcataccagaaagggcaccagatctcataacagatggttgtgagccaccatgtggttgcggggaactgaactcaggacctctggaagagcagccagtgctcttaacctctgagccatctctccagcccttgatctaagttcttttgggaatttaggattagaatgattcttgcttcatgtgtcagctcttgatttgaggtgaaaaccctggactatttgcttttccttatcatgtgggtgggggtgggaggcagggggaacgctgaggagtgatgtccacacatagttagcatagctaatactaagagtcttttttttttttctttctgaggcacggggtctcactggcctcaagttcacaatcctcttacatcagtgtgctgacagtgggcttacagcgtttcctgttatggtagaagttctacccccacagcccgggttatcaggaagggctctctctagagttaaaacggatacaaagtacctgcagcctcaaagcctgacatgtgcagattctatttattaaaagtatgcttggctggagagatcgctcagtggttaagagcattggctgttcttctagaagtcctgagttcaattcccagcacccacatggtggctcacaaccacctataaagggatctgatcccctcttctatcatgcagatgtacaggaagagagaaaactcttataaataaatctttttttttttttttaagtatgctttaagtggctggagagatggctcagtggttaagagcattgctgctcttccagaagacccaggttcaatttccagcacccacatggcagattaaactgtaactccagttccaggggatcaaacaccctcaaagacatacataaaggcaaaataccaatgcacatataaaataaataaatctttttaaaaaatgctctttccaactaaaaccttctgcttccaaaattgcaggcatcttaatgttttctgagcttttaagtgctttgcatgtgtgtgtgaaaagtgctattaatttggagttaactgactttttggcctcaatttttatgtgatagcaccagtttcctataggtgcgctagcaaatgaagcaacctgaaacagcatgcacttattaactcgaagctttatgggtgtgtctcactggccttatatcaatgggagcactcacttttttcttgatattctttagctcttaacctccctctaccatcaaacccagaaatggtggagatggagctaaggggtgcttgtatggtaggtgcacggccctagatttgtcactcatatactatagcaaacaccccagcaatagcaggttagactttatatagccatttgtaaagatctgtgtgatgactcctggatatcccacgtaattacatctcaaggttgacctactggcgactctaattccacctgccattttaactcctcttggtcacagagtctaacatttacacatgttctagggaggacttgactttgttggacttccttcctgacagattgctcttctctgttactgcatttgcatgaacttgatttacaatctgccaagtttttccctccaacaggaatccaaactgacacacacaagctaagttactattaactttgacttttcatggcatctgtgtattttcaaatactataattttgaatttttgtacataagtgacatcaaaagacactaggccatgctttttccagcccctaaacacatgcaatgccaactataatggtcttcacagcagaaattatttaaagccattatctctttctccttttatcattttttaaagattttatttattatgtacacaacattctgcttccacatacatctgcacaccagaagagggcaccatagcccattacagatggttgtgagccaccatgtgggtgctgggaattgaactcagtacctctggaagaggagccagtcagtgctcttaacctctgagccatctctccagccctccttttatcatttttatgatacttgtgattaaacccagggcttcacgaatgctagccaagggttttattactgtgctatgtcttcagctttttgagacaggaccttgttatgtagtcctggctagtttcaaggtcaccatgtagtgccccccacctttactcatttttagtttactgctaactatgtgtgttgtgctcagtggacaatcttgtcaactcttttctacctttttgagaagtctagagatcatactctggttgtcaggccggcaagtgcttttctcactgacaattttgccagcttagtccccttcttaaaaaacctagttcgctgtaacttgactgaaagccaatggaaaacttcatgtggccataaaagtgagtagaaagtcactatggggttagatggcttgcatgttaggagcactcgctgttcttgtggaggactggggtttggttcctagcacccacacggagactcacaaacatctgtaaatccagtttcagaggatttgatgccttcttctgaccttccagggcaccaagaatggatattgtgtgcacacacatgtaggcaagcactcctcattgacattaaaacaaacaccgttatgtcaacaaaaaacaattcaaattcaagcaaatggagacagaggcaactctgataacagggtttatctttactgtctgatttatcccctcttcatcaacaagatttatattttaagtaataaagtagtcttgtctctttggcatctaaatgttttgataagagatgaggagggctggccacagtggtgttttcaggaggcaggtgggtctaggtcagttcaagaccagtttggactacacagtgagttctagaacagctagagaacttcagtgagacgttgtctcaaaaagaaagaaaagctgatgagaggggttcagcagttagaagcacttggtgcttttgcagaggacccaagtttggttcccaatatccttgtcaaccacccatagctccagcttaggcttctatgagcactgaatgtacatggtacacatacatatatacaaacactcacacaaacgctgaacagagcccattagcagtgattatggaattcatctctacatgtggagaacctaagtatttttatttgtttaataatgaaaaatgcacatgtgaacttgactgatacatattcacatataactttcccctcatatccaaacttgacagattggtgaatccagaagaatggccacaatcatcatatgcagcagacctacaaggaagaagaggaggaagaaggaggaggaggaggaggaagaggtggaggaggaggaggaggaagagaaaaaaaatcaatccaaagcaatgatcagataatgttgaaactgaatttctctgaataattcaccttagagcatcagaaaaaaatctagaaaatatatctattaaatacaatcagtacttgagattactatgtttattatccagcagatttaaccatggaaactgagatattttgtgtgtggtatgcatgcacctgcatgtaaaggcctaaggctgatgctcagagtcctcaccaatggctttccactttattaatcaaggtagggcttctcaattgatccctgagctgaccagtggctaatcagccatcttactctggggatcctctgttctccttcagagttttgaaatcacaagtggccagggctatgaggatctgagctctgcccctcatggtgtggcagctgctgtaattacagagctatctcctcaacccaaaagcttaggtttttttttgttttttgggtttttttttttgatggatttttcactttataaagggtaaagcatttctttcaaataattttcagaaataaagcataaacattccatatatttgtgtaatatacatattatacatgttatgtttatgacacatgccccttccccatctctcttttaaattagagcatgtaaaatatgttatttcattaatattaggtttcacctgaattcttcaattggatgctagttatagtgagaatcataatgaaatagttaagcagaaaaaaactccagaattcattgcctttatacttgatttgttctatgaacattaaactcctagaatggctgggtaggtattcagcgcagtgttgagaacaaaacattaatacaatacaggagagttcggctgttacagaatccacacttaagtataagacatggcaaatacacacaaattatgccaatttatcctaagtgctatgaatacaatgtgtaaagtactagtaaagaaggtatgatttaagatgattttggttttactgttgtttttccttctttgtttgggaccaggtctcactgtgcagaccaggttagcctcaggctaattatctccttgctacagtctctgcagtattagaattataggtatgtatgacctcatccagtactaaagttattctacaggccaggagtattggcatactccttgaatctcagcagttaggaggcagaggttggggcaggtggaccctggtctacatagagagctgaatgatatagggtaagacccccatctctctcactttttggagacaaggtctctcacttagccctggctgtcctagaactcactatgtagaccaggctggcctcacagagatctgtctacctctctgcctccctagcgctggcactaaaaaaggcatatgttattatgcccagtggtgagactctgtcacagctacaaacagataaattaacttctataatctatatactctataagcatacttactatattaatatctccaaagtttattccaatccatttcttcttttatactccaaaacatcttcatcatgttgtttgatgagctacaagttaatagttaaaaccagaattgtaatcttcctggcagcttaaagaggaggaaaccaactaaagatccttgtttcataagagaaatagggtaggttaaaacagttactattttactagaaataaaagcctaagacattcaagaatcattagtagagtacattgttaaccacaacctgacattacatttgagaatgatacaatggaaaacatatgatgacagaagaatcataaaacatgacactttttgtgtacctgtgtgtgcaatgtctatatataggtatgcttgcctgtgcatgctcacatatccttctgtgcatgctatattccaatcttagaagtctgacagtgtgaatgatcaacccaatccctcacttctctgtgtgctattagaaatcaaagaacagctacttttttggaaccaccataacttcaacaacgattgatacatgatgacagtcaagggaattaaagacctaatttcaatccttaatgctcttggcaacaattaaacctcccaaaaaattttcaaaaatgaatataaagttggggctgtacagttaagagcatgtactgctctcggaggacccaagtttggttcccaagaccaacaacagccagctcacaagtgtttgtaattccagctccagagaatccgatgggtagggtactcacataaacccacaggaaaattgtagtgcccaaggtcagcccaacttccagccagttaggtttggcattgggcggctcccggacatagaactttgaccgtgttggagctgaaaaaagagagaatatgtatcttactgacttgtagcgaggaaaacttaacatttactagtacttaacatttactagtgtacgtactattgcattaaattctctcatctgagataggggttattgtagcccaggctggtcttgaatacctgccagtctcctggaatcccagtcctggggagggattccaggagagccccaccatccctggcattacattgtcatttatactctatctgcccacccccaatctaaacagtcaaggaaacagtccagagaattgaagtaactcgtctgaggtcaccagcggagccacaggtcggtccttgagattccggacgccttcaaaacctcgtgaaggtgtcgccggccctcacaggctcgggagtgggaggatgagtcgcagcccccggaaggacctccctgttggttgtctcctgggcatatttgaagagccgggggctcttcagaggccaggaggtagtttggaggagggctggcggccgatgttgcggagtggaaaacccacaccgaggcgggttgaaggtcactgcgggactgcctgcgccgcgaccccatcctactacggaggttccaggatggttcctgctgggtgggagtaggccgagggccgagccggcctgaagagacacactcaccgcagctcggaagccgggcgggggccaagagccgcgaaaacgagcgcagagcattgggtagcgccatcttccgcccctagactccgccccttctcggcgtgagcgtcttgtcgggcgggcaccgccttctccctgcgcgcgcatctccggaaggtggcgcggagcgcagtgccccctggcagcagaagcggaatttgcgggtgggccaaagtcctaccttcaggacaaggtttcctagaacctggatttaggggtctgtctgtaaaacagcggatgcaaagaggcctggggccgggcaggcagtttgtccactcctagggcgctcgtcagaggtttaataaagtgtttgttggtgagccagaaaattgaaaatggaagtgtcttgaagaataaaatttgggttgaatttagtgttccaggtacagtaagttaattcattgtgtggtttacagtcatcattttatcgctacattggctacaggatgtgccgtaattattagcatcaattaacagatgggctcaaagcaaacttgtggacaaaggaactttgtatttgcaaaggcctcttaccagttcctaaaatccaattatattcaagatcacttcgatgcctctcaatcctgtgagatagaattctgctatttactagggaggcaatacagggcttcctacatcctaggcaagtgccttaccactgagctacaactccctacatagtttttgagataggggctcactaagttacgcaggtggccatgaatttgatcctcctgcctcagcctcttgaggagctggggttataagacctttccaccaggccctagtaaaattcttgtagatgttacatgaaagtgccctgactggctcaggaggggcatccagatggcaaagggatccagttagctgacctaacaaggtgggactggctataatgccatgtgtctatgtagaacaggatccaaaccatcgtgtctcaagtatcatttgtgtccactatatgtcaacactatgatttttagtcgttaatcttaccacagtttcacaactgtaacataaaacctatcctgtagggtttgttgggaagcttaggagttatctgggagtagtaaatacgtttgcctattcgacacattgtactaatcagctgttttgttttttacctttgtaatttttatgtgtaggctcacattgtgataagtgtgtgtgtgtgtgtgtgtgtgtgtgtgtttggaaggtgacaatgaaggtcagaggcattggatcaacctgactgatcagctgatttaaacatttttatttttatgtctgtgttcgtgcctgtttgtcaagtgcatgatggtgcctgcaactgcccatggaggtcagaagagggcactggatcccccggtactgtagttataggcagctctgagttgtccagtgtgctctgggtgccaggaaacaaacccaggtcatctgtaagagcaacaagcactcttacttgctgagccttctctctagtgcatgatcagctcttttttatgttgcacaattgacagattctgtttcactggtatccaaagaccatgttttaaaaactattggtaatagatgatacattctttttgatttgataagattttattatttttaataatatgttcatatgatggtggggtatatgaatgaagctccccttggagatcagaggagagcattgtattccttgaagccggagttatagatgtctgtgagccaactggtgtgtgctgggaaccaaacccaggtctttgctaggggagtaagctggcttaaccattgagctatctctccagcctgcagaagatacaaacttacccttaaaagccatttgttaaaactaaagctgtttaggtctactttaatagcaaaataagtgttagcattttcctttagttagtattagtattagtgttagtagttttagcaatattattttaaaatctttttagtaaaacaaaaagtcattagcagagtgtggtggctcatgtctaatcccaggtcttgggaagcagaggcaggagtgactctattttgatagaagtttgagtttcatagtaagtcccagaccagcctgggctaatatgagaccctatcttagaaaaaaaaaaaaaaaaaaaaaaaaaaggggggaaaaaaaaaaaaagcaaaaacaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaggggggtacagaaagataagccaaaaccagggcacctactgtcaagcctgatgacttgagttcaattgctatgtcccatttaatagaaggagagaatagacttctactaattttcttttgacctccagatgggtgctctgacaagcacacatatatacacacatacacactaaatacatgtattaaaaaaaaaaagaggggaaaagaaagtaaattaccaatagaaggtaaaataatgacattgtgcattgtggctaaacatgttactaacagcctgagttactttagtttgtaacctagtctgagcctcctgggctcatgctcaagtaagcaaaccagcctactaatgcgctgagtcagttgttggctcttgacttactggcttcttgtccactcagcaagagttgtatactctttctacagcacaccgccagagcttgtcctgacacagcttttgctagtcttcaacaagttgaaacagatgctaccttttgtcagagtgtacagaaccagtaagcacattgccagcttcaggatctatgctgggaaagtccattttgttttccagaactctgatccttgtgtccttttcctagtgtatagtttggagagcaatgaagtatgagcacaacgttctcagtatgttagagctcactggacccctagagttggaagaagcagctaaagatgaaactcattttgaaaagaacctagctgggagctaatagctattctagtttggtaggcatctttttaaacatttatttaaaccatatcctgaatttaaatgctaaaatcctgatttgtgacctaggtgaagggagatttaacacctagaaaacaagttttagccctggatttttccatgaggaaacatcttacttgactgatgtgtccaagggagggggtaaagaacaaaacctaaagaaggatggcttcttgtatacataagttttattaaacaaacattaaacaaacatcccaaaatgtggctgttattttgttaagtctgggtggcaggttcctttaatgttgtttttctataaaatgtaagtaaactggcctctggtcttccaaacaaggtaatcttcctgagtgctgggctttactatggttttgaagtccttctgccttagtcgctcagtactgggattccatgtgtgcaccattacacccagctggaggaggaagccttttaagcacagtgatggggaaggatgcaaggtcctcagcagctgcagtgccatacaaccttggctgtaacttcccagaagcacaagaagcactcaaggcccaactccaatttctttttttttcccattcatttataaataaagtcatgcacaattatgatccaattcaatttctatttgccaagtagtagtgattggagtctatagtttatctattactgagttcaggctatcatgtcattgactgtgtggtcagactattatttgtaggcacattttaactcagtaacgaatctgatcaatattgtaatcagaccagtattcactgaaccttaaaaactgctgtttgggcctggagagatggctgagcagctaagagaactcactgctgttccagaggatccaagttggtggcttacaaccactgtaactccagcttcaaggtatgacactttcttctgacttctatgggtaacagtatccacacacttgcacacgaacatgaataaaaataaaaatctttatataaaaacaaacaaaagctccccacccaaaaccctgctgtttagacttggatggggcactatgtctgcaatcctagcatttaaaaagcagaggaggaagtgagatcagggtaagcttgggctacttagcaagaccaacaaacaaacaaaattgctatttagtgggaagaggattgacagcagtagaggcagacaagagatggtaagggggatatgtatatgtgagaataagattgaaatatatcatgtacatatatgaaaataatgaaaaacatcgtgtataattaacatgctaataaaacattacaacttaaaaaattgtatgtacaatttaaaaaaaaaaaacagttggttttctagtgctgtgggtatagctaactcaatggtagaagtgcttgtctggcaggcatgaggcaccaggttagagctccaacagcacacactcgaagaaaagctatttatctatgtctttgtatgtgttgaattttattttatatgtatgagtactttgcctgctgtgtgccctgtgcacagctggtgccttcagaggtgctggggcccaacccaggtcctctgcaagagcaacagggttcttactcaatgagccccatctcgacagccccataacttcatttattatttatatgtgacaatatggagagcagagaataactttgtggggccctttttctttttccatctttatgtgagttcagggttcaaactcgggtgtcaggcttgcatagtaagagcctttacccaccatgccatctcaccaacctaattttcctaaatctttatcgagagattacagtattcaaggagaccctaaggtttgacctctataatcccgatctttcgtttttttcgatacagggtttctctgggtagccctggatgtcttagaattcattctgcagactagggaagttaaagaacaatttgaaaaccacaaagtatgtgtttaaaaaagaaagattgaaaaatgtcaaactcttgcacatctttatgattcatggtgcaaagaatactacaaggcctgcacgagataattgagggtaaaatggctcttatgactcaatggcatgtcactctgtaaaggttttattgtcaagtgttaatgaaatgtctgctggtgggagggatcctcttcactttcaggcctaatcttgctgagtggagtttggcctctaaggtttaaggacttctggtaacaggtggttcaacagttacaatcctaagcatgaattagaagtcaactccaggagttccgaccctcgactctactacatcaaggtgactcacacagctcttacttcaacccattatatgacttcagcaatgaaataaacacatacttcaaccttcaaaggctcctttggcagtacaaacatgccttttcgaatctggctaacgacctttcctggctatcttaaccatagtcaacagaaccacagataccctacccagtcaagtccatttcaaaggtcaagctctttgacgcttttcaaagacgattaagccctcacctcttcggatcggttcacaagtccccacttaggcgaaggttttctcatcttacccttcgcctctgctcaaatataggcacttgggccttgaacgactacatcttcttaaaacacctccgtcggcattttggcatttgaggctcaagctacgattacaacacctgggcgagtctaccccaatgagtgaaaggccggtttagcgaggaggagcaaaaaggctgtttgcgacgaagaggcggcggaagcaccgctggctgccctcccaggagctgagcactggaaggaccggcagagccaacccagaatcagccgttccgcaggccctgccggcctccgcgttcccggcaggctccggtgcagcgagggtggggagagagggtcaccgcgcctgcgcgttgggaggtgtgacccgggtgggaaagccctcgagctccgccattttggctgcctctgtcggtcttttcagttaccacgtgaaccgccgacggagacccgtgaggggggaggtggcggcagcgttaagtgagaaagggggggaaaagaaaaaaaaaaaaagaaagaggagaaaggggtgtcaggacagggcggcgcggcgacacccgaggcctagtggcggcggagcggattcaaggctgaagcgagcttgagaacggcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacaggtggtgtggctgaggcccgactcattcattgcttgaacgcgcttctccctccacggcccgtccctccctcttcctccctacctgggattcacctgtccccgcccggccggggtcaccgtgactccagagggggcaaggatggaaaagcgaagggagctttgcagtctgcaaactccatgtagtggcttttataatttacacacaagcccccccccggcttttttgaaacccatgtcttagtttgagagcaaacctgccccaccccgccatccttctccggaggtgggactcatttctagggggcggtccggtccggtccggtccggtaggaagttctagtacttaagtactttacttaagactgtgaagttttaaaaacacctatacaaaaacttagccgaaacgatataagaatcttttgagatggatcttgttgacgctagctctgtgtttcagatatttgcagtttgcataagaaacgcatgcagtgatacttacagaggtactggattgaagctgtttacattgtaaactatgcccagtcgtcttggtgctgtcattaatacattgtagcacttttgttgttgtttggtatttagtgtatgagtcgcttcttttacacaaacagttctttaaagaactgtatttgccaattttaagacttgaatggcggtggtgtttcacacctgtaatgccggcactggagaggaagaggcaggtgaatggatctcttgagttcgaggccagcttggtctacagagttatacagagaaaccagggctatacagagaaaaaatgggaagagggagagattcgtgtatgtgtgtgtgtgttagccttttagcttgcagttataattcacttgtttgacaaatatggagatctagggtttgtttgtttgttttttctttctctaaataactcagcagttgagagcacttgggctctcaactgcttgagagccagaggtcttgagtttaattcccagcaacaacatggtgactcataaccatctataatgggatctgatgcccccttttggcgtgcaggcatacatgcaagtagagctctcaaacacataaaatacataaatcctaaataaccatttatgtcgaggtaattgattttacagaaatatccatgttgtagattaatgaatttgtgttgaaaaacgatagtcacatactatttagtggtattttgttttcataccatttgaagtggaattgtagcatagtttccccccctatgttctgagacatctttttccctgtctgtctggaaaaaaaaaattaaaaagacataaaccagatttggcagcaagtgttttcattcactgtgtcgtctcattcactgaagaataacagttgctgttatttctgtgctggaaggctttgtgcattcgaagcaggtgatctaccgcggagttacactcaattattttaggactgatgtgtaggtagaactatagcatagttttcttgcaacatttacccacccaccccctgtccccttatttttctttatctttttttataatgctggaggttggaccttgtgctaaatacaagcagagctatgttcccaaccccctcatcctctgtttatactgatgggggggggaatctctgaaaaaacgagagtatcgaaaaatatttgtcttttaccgatatttaacaaattgccaagattactttttctttccgtacatagaaaaaaagaaaactgtatgcttatgcttcactccttagaaataaagacatggccctgtatagttataataccattaacagtttttttctaaaattcaggcttttcaactgttagtgacaccttttcattgttttttgtttttgtttctgtttttggagactggttctgtgtcactttggagtgtgtcctggaactcgatttgtagaccaggctggtcttgaactgtcagagatccactgcctctgagtgctgggattaaaggtgtaggctaccacgccaggctcagtctttctctatatttcaggcaggcccccatttcttagtattccttttgcttcagccttccagtacttggatagcaggtgtgatccaccattctgggcacaatcaagtgtgtgcctctgtgtaatatgcacatgttggggttgactccagggtgttgcacatactgggcaaatactctacctctgagtagtatatatctcctcccctaaaattactcttattttgagagagttataaagtcaaatgtagtttgagatattctttgtatattttgcttacttttccaaatattatatcttataaatcttatagttgattgtaacattgataatgtctaccaattttattcatatttcccaagttttatttgtagttgtatatgtgttcatttctatacagtagctattacatgtgtaggttctgtgtctgcagtcaaaatatagttctacagtaacacaaaggagcactgttttgcccttttagaactacaaccacctatatccttcccatccttttctctcaccctccagcaactgtgattagtgtttctcctattgaagtaattttaaaggactgtttcctaaagagactcacagagtgtatataacttacagattggcatttctttagtgcagcaggatttccttgtggttcatctaagttttcacttgtattagtagtctgttatattttattgcaaagtaatatgctataatgtagatttagatttagtagagtttgtttaactatttatggaattacagttcttggttgtgatggtgggacaaaaatctttaatgttgttgctaaaatcacggtgcaaaaggattaattattttaaagcaattttttctttttattagaaaattattttacatgtcaatcccaggtccctctccctcccctccgcctccccccacccccaactaacaccctacccatcctataccctttctgctacccaggaagggtgaggccttccatagggggccttcaaagtctgtcatattctttgggatagggcctaggccaacccccttgtgtctagactcaaggagtatccctccatgtgggatgggctcctaaagtccattcctatggtagcagtaagtactgatccattacaagaggccccatagatttccaaggtctccttactgacacctatattcagggggtctggacagtcccatgctggtttcccagctatcagtctggggataaagcaattttattgtgtgtttgtatgaatgtgtgccttcgtgccaacacacacatgtaagggtcagagaacagtttcccagaattggttctcttcctaccatgtgggtcccaggcatgaaattcagatctttaggtggcaagtacttttattcactgaaaggttttgctagccagttaaaagatttatttccataagacttaaacaagaaaaatgtgtaaatctctaaatgaaagaagaaaaagagatacaatgtttttattgttgacagacattaggaatgaaaaaaatgttaccaagcaaaattatagttttgtttcaaaatttcagcttttacagtgttagctcttgcttgatttttttttttttttttttttcctggaactctgacctcaaagttacagagatccacctgcctctgccttctgagtgctgggattgaaggcattcactacaattctggagagctctcttgattttcaagctttctcttcccccactttttcttgtctgataaaggaaaagttgggcatactccagtgctaaaatcaagtgttggtaggttgctgacggtagcactccttttgttgtggtgtgccatacttagtaaacttacatagggccagttcatgcttcacagaattatgaactgtctctggctcagtattttagtgtaaactcatgtaatagtatcactttgcacaatttcataatttctacagtggatttacttgacttagttcagtttgtttgatacctgcaataatatttgttacatatttgcccctccctttctccacagtgctgttttctgactaagcattgttataaattgctaaaaatatgtgcaaaatatttcttgtctctagttcatctagagagaaagaagattaactggtgttctattttatgtgagatttttgcttggttgcttaccagtccttttaaaatttcacatcattttaatatatttagaaaattaaatcatttaaaaaattgtagcctctgcatacctttcctgctgtttgttcatctaaatcagtggttctcaatcatcctaatgcttcaaccctttttgttcatgtgatggtgctccccaaccatattattttccttcataactgtaattttgctgcttttatgaactgtagtgtaaatatctgtattttccgatggtcttatgcaacctccgtgaaagggtcattcaatcctcaaaggggtcatgacccacaggttgagaaatactgatacagaatagtttgagaattgtcctagaattgtccatcattctatttgatttttccaaacagagtttctctgtgtagcctgtcctaaaactcactctctagatcaggctagcctcaaacccagagatctgcctgcctccatctccccaagtgctgggattaagggtgtgagccaccagtgcccagctttattcactttcttgggatctaggtttatggtaggaaagatgtgcttgaaaggtgtggccaaaactcacacctttcaaatttcagcccacttgaaaagtggaaccttcttaatgcctgaaatcaccaagattgttattgctattgcttcatccttgtctcttactctttatatgttaatgtgagtgatacgaaaataaaacccaagttgggaatacttaccactgtttaataagtgttgttttggggctgcagagatggctctccgacctattccagaggacccaggtttaaataccagcacccatatggcagcttacacctgtctgtaacttcagttccagaggatccaacacctccacacagatatacatggagacaaaacaccgatgcacataaaataaaaattaattataaatgttttgagctttagtttgagtgatttgttgttaagttccaaggacagaatatttcttagaaaaaggttaggagccaggcaatggtggcacatgcctttaatcccagcacaggggaaacagaaacagaattctgagttcattgccagcctgagctacaggaatgagttccaagacagccaggactacacaaagaaaccctgtctctaaaaatcaaaagggacaaaaaagagaaaaaaaaaaaaaggaaaaaagaaaggtatttcgggctagagaaatggctcataaccaaaaatataagaaaaaggttaggagaatggtgacaactaggtgatagtctgtgatttattgaacaccttccatttcctaggctgtgctctggacccttcagagtagcctcagatttctgagtactagattgtgggtgtgagccaccatggttttctctacagtgcacttttgagagttctttcctaatctcaaaggcttacaaagcagacttttaatttacatatttatttgtgtattcttgcatctgcatgcccacatacacatgtggaagcgaatgtggtgatcagaggcagtttgtgggagctgggtctctgtttctaccatgtaggctctggggatcaaactcaggtcatcaggcttggcagcaagcacttttacccagtgagttatcctgctggactcagcaggattctccccccccaccccaccccagacaggtttctctgtagctttggagcatatcctggaacttgctctgtagaccaggctggctttgaacatacagattgcctgcctctgcctcccaagtgctgggattaaaggcatgtgccaacaccactcagtttcaggcagatatttttattaagcaaacagaatgaatgaagttaaattagggttcacacgtagagcttggagtcaggaatcagactttattttttcagggtaattaaatcatacttatctaatatttactatttgggggagagatatgagaggagagaataaaaaagaaggaaaagtgtccttataactaatgacaattaggttaattttgttgctgataaaattcatattggaattattaacaagtagatttctatatacacaggaaaggtcacctgccttttttatactatgtctgtccaacttggagatcaaacccttggcacatacatgacaggctcagctatcatttaaatttcagggtgacattattctagttttgcagtagggtctaggcagttactttgaaattggtttcctttttccttttgaaattagttttaatatatttctgcctccctgtactacatgcatgtaaaaccagggctgctaaaatcttttccacttgtgacctccctttgcctgaaaaattgtatacaatttcttaatggagatatataaggtagatgctcatcatactgatcataaacacatttatttatttaaaaaaatgatgttggggctggagagatggcttagtccttaagagcactgactgctgttccaggggatctgacaccttcacccaatgcacataaaataaaatgttaaataaatttaaaaaattgtaatgtctttattagcatatcttagttatacatggtaatgaatttcattaaaataataaagaaattttacatttatttatttttgcatgtttggggtgcatgtcacaatactcatgtggaaccagaggacagcttttaagtgtatgttcttttactttgtgggtcccagggttcctattcaggccttctggcttggtgtggtaagtgcatgtacctggccttaagttgtttttgtttttatgtagcctagaatttgctatgcagaccaaactggccttgaactcacagagatctgcctgtctttgtgctggaattagaggcatgcaccaccaatgccagtcaagaaaattaagacagttctttggtacacattaatcttaccagttattaaagaggaaagcagattgtaaactgtgatggctggttttaattatgaacatgacaactagaattacctgggaaaagagtgtcaatgagaaattgtctagtcccagcacttgggaggctgaagcaggttgatctctgagttcaaggtcagctcccaaataaatacattgaggcttatattaattataaattctgagttgatagctcaggcttattactaactagctctcacaatttagattaacccatttctattaatctatgtgctgccccaaggctcctggcatttgtctctctggaatggcttgcttactccccaccttgctggcaacttctctgactccagttttcttcatcccagcatccttagtttggttgtcctgcctatagttcctgtgtggctactggccaatcagctttttattaacaatgaaagcaatacatgtttacagtatacacagattgttctatagcagccagcctagtctatagagttccaggacagccagagaaaccttttcttgaaaagcaaataagggggctggaaggagggggcttattgagatcaagttagcttgtgggcagcaagtgggagataatgttgattgtgataattgagatgggagtatctgcccaaaatggtggcatcattccctaggcagggttaactccaattgaatgcaagcatgaaaactaatttattgctctgttcctgtttatgagtataaacaacaccatagctctgtgttgcctaggtctgtgtcaacttaacccaatgcagagtcattttggaagagagaatctcagttgagaaaatgcccctataagattgacttgtgggcagtcctgtggtacttttttgattaatgattgctgtgagaggacctggatcacttgggccataccacccatgagcaggtggtcctgagtgctgtgagaaagcggactgagcaagccaaaccagaaggaaaaagccagaaagcagcactcctccttgggctatgcatctgttcctgcctccaggttcttaccctaacttccctgtgtcatgaattgacattattcagggaaaaaagatgaaataaatcctttcctccccaagttgtttattgtcaaggtgtttgatcaagccagtagaaaccctaagatagctcttgctgtgacttccctgcagtaatgtattataacctagaattgtcccaagttgcttttgtcatattacagcagcaggaaatgaagttaagatatacactaatgagatagatgtgcttgtttatttttacatgaagaattaattaagtcttgattgattctcacttgattgattcccacccccactccccagaaagggtttcactgtctaacagcattgtctgccctggaacttgctttgtagaccaggctggccttgaactcagagatctacctgcctctgactcctaagtgctggaataaaagtgtgcaccaccatgcccagctatttttttcgatactaatagacaatactgtgtttttacagaagcagacaaaagctttgtaggaactgaatttacagttacattttgtagatacagcaaagctatacagtccaagatcatttggggtgctcacatagactcatttgataatagaactgccatctcagctattgtgaagcaatgactggagttttccagaggggaacacttggcaccctgcaggattggaggtctggagtgctgctgaccaagtggtctcaactgggtgggttactttctagttcactatcttatttcctttaatatttctgcttttgagaatgtacacacgatagaggattgattcaaatatatatatatatatatatatatatatatatattttttttnnnnnnnnnnnnnnnnnnnnnnnnnnnnnnnnnnnnnnnnnnnnngaatttctcaactccatccttccctccctccctccctctctccctccctcccctccctttcttcaaaacaggctttctctgtgtaacagtccttgttgtcctggaactccctttgtagaccaggctgtccttgaactcactgagatctgccttcctctgcctccctggtgccaggattaaaggtgtgcaccaccaccgcctggcaacttaatttctttcttacttccttcaaggttttctttttctctgatataattatgaccatttgatatatacttagctgtatatttatcacatatcttttgcaattaaagtgtgggctttttttaaaacattttatttatttatacaacattctgcttccatatatatctgcacatcagaagagggcaccagatctcataatggatgtttgtgagccaccatgtggttgctgggaatttaactcactacctttggaagagcagttggtgctcttaacctccgagccatctctccagcccaagtgtgggctttaaaaaaagatttatttaatgtatatgagtagtctaactgcatgtatgcctgcaagacagaagaaggcatcagatccattatagatggttgtgagtcaccatgtagttgttgttgttgttgttgacctctgtaaaagcagcagttctcttaaccattgagccatctctcatccctctaaaatgtgggttttatgatagggactatgtttttgttaattgttatgttcatattggttaatgtatatagtactataatatgccaaataaatgttgcataaaacagatgttaaaatagcaattacagagcaagagaaaaggctctttggattgtgtttgcatgagtattttttggagaagatagttgagctgggctcttggcattgtcgactatattattatacagggtaattgtaagatattgggcagaacctgtgtttggtaagaccttggagattgcatttatgaatgaatcatggtattagttcatttggtggcctattgttataaaagcataataaaaggaaatcttagtcattatttcatttttgcttgttttaacatagagaaagttggtaaagttaaaggagtttattgtcaggtgcctgatgaattagtctctaaagggtaagacagggccatatgtttataaaactctacaagtgatttttacacagctagagtgggggttattatgtaatgttataaccatgaatataaatgttcatgtatgtgttgtcatcatccccccctccaccctcccatagggtttctctgtgtagccctggctgtcccagaactcactctgtagatcagactggcctcaaactcacagagacctgcctgcctctgcctcttgagtgctgggattagtgttgagcaccaccaccaccacatggctcaaaaattgtgatgtttttcatacaatttaaaaatcaaattgaggtttttgggttgatgaccattgtgaagttggtgtaggaaagagtgtaagctgttgatttaacttagtgtttagttgagccagtcttcagatttcacttcctttgcaggcagtatcatgttgatgagagaaaactgattcttaggaatgcttgttctgaaaagaatgtcattttgtagttctgctgtttaaatgtaaaagtgaagaggttttgagagtgacatttttaaatgtgatattaggatgtggaggcaccctaatgtggttgtaatcttgacttttgaggatttccttggactagcagattacagctagtatctaaagtgtgctttgccttttgcatagatttatattaagttgtaacttaaaaagacaaaacagggctggagagatgagatggctcagtggttaagagcactggctgctcttccagaggtcttgagtttgatacccagcaaccacatggtggctcacaaacatccattatgagatctggtgccctcttctgatgtgcagatatatatggaagcagaatgttgtataaataaatttcaaagtcattctaagttatgtagtgagatcctgtctcaaaaacccaaaggttagggatgttattcagtgggagagaatttacttcacatgatttcagtttctagcaccttttcatcctctgtcaaaaaaaaaagaaacaaaacaccaaaccagaagcaaaacctagttaatttgttgtatataggtctttctttccttggtgggtgatggcatccgcttgtaatcccagcactcaggaggcagaggcaggcgaattggatctttatgagttcaaggccatcctggtctacaggttgagttccaggacagccctgggctattcagagacccggtctccaaaaaaagaaaaaattaaattacactgctagcttcttttaagacaatgtttttttaacttttaaaacttctttattattattttttatttaggtaagctctcactatgtagtcctggctgtcctagaactcacaatgtagatcaggctagcctcaaactcaaagaagtctgtctgcctcttgagtgctgtaaataaaagcatgtgacatcatgcccagcctccttttcctactttagagtaaaacaaaagttgtgcagaaataaatgatggagctagtgttttctaaaatttgtttttgattaagaaagatttattttaaatgtatgagtattttgtttgcatatatgtatgggcaccatgtatattcctaatgctcacagaaaccagaagaggcattggattccctagaactgaagctacagatggttgtaagctaccatgtagttgctggcaattgaagaactttggtcttttgtgatcaaagccagtgctcttagctgctgaatttggtttttgagacaatcttctgtagctcatgctggtctggaactcacaatttagcccaggctaacatcagacttgtagcaatcctccagcttcagctttctgagtgctggagttataggtgtttgccattatgcttgactatagctaatcccctcccatattgtctactgtgattatcttttttttttaattttatttattatgtatacaacattctgcttccgtatatatctgcacaccagaagagggaaccagatctcataatggatggttgtgagccaccatgtggttgctgggaattgaacccaggacctctggaagagcagtcggcgctcttctgagccatctctccagcacctactgtgattatcttttgttagtataaaataaacaaaactttagcttaggtaatatggaatgtcatgtttcctgaggaaactataaaggcgcttgagttttttgaggttttatcttgtttggataaaaggaaaaatgaaagcttgcttttttatgaaggcagaacatactctgaagatggatttttctactttcaaatatgttgctgtaccaagtaactaaatagcaatattaatttccttctctatgataatagttctacttaaaatggtactgtttgtttttcagagagattccattggctattacaagatctcctttgattatcaatgtttgagaactgcatcaaagtgaagaatgaaataaactagtatttattgaatatctgtcttgaaccagaatgatagttttgtttttctttttatatgttgatgggtctaaattttgttacattcctttacaaatttgtaagataggtaggtttgttgttgtttttatttttttttccccagacaagatttctctgtgtaatagccctgtcagtcctgaaactcattctgtagatcaggctggccttgaactcacagagatcctcctgcctctgcctgagtgctgggactaaacccatgtgccaccacttcctggtaagataggtagtgcttacaattaaaggtaccttccttattgctttgtatttgttctatctgtatcaggacatacatgttcctaaagacattgtattgtgcaagtttggaataaaaactacagggtatgtggggagaatgggcctggcacagcatcacaaatataagcaaggtagtacttgttaataatctcagcaatccactctggaagccaatttccagactagtctggggtatatagaaagattgtgtctcaaatcaagtccccaataacagcaaaataggactttaataaaaatgataacatggggctgaagagatgatagctcagtggacctgaattcatcatttcaaggaactgcacaataatcatacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnccacccacccaccccaggaaaacaacttgaagctagcttgtttcagaagtgagcatccaaaggactgtagtttgccagttaccatgaagtggtaggttttttgaaatctgatacaaggtagtatcagatgtgggtagatgtggcatagattgactcagagcacacagggtgaactgaggtaactggtagatgtttgatatctttgcagcaatatgctgtgcatgcccacaggacttgtttcagctggctatttttgtattcatttagttttctggctggggaaatcccacagaagcaaacacaaagtttgaagagattaaaacatcctttaatactttaattctagtggagcaaatgtgtatattcaaaataagcattactacagagttgcctattccctgcttaacagcattgtagagaccatacatgatctttgtgtgagctcttctgtccttgcctgtccctcttgtacatagcacctgaggcaccttcatggttttgctattttagttgccagtgtatgggaactctgctctgtagaccaggctctggcctcgaactgttaagagatctgcctgcttttgccttctgagtgctgggatcaaaggcagttgtggtggcctgcaccctcaagccttctttttaagtaaggtccgtccttttctttctgaagctatgtgttgctaaaaacctgtaatttttatcttagcagatgttcagagtcctttgtaactccccagtagccaaagctaacacagttgtgtgtcagaactgctgccaattcttcctctctcataggggacttctctttgagggcaaatttcaggtgctattataggtgtactatgtgtaggaccctgctgtattgttctttggacagttgccattgaagtttctttggtatatatatcaaatatatatatgcacttacctgaaaattcagggttttagttgttttccttatattgtatggtcacctgtggttgtagtgagtctttctgtgtccagcttgcaaataaccatggggagacttctcaaatgatgacagcttggccaatagcttagacatggcatgtttctaactaactcttacaacttaaattaacccacttcttttaatctgcattcttttatgtggcttggtaagctttactttgtgattcccatgctgcttgctcttcgtcctggtgtctttcccccttcttcccagtgttctctctgcccccacatatcctgcctagctattggctgttaaacctgcccaagtgatgtatcttcacagtgtacaaaaaagattattttacaatatgtggttgattgtatttattctttttgggtctgtatagtttttaaaaaagatttaatttctatttgtgtatatgcatggatatatgtatacctgaatgaatttatgtgtgtataggtgatgttacagtcagctgtgagctgcttgatgtaggttctgggacctggagttgtgtccttgacaacagcagtaagctctttttaaatactgagctcttgtgcagcctcaacatggacagttctttttgaggatttatggaatgtttattagaaggtagtaattttcttagacagtattgtatgttttgcctgaaaacagtggtatttcctttaaaataatctttaattgctgggcgttggtggcccacacctttagtcccagcactggggaggcagaggcaggtggatctctgtgagttcaagaccagtctggtctacaagagctagttccaggacagcctccaaagccatagagaaaccctgtctcgaaaacaaaacaaaacaaaacaaaacaaaacaaaaaaaaaacaaaaaaactttaattcaggttctctataactgaattgtttatatttatgtttttgtgtcctctgttcttcaaaattttgcaaaaatttaggaagttttgttacaatcataccctgagttttgtaggtaacactaataatacttagaaatcataaataccacttcagctagctagccctcctgcccactcttcctttttagtttctttcttttctagcttggccttgaactcattttgaagccaaagctggccttaaattcacttttattactcctcagtcttctaagtactcatagtgtttggctctccccctccccccacttccttcctttctttttttttttttttttttttttttttttttttttttttttttttttgagacagagtttctctgtgtagctctggctatcccagaactcaccctgtgtaccaggttggtctgggtctgttactgcctctgctgggattaaaggcatgcaccaccgcacctgtttttgttgttgttgtttttgtttttgttgttgttgtttttgttgttgttttttgattttatgaggttttcgcatcgtgtatcttcataccattcattctcagtccctttgcatctgttctccacccctccccccaatgaaacaatatcaagagaaaaaaatgaagaaaataaaaatgagaaacatgttttgaaaaagggaagaaattaaaaatcttgtcatagaagctgcagtgcaacccaacaagtcaacactgtataaccccttaaccgtacagttttacttgcaagtgttcattgcagagtcattgagtctggttggaggcttctggcttctgttacactatagatgctgggccctcactaggactctctttggatagtttgttgttgctctgtgttgtggagatcctgcagctttgggtctgtgggtcaggttccttcatgtgctcctaataatagatgagatggatgggtaggccaactcataactctgggtctaggcctgagcaactgccagatgggaaatgggacagctatacaattttggggctggctcatctacacttgtgctgaatgtgttggcttaattatattgccctggcaaggtgcacggcctggtcttctgagtgttgcagctggtggggggtggggtggctctcccacactatgaccacaggacacctggcttttttttttttaactactattttttaaacaatttatttttcttaggtgcattggggttttgcatgcatgtatgtatatgtgagggtgtcatattccttggaaatggagttacagacagatgtgagctgccatgtgggtgccaagcctctggaataacagccagggctcttaacctgtgagccatctctctagcccctacttgtttttgtactaaatgtatatgggtgttttgtctgcatatacatctgaacaccaaagagttcatccaatcccatgggtctgggtctaaagttatagacatttgtgagccatcatatgagttgagtgctgagaattgaactcaggacctctggaagagtaaccagtgctcttaactgctgagcctccaacctcctttcccccttcttcctcccatcaccttctctttattccttcttttttcgactctcttttcaaataacataatttaatgccaaaaaagaagagaaaaacctggtgaagtctggcatgttttatgatacatgaatgggactgtagtgctagaaagcccgtggcaactgtcaccttcagttctattaagattgaatctatagtttttttgtttgtttgtttgtttgtttttttgagacagggtttctctgtattgctttggagcctgttctggaactctctctgtagaccaggctggctttgaactctgcctcccaagtgctggaattaaaagcgtgcaccaccattgcccagcatgaatctgtaatttttcacttttttttaaaaaaaagattttattcatttattatgtatataacattctgcttccatttatatctgcacaccagatgagggcaccaggtctcataatggatggttgtgagccacaccttgtggttgctgggaattgaactcaggacttatggaagagcagtcagtgctcttaatctctgagccatctctccagccctagttttttacttttgagctccaaacctacagagacctccccctccccccgcaaaaaaaaaagaccccctaatgccatcattctgcaaaagtattggtgtaaaattcccacagatttttgtatattatcctgggactacatacttgttgctttaaaaatattaagatgtgtagtcatagtggtgcacacctagtcccagggctagggaggcaaagtcagatagatctctgagttgaagccagactggtctgaatatcgagttctaggccagctccatagtgagactgtccaaaaaatattatcttaaggtgcattttgttttatgaaatggtaataacatttttataaactgtacttagaaaaattagaagatgtattctaattcttcagttttcttttgaaacttgacaagcttttaaaacatgggaactttgcgtgggcttcagaaaatgatccagagaattaaggagatttgaagctttcatataaggaacagctaaaacaataaagatgtttggttgaaataagcagggtgggagaggagaagctcttaaagagctagagtcaattatgaagttataaggaggtgtagtttagatcatttcttaaaattattttgctaaatgctggcatcaggcaccagctgtggtcacttccagcagatgagatttaaggtctctttagattaaggtatactgtaaaacacttgacttgttaaatcttactttagcgggtctttcctttttggggggcaaggtttcacaatgtggctgtggctggcctggaactcaaggagatctgctttcctctgtctctttgagtgctgagatatgcaccaccatacttagcctaaatttccccacctccacccccgggacagagtttctctgtgtggatgtcctggaacttgcagaacagactggcatcatattcacagagatctgcctgcctctgcctcccaagtgctaggattaaaggcatgggctaccatgcctgtttttttaagacttatttttgattgtatgtgtaggagtgttttgcctgaatgtatgtaagtgcatgcagtgctggtggaggctataagaggaacttcagatcctcagaaactggggttacgtcgtatgggttatgctaggaactgaacttaaatcttgtgctagaacaggaagtatcttaaccactgagctgtctttccagcccccattgtgggttttgatgccctgttttctttttattttgtttttttttgtttgtttgtttttgttttttttttgagacagggtttctctgtgtggctttggagcctatcctggcactcactctggagaccaggctggcctcgaactcagagatccacctgcctctgcctcccaagtgctgggattaaaggcgtatgccaccaccggccttgatgcccagttttcaaggcaccatactgctgtttagttcagtcatggcataaaagatagtgggtacccgtttgtaagtcattcgatgtctcacatagcttctttttactacctttttataaccaagttgagattttcctgtttttgaatgatacttttcatactgagtcttgttggtgtcctgtggaaaatgttgatgattttgttcagcaggtcagttaggctcaaactgcatgtcctaattctaatgtttgttgttttttggtttttttttttttttttgaaaatccttatgtttctgcttgggtctatccttcatatgcccctcctcacctcatggccatactgttcttccaattgtgcttgcttgcttcctgtcttccctttttttttttttttttttttaatatgttttttaaagacagagtctcactatgtagccctagaacttaactgtgtagacaagactggcctcaaaccatctttgtctcctgagtgctggtactaaaggcatgcaactgctacattctgaaagacccccagaggctcaggcccccaggatctcagtccaggacttccacgaccccaatcactgggtggagttgaaagcttgatgcaaacagcaggaggctttattgcagttgtttaataagctaacccattagctggggcctttcatccatccaccatggcggatggctagaaaagaaggctagaagccactgcatagagatcttatagggcagcagcgtaaggggagtgtctaggggtatgcacaggctcaggattggtgtgcctccagacttgccctgtgttgattggtcaactgattgttatggcccataggctttcccagggctattgctatgctctgtgtgtcattgctgtgcacttgtccgtaaagcacacccagagccttaaagcataacaccaccagctaacttctgattggttccttgccacgaggcaggcatctgacctcctagtgaccaaggcaaggtcaggcaagcacgtgctagcctgttatggctgctgaaatggggagctggtcccttcaattcagctttctgagtttaatttgcttttatttttctaatttcttaaggaataagatgaattaattaaaacttttggtaatagactttttcccctccctgattgcttttataatttttttgagacagggtttctctgtagttctggttgtcctggaactttataggccaagctggcctccaactcagaggtctggattaaaaggatgtgctaccacagccagtgcttttacaattttttgtctttactttccagtggttggattgcaatagaacatttgtttgctttttttggggccggggacagggtttcactggactcatactctgtaaggctaggattataaacatgtgtcactatgcctggtttcagtatttttcactcattttggtctttattttctctagtacatgtgttaaacttgatattgttgttggaattctatttttcattactttgaactatttaagcttccatttagattctgttactgtggcttcaagttttccatagtgtttctacaatcacaatggcttcaacatcactgtgatgtctggtaatattttaagttgttataagtaacttcatttttgttagtttccattttaggatttccatttttctattgacgttttttaagtttcctgactgtgttcaggttttcttcaattcttacatattatagaaatttccttgaaagtctttgctgtttccatcattatttttgagtgtgaaatttgttactcttgtaggctatgggtcactttcctgtgtacttctatttctagtaatactgtcttctcttcataatttaagatacgatggacaggcagttgaatgtgtggatcctgcatttattaatagcattttgttttggcaggcagttctttttgggaagaggggatgtgcattagccttttcatgattgtcttttttcctttgtttttttttttttttttttttttttttttttttttttaaattatccttttccagacagggtttcttggtagtcaggtaggctttgtttgtaggcttgtactgctttgtagttgtgctttccctggcctaagtgtggtgtagacccgcaaagatttctaggaagtttctaaagcttatatctgtcgacttctttgctgcccttcccaagagagtctagctattcagcagtttctcactctatagctgctcagattgtgacacttctgaacacccttaatctgcagtagggaaaatgactttaggcaaaagaggggattgacctcgctcctgtaatcacagtcctgtgctgtgttttgttcaacagctgctaacagatatcttcaaatttttatacaattttttataaaagtatacacttttatacttggcatatgtttaagctgatggcagttatacatttggaggcagctatctcaagagtgttgtatgggtgccagagatgaggctttacttattatctattagaatagttcattctggctctctttcccctgttttctgagaaggcagatcattgtctgtctctgtctttctctttctctcttctctcccttactcccttaccttccaataaactttccacataagttatgtccagaaaaaaatagttaagaatattcttgctttattatgctttggttttgcctgcctgcctgcctgcctgcctgcctgcctgcctccctccctccctccccatagctgtcctggaacttgctttgtagaccaggctgacctcaaatttacagagatctgcttgcctctgtcttttgagtgctgggattattgttgtgtgccgttgctgccaccccttcccactgactctcaggttttaaaaaaataatagcagctgggtggtagtggtgcatgcctttaatcccagcactctggaggcagaggcaggcagatctctgagtttgaggccaacctggtctacagagttaggtctaagacagctaggactgttaaatagagaaaccttgtctcctgaagaagtgcaagaaccgtctcttcaggaagaagagcaggcctcccaggaaggagggattacttggctgcagtacaaagagaacgaaagcagcagtgagagggataacgaacaagaccagccatgagctgatgcagcctgggatgttcatgctggatggaaacaacaacctggaagatgactccagtgtgagcgaagacctagaagtgactggagcctgtttgatggctttgcagatgggttgggagtggcagaagccatctcctatatggatcttacttacatggctctcgaagagcaccttgcccaggtgatggagactactcttgtgcacctggagtctctcgccgttgatgtcgaggtggctaacccacctacaagcaaggagagcattgatgtgcttcctgagatcctgatcaccgaagatcatggtgcagtggaccaggaaatgtgctgtcccatctcctgtggctaatatgtgaagggggaggtggcaactaagctccggtgccaccactatttccataagccatgtgtgtccatctggcttcagaagtccggcacctgcccagtgtgccgcttcatgttccctcccccactctaaaggccaagactctttactcttggcctggttattttccctatctgaaacccacaatactacaggagccctctttcaaaattaacaatggcagtgaaatcagtcggtcaattaaactaaacttgttgattccttgtgattgtttccaatgtgaaatgtacaattacattttaaaatcatcctttctattagaaggtaaaaaggggaaactaaacttactaaatgctacttgagattgcagcaagaacataaattttctaacctgaaagttgaaacaaatcatatttgttctgtagactgtgttgtacttccttgttgatatcaagtttatctgctaaatatgttagaaagacaaaaataacttgtgttgcaagttatgggttaatgttcctgtatttaatggtgtaaaagcttattaaagttcttgttaaagtctcttgcttattagagagagagagagagagagagagagagagagagagagagatttagtctcaacccccccaaaaaaacaattaaaaacttattgtctatttgtatgttttttcagataatttccttttctttttagagtcagagtgtcactacacaatcctagctagcctgaactttctatgtagacagtgctgacctcagactcacagagatcaacttctaccacccacatgtttggggctaaaggcatgtaccaccacactctgtgaattaattatttttatttgggaaggaggattttaaaaatacattttaatataggacctagcatgtgtgtgcacacattcatgcatgtatgctcttagaaaaactggggaagactctctgaggaaattgctcagtagttaaagcacttgttatccaaaaataagattcctagacccgtacaaatactgggtgagaggtgacatcccacctggaattcttgcactccaaaggtggccccaggggatttcccctctccccttttggggggggcatttaagtgtgtggcactggaaaaacagtactttcaatagtagagaatgaaagaaatccattagaaggaagagtgagtgcagagtctattctggagaactcccaggatttctctgctctacaagctgagtgagcagccacagaggcttggagccatggcttaaagcaggctatttctgctgtattttcagtaacatcatttaaagagcagaaagaacagaaacactgtgctggttctgggtgggcagaggtagaattggtgctaggaagatgcttaacctgagcagtgacaagcttacttcatgtcaggaactcagagcaggtatcatggactgtatgtttaagacctggcctataaaattcctcagggtaatggggaacaacttttgagtaacaactacagtggcccaagatgtagaatcctggtctgagctatagacctgggtggaccactcaaagccctgtttactagaggattggaacaaaggcaggcttagtgtatgtgccctgcctaggtgggaaactggaaagagataagattgagttggctccccactgactacacagaatagggtcacttcatgctgctttctgacaagggactgcagaggcacacttctacatccccccaagtccccctctccccagctcagaagcagaatgggctgcctgagtagcacctgtgtggcagaagacctcaggctcaggcaaagaccacatagatggttgtacagctacctcattctcttttccttctttgaaaaaatattctgctgggtggtggtggtgcacacctttagttccaacacttgggaggtagaggcaggcagatctctgagttcaaatcaaggttagcctggtctacagagctagatccagcacaggctatgctccaaaattaaagagaaaccttgtcttgaaaaaccaactctcctccccaatattttcttcctttggtaatttcatgtgttaatagtggctttagtgggctggagaaatggctcagaggttaagagcaccgctcttccagaggtcatgagttcaattcccaattcccagcaaccacatggtggctcacaaccacccgctatgaggtctggtgtcctcttcttgtgtgcagatatacatggaagcagaatgttgtacacataataaataataaaatctctaaaaaaatagtgtatttagatcatatatatctcttcaacccctcccctccatcccatttccacttttcctatgattatcagcctcctctcccccccatttagtgctgctcctgtgcatgagagcatagtctatcataggctccctagtggcatttagctgctgctcctcagctagatgtggagcttggtaaatccctttcctctccatgctgcagtgttgactggtttaattcttgtgccaggcagctttattttaatatctgtcttcagtttaatgggctgactttgtcctgcccaaaatgaagattctcctggaactgggaatgggtctcgctgatgagtgctgagatcatttaaggttgtttagttatacttcctttatcttccctcccctccctctgactagtttaagatttttgttttgctttgtgttgagacaaggtctcacaatgaaacccttggctcaaatggagttcactatatagatcacgctggcttaaactcttaagagatccatctgactctgattttcaagtgctgggattaaaggagtatacctctacacctggcttttttttttcccccagacacagacagggtttctctgtatagctttggaacttgtcctggaactcactctgtagatgaagctgactttgaactcacagagagatgcgcctgcctctgccaccagtgcctggccccacttggcttttatgatttatttttattaatattttttgagggggagagggagaggtgagtgtaggcgcctatggcagctagacgttggatacccttagagctgaatttacaggtgcttatgggccacccagtgtagatgctgggaacctacctcagtttctgtgcaagttcagtatgagatcttaccactgtgtcatctttccagcctttctctttattctttctttaactggagttaccttatttcctcccttctttattattctctgcattttttcatcttaaaaatttcttttaggggctggagagatggcttggtggttaagagaactggctgttcttgcagaggacccaggttcaattcccagcacccacatggcagctcacactgtctgtaactccagttccaaggaatctgacaccttcacacagacatacacatacaggcaaaacactgatgtgcataaatagataaatcttttaaaaaaactaaaaaaaatttctagatataaaaacatacttattttatgtgtgtattttgcctatacatgtatacgtgcaccacaagcatatctggtgcctgtagaggtcagaagagggtgttggatcccctggaactggaattagagatggttgtgagctgtcatgtgggtgttacttggattcaaacctgtatcctctgcaagaacaagtgcttttaaccactgagtcatctttctactcacacttttcttctttctgttccccattttgtttaatttctggtcttctgtttttttctgttgctctaatactaatcttcatctgcacatatcaccaatcttaatctgtatgtgtcctttccatttttacttttagttagtgagtaccttagcatgcattataatgtcctttgtcctttacctcctcccaaattattggagttgaagggatggatttttatgctcactgtattttcatagtagactcttttggttgtgtgtttatgtcagaaaaataatattgtattctcaaaggaatactagagagcaaacctagtgcattgactgtgagctgagggcttagatgtgagctgcacctccagtctagtggggaggaactctgccttactgtaatttagtccctctggaatattgtagatctttctactgaaacaaccatgtgattaagtaaaaatacaacaatttactgtatctcactgcagagacacatgaaacatggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatagatcaggctggcctcaaactcagaacctcctgagtgattaaggtttgcactactatgcctggtctgtaccttttaaatcatattttcacttttcctatgactcagttactagattttttttttaaatgagcttatgatttttcaaatctaaatctttcactttgtcttgcttttagtttttgtatttaagcctttcaactttgggtgatagagctttgggtgtatgaggcaagtgctgtgccactcgattacatcctagtgcccctttggtgactgtttatttagttggacttagaagaatctgaaaatagcattctgtttaatagcataaaagcttaataatgaacttggaaagtttctgcatttattgataaactgacatactttctttttttgacagagatgttatgaacataaacaatatagaaatggattaaagttctgtaaacaaatcctttccaatcccaaatttgcagagcatggaggtaaggatacactatgcacctttaattagatttgatattattgaatgactggctttccttattttgctctgctattcagctgtctttattttccagagtagacctttagctcttaaaggaagataaaatttaataataaattttgagttaaaataccaagaaaatgatagcacatttgatttaagccttggttacgtcttctaacagagccaatggaaaggcagaagagcccatttaggccaaatgtttttttaattaatgtgtttataagaaaattttgctttaaaacttggaggtggacggattttattctttaccataagcttgttcagaaagtgaccatttactttcttatctatattatatcttaattagctcctcaccactgagtcttaagacatttgtatttacagccagatgtatagcttttgtccaaataatggtgggtgattagatatttgcagaacaggtggtgagtatgtgacagaacttgtaaagaaataaaaggaaaataacattttgtgggtctgatttctatagatttgggaaacatgactcattagtaattaattgacattgtgtattgaggaggggagaatgacagttcactattaagtttttatcattccttctcttcatgtattatgtttccctatgttcaaggttttacttatgctgcagtttggagttgaaagcaatgagagtaaaaatacttaatttgatctcctttcgtattgaaaacctgtcttcagtttttaatctggatagtaggttcttttatattccatttctgaagtatgtgttttggtaacagaacttctaaattaaatatggtagtttcattatcaagaatgaattcataattttagagtagttttctctcttttattctaaaacattttaggaaaaaagaatatcttcttgtattttaacagactgaaattaggttgagtatcaaatataaattccaagctaaatgccacatgcctggttaggttttatcttacattatttgtttaaaaaacaaacaaaaatctatgagaacctacaagaacagcatctagaagtttttgcttacttgacttgttggtttttaaaaacattttaattcattacaaatctggaaatgtttgtactgtttgcttttgagattatagttatttcttattgattactttcttctacattctttttttctttcgtattaaaccagaaaccctggctatgaaaggattaacgttgaactgtctgggaaaaaaggaagaagcttatgaattggttcgcagaggtttgagaaatgacttgaagagtcatgtgtgtatccttttgaaatgtatataagattgagtgggctgttccctcttaccacaaggaagtgctttttttcttaaattgaacaccgcaactgtcatcattcagagaacccccctcccccccatatacccactgcattttaacaatacatgttaagtgaactgtgatctatggaagttcttctcacttggggggggggcattgctatggcttgagtatttatgttcctctaaattcacatgttgaagcctggtcaccagagtgatggtattaggaggtaggtttgtctgaaaagtgattaaggtgtggggatagagccttcaggaataaaatctgtgtaacctgccccttggccacatgaggatacagttatgccatctgtgaaggagagaacaagactcactaggtaatggatctatagaagtagtatgagcagcagatgtcttttgtttgtaaactacccagtttaagtaaagtattttgttatagcagactaaatggcccaagggagataccatgctgatttcactcatctgtgatcataactttagagaaaccatactaaaaggaatattttttaaagatttattcatttattaggtatacagtgttctatctgcatgtatgcctacatactagaagagggcgccagataccattataaatggttgtgagccgctatgtggttgttgggaattgaaaccaggtcctctggcagagcaaccagtgctcttaaccctgagccatctctccagcccctgtcataaggaatattaaagaatcacctactatattgagtaagaacagaggctgtgaagtacaggtttgcatgtaatgaacttcactcagacctgaggccctacttagcctttttctgttatcttaggactcagtttcctcatttgtgaaatggggatattcatactctactggttgtagtgacttaatgttgaaatatataaaaaaaaattatgttttgttaagtgattgataaggactgtatctgagtagaaatgtatgagggaaaacataaaaaaatgtactttggtagttttccgtctctaacaaggatacctgtacctgttttgtgggttagcataatttaagagctgagtcatttaatttagcacattttcaagtgtttaacagtctagtaggacagtacaggtgaagtcaataatgtgttgtagataagtactagatcctatatatgttctcattttgagtatatttaaaacatggcttcttcaaagaagtaccactggttgtgcaaagcagaagttcgtcgattgatcagaggactagaaaggtaagccagggctcaacagtgcagttgtagaaaccctcctactctggatgttgatatgtcagtattttgctctggatttacttaaccacagtagatgtaactagcttaaattaattattttagatttattttatgagtatgagtcttttgcctgcatatatacatttataccatgtgccaacattatcttggtttttatcatttgggttttaaaaaagaagtaggatagaaaaaaaaaagacaaatggggcagtaggattgattgattaatgtgatatagtaaaaagggtttatagtaggtgagatattgcctcctccttttattgtatccctctctccctctcatttctctgtgtagccccagctctcctggaattttgtagaccagactggccctgaactcatagaaatctgcctacctctgcctcctgaatactgggattaaaggcatgtaccatcctcatgcctagctttatagtattcttatcaccaattgtcaatttccttggcttatctatttttagttgactataaggtctctgaatgtaggaaataaaccccaattattgagagcttgtatcaataattttttaaatgtagtgttttggttttatatgtgattgagtgagttttggaaacattgttccatttggaagattttcctaaagaacttttagccaaaggaaagcccctcaggatatcatataaattatatatcatgggtttagttcttctcttttcttttaatgctaaagattatttcttatatttacttggtgtttgttttgtgtcagccagtgagcactttcatgaatgttatttcagttaccattattttgttccgctgtgtaggtatttttatttacgttctgtaatgagaaatgaaataaagctaatttgtttgaggttataacattaataaaggttagatctaattatctatagcttcaaatactgtgttcttttctgttcattaaattctcttttttccttgtattctttcccagtgtccctgtttacattcagaaatttacaaatgttagctttctaagtatttaggagattgtttggtgtgtatgtgtaaaacatttttttttttgttttgagacaaggtttcactttgtatccctggctgacttaaaacttaagtctgtttctctgcttcctgagtgctgagattaaaggcatgtgctaccatacctggctgggaataatatttcttgacatacaggttatatccttaactaagttactttaggttggcatgtttatggccttcttcagaggtcagacaagaaatacgatgaagctattaagtgctatcgaaatgcactgaaatgggataaggacaatcttcagatcttaagggatctttccttactacagattcaaatgcgagatcttgagggttatagggtaagtaaaattcatattgttttattttatcataagagaaaaatcttattacttagaacttttaatatattttggtaaagaaatttttctttgcatttttttgaaaaaaatttaaccgactgcctcccttagtgaatatacctgtgattggagcagttaggtcttaaaaacaatcgttttgttgtgagatagagtaggagtactgtataggttgttactcattttgttaaacattaatactcagaatattgctattaatattttgtaactctagtcttgtcattttctgtaaagtaagtttttaagttttgtgtttgtctattcatattaatatagtttagtagcttctgtttaacccttaaatcagtcttgggtttataatttcctctttaatctatttcttcatgttagttcctgccacagtgttttctttacaggccttaattaagtgcctagaaagtacacatatttggggtgtactttctaaacagtttcatttgctgcatttgctgaaggatatctggtataaagtttaaaaagatactataagattaacactggaggcttcaaattatttgtcacaatacagctatataatactagatgttgaaatttttctaaaatagttaccataattgtgctacagaatgaataattgtggagcaaattaatgtgatcttctgttttcttagggccctgagaattaaatccatggccttgtatgctagtcagtagagaagtatttgctttaactataaacctaacagtaagttttttttttttttttttttttttttttccctgccccttgaaggaaacaagataccagttgcttcagcttcgacctgcacagagagcatcatggattggttatgctattgcttaccatttactagaagactatgaaatggcagcaaaaattttagaagaatttaggaaaacacagcaggtaataacaagccagtttattgtgtctgatttgatgtgtaactgaaagaaagaaatttatgtagtttaaccaacattttatttggaaaatagcttcaaacttattcacaattgaaagagtagtagaaaataactataggaattacctatattatctaatggtaaacctgtggtacatgtacttttaaaagtctttgtggtcaatctgtgcttacattttcttccttaaaagattgcagacatgttcttttacatacttcaccgtactcctaagaatactcctaacaatgcaattgttataattgcagatggtatcacagattatcaaaattagacttgtttctaaggtatagtacatggtgaaaattatcttaattttttcctctaacagttttgttttcaattccattgtctggtttttaagcatacctgtcatgtgatcatttcttgggaatgtgtctgaactaattttaaatagtttatattttctggggctgcagagatgcctctgtggttaacaatactgactactcccacaggagttcaatttccagcacccacacggcagctcacaattgtctataatttaattgtccagttccaggggacccaacacccatggcaaaacaccaatgcacatacataaataaatagtttgtattttctgttattaattatttggtgaacatacattaatgtttttggaatgttcctgactttggatttgtttgcctttcctcattgttaaactgcactcttcacagaaatccacagactaatgatggttgcttctcagttcagcacatcaactggtacataatttatccgttccattttattactgtgttagggtggtatttgcaactgtaaacttgtttctttatgaaaaacctaagaccaaatagctcatctgtcatcacattttgaccaccagccttcagtattcactgcctggctcagctgttaaaatggcaactttgaagtagggattctctcactcccatttttttatttttctagatttttttgtttgcattctgtcattagcagatttccctttctatttgtatatcaaaacttaagcagatttccctttctatttgtatatcagaacttatggattattttattcaatttattataagctgttctttaacatttcataaacagatatttaggaattttaaaagtattgctattaaccacatattatctttttgtttgggggtgtgcagataatttcctaatacaaaaataaaattcttactgataatattccttgtgtctacatgcagacatctcctgataaagtggattatgagtatagtgaactccttttgtatcaaaatcaagttcttcgggaagcaggtctttatagagaagccttggaacatctttgtacctatgaaaagcagatttgtgataaacttgctgtagaagaaaccaaaggtattttaaaaaatatatcattgtaacttacagccaagagtttgctgaaaattcatagttactggtgacagttgcatataatgggaaaaatctatcattcatacattttgaataacttgtgatgtaggaaaatatacattaaatgatgaacattgttgattgaggagaaagggtcgcaaaattcatttgataaaacaactttggtaaagtgtttgttttgaattttttattgtctttaaagggggctgtgctatgtcttcttcactggtctcaaacccctgggctcagtggtctttattctgtagctgggagtaattgatactacagagttaaactaacacccagtgtaagcatctactctgtaaagtctccctgtttttgaagatacaggggtgttggggggaatcactacaggatttggccaaaacataggagataattgtaattttataaaacaagattaactattttagaaataactcaatggaaaaattacagtctttaagtactatatgccagatttttttttttttttttggatttatttatttagtatacagtgttctgcctgcatgccaaaagagggcaccagttaccattatagatggttgtgagccaccatgtggttgctgggaattgaactgaggacctcagaaagagcatccagtgctcttaacctcctctgagtcatctctccagcccctgtatgccagattttattaccagtagtatatatttataaattagtccttactaacattcgtagagcaagctggatgtaatggtccattcctacagtcctatagtgaagggattaaggcagggttaggagtttaaggccagcctggattctagagcaagatcttgtcttaaccccaaacccccaaaagaccaacaacaaacaaataagaaaataacaacagcaaaaacaaactaaacgaattcccagatctctttatggtttatctgagtttatttgagaaaatgggaaggccataaattccagatggcaaggaacaagatttggatttttttgtgataggaatgctaggtccttaaataaatgtctccaaatgctgccgtttattcctaggctgagaaaaagagagttttgtagttcctatttatttgttagttgattgatttgagaccaggttcttttatgttggtataggttagcctttctaggtgttctgttgatgttctggccagacttattaagactggatatctcttgtgtgcatgtaggattggtgctttacagtattcagcgatttgtcctgttagaggaacaagcaaaatgtctttaaatattgtcaaatgtactttggttgagagcccatgaaagtctaatttttataactctctgcaagacccttcacttatatctcccttaaaatactgaatagtagtgactaatttgataattctaagcatgatagggaagctgggaactcaggataacactattcactgtcaaacattaattcaaaaagagactgtgaagagaatttttgagggaaagttttcctgggatgttttaaaaaattactgtgtttttgttaaataggagaacttctgttacagttgtgtcgtttggaagatgctgctgatgtttatagaggattacaagagaggaatcctgaaaattgggcctattacaaaggcttagaaaaagcactgaagccaggtagtgtggtttgatagtcactgttttcgtccttttttctttcttcctcttttgcttcttttaaagacagtgtagccctggttgttctagaacttcttctgtagaccaggctggcctcgaactcagagatctgcctgcctctgcctcccgagtgccgagaataaaggtgtgcaccaccacagcctgattttgttttgtttttttctttcttcatccttaatgtatgtttttaacgtgctgccgcaaaatctagagccagatacatgtttaataggtgaattctacaccagccagcgctacattgtgagactatgtctcaagaaaactaaccatacaaatatgcaaaaataaaccagaattggttcaaagtctagcatgttagattttgttagttcatgcttataatctctgtacttgaaagaatgaagtaggagaatcttgagtttaaagccagcctgagttaaaaagtagtttcaaggcctgattttacatactgatacccagaaatgacaaccaagcaatagattcaaaatctaaatgtataagtttacttcttagtcatataaaagattgagaatattctgaaatccacttttacaagataatagaattgcttaataaaggccagtaagatgacttacttggtggaagaagacacttgactcccaacctgtgacattaaaatgtgtagtggaatgcaagtgcatgtgtgtgcatataccacaccacatcacacacaaattttaagtaaatgtcataaagttaattttttatgtatatgaatgtttgcctgtatgtagagttctgtaattttaaattagttactttgggtaactaatgaatatttaaaatatgaaattatttggaaatactttaaaatgattgttgatatgcttaattggcagggatacacaattttcttgtacaactttgctgtttacttttttgtttgtttgagacagtctcgctgatttcaagcaaatttgcttgaaatttgttatgtagaccatgctggccttaaagtcacagagatccaactgcctctgatacattaattgtaattttattgtagttgtagtgttttacttagattgtaattgtttttatttagtaaacttgttattgggtagaaataagtaatttgtaattatatataaaaagaaatccccccctttttgtctacagctaatatgttagaacggctaaaaatctatgaggaagcctggactaaataccccaggggactggttccaagaaggctgccattaaactttttatctggtaagtagagtaattgcaaaagaaagaaaaagctattgtgatttaagtatgtgtatgaaggctaatgtatgcattgtatgagttgtcaacagaatctttctcttccaggagagaagtttaaggagtgtttggatagattcctaaggatgaatttcagtaagggttgtccacctgtcttcaatactttgaggtctttatacagagataaagagaaggtaaagacaaccacaactattctcagaatctgcctggctggctctccattccctgggctcagcactacctcttttgtgaaccactgttagtctcctggcttgcagtgggaatgtttctatacccttttctcttgtaatctgtttgctctttggtgctgtagtgacatcagtatttgctttctttcatttcctttagctcatactaacatttttttctaacccccttttattgttagaagtcagaagtgatttattttttctttgccttgaaactaaattttagccttgtaatcctccatttttatttagtaaagtgttgtcagaagcattgtttttttcttttttttttctttctgtttttttgagacagagtttctctgtataacagctttgactgtcctggaactcattctgcagaccaggctggcctcgaactcacagagatcttcctgcctcttctgcctcccgagtgctggaattaaaggcatgtgccaccacctcccagccttcaagtgctttttaaaggggtattttaatctttatgttgattatttccttgcaagaacaattttatcaagatatattgggttaaaaacatgaaagatcattgaaaagaattagaaaggtgggagaaattgagcatgtgtaatacataatgtgcatttgtcagtcttttgttgaaaagcccaaggtatgtatgggcttaattgattgctccttttattttccttgcataggtcacatccataagaatctaacctattctagtttttataatttccttcaaatcttttcatagtatccaacttaaataatttttgacttttactaagtttacatgatattggattaaattctgcgttatgatagtctttcagttgttattaaatgcacctaactcaaacagtttgggaatgtcatattgcaccttggtgtaagtgtgtagcctaacttgtgaggagagcacaggtgatatcagaataacctggctgtgacaattccgtgcttatagtccactcacaagaaaacctgcagtaatctgttcattggtcatttaagcaaatttctatagtaacaaatcattaaggatgaattaaataaataaatcatgttttttaaattttgtttttagatttggtgtgggtattgcgctatgttgcccaagctggctagaatttctgggctcatttgatcctcttgcctcagacacttgaataggactacagacacctgccactgtgctctgcttaaattagggaattaatgaaatataaaagtactgcatgcctccgagaaagccagaagtgtagttaaaatttaggagaaagtacaatctggacagacaggtattttcctggacttttagcaccccactttgctggaattcgaagttaatgatctttttcttctgaattatgagacgagttcatttatgagatacttacaaaaatgcccccttcacataacatttaattctttttatttatctgaggccagactttatgtctcaagtttcaggcttgctgcatagttggagctgaccttgatcaaactcttgatccttctgcctccacctcctatgtgctggtattacatgcatgtgccaccatgccagggcatggcatttaattcttgatcataaagagcaagtgataactgttggtattctctatatgttttaagataaaaattaatttagacataagttacagcattgcctctgtccaacattcatccactgctggtttagtgatgttttatttcctatcatacaaatgaaggttttaggagatgagtattaatgtgtgccttttatttttaggttttttttttttttttttttttttttttttttttttttttttttttaagatagggtttctcagtgttttcttggctatcctggaactcgatctgtaggccaggctggtcttaaactcaaagatccacttgactctgcctccctagttctgtgattaaaggtgtgtgcccagcttagactttgtaggttcttgtctagaggttaaaatactcataaagggagggaatatgtgtgggaatatttatttaatcctttagtataaggaatacattttgcataagagcagtaacttactttcactaaaatgtgcttgtgtttgtactctaggtggcaattgtagaagaactagtagttggttatgaaacctctctaaaaagttgtcgcttatttaaccccaatggtaagtacatacatgtttgatagactatgaaattagcatttagttttgattattttgatagcaagtatggtgcatttagtttctttttctattatgtattctttttctattatgtatagccctggctgtcttggaactccatctgtggaccaggctgtcctcaaactcacagagatcccccgcctctgcctctgcctctgtctcaggaatgctagtattaatggcaagggccatcatgcctggctatcctctaatgttaaatcccaagctttacattatttcatgaatttttcaacatgtcttagagaagagtacatttcaaacaaagctgtaacctagtgtaagtggcatgggctcataatcccatctattcagagtatttgaattagggaaatttaagaagttgaaggcctctgggcaagtaagaacctgtgaagatggagtttctttccagcctggtccctttagccctttagccccaaataaacaaacataggcttataataactataaactgtttggccgatggcttaggtttcttattggctagctctctctacctatagctattaatctatgtatttctacatggcattatcttacctgagaatgcccatgcatcctaccttcccagtagctacatggcgtctccggtgactgattctctgcctttcctcttcccagaattctactggtctggtagccccacctatacttcctgtcttcctactgaccaatcagcatttattcatcaaccaataagagaaacatatgttcaaagcatacagaaggacatcccccatcatctcctcttttctgtctatataaaaagaaggtttaatttaaaattttatataacaaaagttatcaagcaagaattatagttactaaaatttagttcattaatatttagcaaaatttaaagaaaatattctatcatctatcctatcctggtgagtctaaagttttatatgtaccttatcttttatcataattcagaaaaaccataacaatctgtcctcaactccatcaaatactacagaaggataatatataaactctagaattgacagagacactgcctggacagccacccaaagttcctctgtaatgttggggcatccatcttcagcccatagtccatagtgtctggcagactttttaatgaggcaggaagcttgaagaaccatgctgtcccttggcaagtctagcagtcacttttctttgtaacctgcttgtccagttttgacagcgtgctgtcaagcagtccaggcaagagcagtcttgtccaatggctattcctgccatgtaaaaggcaaactccataacgagttttcttcaatgcccatcttcctctctgatgtaattggtgttgccaggagctgttatgtctcattttcatgagaaaccttaataaacccattttaaatgccatattctgtaggtctttgaaaaatttgaagtatgcgtatccatctcaaatatattacttttttttttttttaaagatttatttattatctatacagtattctgcctgtgtgcaggcctggttgtgagtcaccatgtggttgctgggaattgaactcaggacctttggaagaacaagcagtgctcttaactactgagccatctctccagccctaaacattacatttttaaatgagctgtataaatacaatgtctaaacaagagtagaaatacatatataacaaaattgaccttaaatttgtatcaataaaccaaaatccataccaatgcagagtattcatttctatatcaaccttgtttcaaaattttgaaagagggttgctggtacagctcagtggtagagtttttgcttggtgtgtcttaccaggccatggggttcaatctcaagtatttcattttccccccaaacacacaccatacatatacaccccatacacacataacctaggatgatattatgtttgcaaatcagtactttcatggatacagagttagctcagtctgtaaaatatacgtgtaagggtccccaagtttgatttcagtgctcacatgaaaaaaaaaaagaaagaaagaaaaagcaaggcctcgttgcatgtgtttatattcccagtttgggggaggatctgctagatagccagcctaacctaatttgcaagcctcgggtcccagtgagggaccctatcctaaaaaccaggtacattgcaactgagaaatacttgttcactgtatcaccaacatgtagatgtacatgcacacaaaataaatatgtctttagttattaataaccagtttacaatcacattttcagttgtattatattttgtctttccctccgttctaattcagtccctttgtctttcctctcctttccttcttttttctctttccctttttctttcttccagattttgagacagggtcttactttataatccaagatgttcttgaacccaggacagttgtcttagttgggatttctgttaccgtgataaacaccatgaccaaaaataacctgaggagaggttttgttgcagtttacaactcagggactgagagaagtcaggaaggagtagggtaacaaacattttgaagtcaggaactgaagtagaggtcatagaggagtgctgcttactggcccatggcccgcttcctaaggcttagcctgatctcttatacaccactgacagtgggctggaccctcccagatcaatcactaatttaaaagccatagtgcagactgcccacaggccagtctggttcgagggagtattttctcacttgaggctttttcttcccaaatcagtttgtgtcaagttgacataaaactatccagctcagcaatactccttctttaccacacccagccctttcctttatttgaagatcaagtaactcttaacagaaataatttggttgttgtctcctttaattcatgtttatcacctcttgaacctgtgattattggagagtgaattttcttaatctagattttgatgaatatattttacgtatattatttttctgcccttataaaatattttttttaattggtagttagatgaagaaatggatagtcttttctgcttagcattagccacatagaaaaaagtctggttgcataattctcaatcttcataatgctgtgaccttttaattcagttcctcatgttgtggtggccccaatcaatccataaaattattttgttgctaactataattttctactgttatgaattataatgtaaatatcttctttcataatggtcttaggcaaccctttaaagggtcatctaacccactaatgtttggggttgtttcccatagcttgagaaccactgatctatctagttctttatagtacagttcaaatgctggttagcagcaacatacatacagctaatgtctgttctactgaacaggacaggtgagaaacatgtctgttgctccagaaccttgtaacggacagactctagctaatggtttgatgaaggttgattaattgggttctctctgtgtctctgtcttacctctctgtctctgtctctgtctctctttctctcttctttctctaataaaaacataaactaaatgagccaaaatcattttcttctatgagtaggcaaatactgttattttgaaagctaaattttatttcacttacaatttggtttacaaaagtttcagcttgtatggagaaagacacaaaaatttttttcctcctatgttatactttggttctttaccaagtttcacgagattagactggttcattgcattctccatcgtggcaagtagttttattgaaaaaaaaaaaatgaattcagggcctggtgatttctgagtttagtccctggatcccccatggtaaaagaattgaacttacttgaatgataagttgtcctttgacctgtttatgccctgtggcaggcatgcacccagacacatatactcacaacaaatataacaaatgttttcaaagaaaataatttctatttgggctggagagatggctcagcggttaagagcactgactgctcttccaaatgtcctgagttcaattcccagcacccacagggtggctcacaaccatccgttatgagacctggtgccctcttctggtgtgcagatatatatcgaagcagaatgtcatatatataataaataaataaaatcttaaaaaaagaaaataatttatatttaagcattcctgatatttatttaattttatgtggctccatctttcaagtactgtggtggtaggtgataacttactcaatgacaataactcgagcacctaacttgtgcactaccactgaagatctggaatcatttttcccacagagttctggcttccgtagtggactagcccaccatgtgggacctggggtacacattgctactaagctggccattgtttctaggtctcagattaattttaacagtacttttaaaaaggcatagagtggtttcattggttaattgtcatgatattcctttgattatcagcatttttctacatattttacaatgtggaagaggctcagtgacatacccatgaatatgcagcacttttgttacagatctatcagatgaggagttggtgagttccactcctattatttgtccactgagccatcctgttcttactagggaaaagataagcaaatagaatttgagagcaaatatgattctcaggttatagagatttatgtttaaggacaaaatttttgttgtgtgaattttgtgtttaactttcacattattaaaattacatcttgaaaacgttacatcttgaactgaaatatagaataaatgttttttttatttttcttattttctttagatatagctcttattcagtctatattgttgatctttacatgtttggcataatattaagacctaaaaatgtcaccaaagataaaaatgttcacatcacaaatatatatgtgggttagtatattacttagaaaattaggcagtcacacttttcttaaaatcttactataagtaaggtatgctaaggtgcacttaagatacagaatagaaaatgtgcttagctgtagattacatctagacacatgcataaactactttaaaactactttccttataaatagaggggccattatggtggttggatattctcttaatgtttgtaatgtctaatcttgattttttttttctttttttccctttcaagatgatggaaaggaggagccacccaccacattactttgggtccagtactatttggcgcaacattatgataagattggtcagccatctattgctctggaatacataaatactgctattgaaagtacaccaacattgatagaactctttcttgtaaaagctaaaatctataaggtaaaatctttatcccttctttttttgtaacgagatattagtcatcatttttgttgttttacagcttctaggtagagtaagtaacattgtatgagaaatatcaggctgatgtattcttagagttgtaatggtaatgtttatttgttcatttatcaataactatacaaacaatacataagagaaatactgtgtgtggggggactcatatgttcctacttgaattgttactgaatgtttaatagttatttactgtaaattgtgtgtttctgctaacagttaagtatgatcacatggagagatactctctcagcctagacacacatgggagggcctaggccctgccccaaatgatgtgacagactttgatgattccccccatagaaggcctcactctgtggggagtgaatgggggcaggggaggatgggagggagatggaactgagattgatacgtaaaataaggttgtttctaatttaagtttaaaaaaattaaaaaaagaagaagtatgatcagtgtaagtatctgatgctatttaagtgaaactagtttattttgaatgtacatgctaccatctcttgactcagtttctgagctatgcatgagaagctcctgttacatgttctcaagtcataaagtttcctcttctctatcttatttgccagtagatccagtaataggatttttttaaaggagttaatgtaatatatttagaaagaaatataaacatataagaatataatggaattaaataatatttccaagtaccccccctttttttttttgcttgtactgggttttgaatgtagagctttatatgcactatatagacattaacaccaagttgcccccatctgcaagttttgtttatttattactgtattttatttgaggcatggtcttggtagtaggctgagcttgaaagtgggacttctcctgattcatcctcttaagtgctggtattaccagtgtgaaccactgtggcccagaactttaaaaacatgtctaaaattagattgattattttaatggaggcagcatgtttttgttgttgttttgttttttagacagggtttctctgtggctttggtggctctcctggaactagctcttatagaccaggctggtctcgaactcacagagatctgcctgcctctgcctcctgagttctgggattaaaggtgtgcaccactaccgcctggctacagcatgtgttcttaactgtagcatgtacatgtaagttggaggacaacttaagagagttttctttctaccttttggttagaaacatctgaacaggtcatcaggcttggcagcagtttctctttaactgctgagtgagccatcttgtttgctaccccaaatgttttaaagccaagttttactgcttttccagatgtcctagcgaaatgaattataattaggatagtgggggaatgtccattaatagctgtctgacctggtggttgactgttctgcaaggctaacttgatgatgggttccaggaatattcctgtcttaacctctcccagtaataggatgaaagactcaagctactacaactggctttcttacatgggtgctgggacctaaccccaggtcttgagttaaaagagtatcttttctttcatttgtttaattatttataggtcataaattacttaacacaataaaatgatcaaaattgttgattttctttttctaccttcaagcatgctgggaatattaaagaagctgccagatggatggatgaagctcaggccctggacacagcagacagatttattaattccaagtgtgcaaaatacatgttaaaagccaatctgattaaagaggctgaagaaatgtgctccaagtttacaagggtttgtatggctaatgttctggagtgtaaataggacatagttgacttcgtgttcatacctttctctttcaaagttagttcttttatgtgtgtagatgttttaccttcatgtgtacggtctgtgaaccctgtgcatgcctggtgcccaccaaggccagacttgggcattgtctttgctttaactgaagttaagacagtcgtgagcagccatgtcagtgctgacaattggacctgaatcttctggaagagcaccctgttcttttaaccagcaagtcatttttccagccccttaagtttcttgtcagtatcacagttgtccagatattaaattattgtattagacaaagaatagtcaacattagataaaatattttctttttatattatcttatatttgttggacttttttttttttttttttttttttgagacagggtttctctgtgtagccttggctgtcttggagcttactctgtagaccaggccatctttgaactcagagatccgcctgcctctgtcttctgaatgctgggattaaagatgtgtacctcacagctgtagtcatcttaactcagacagtcatggtagttttttgttttttgtttttcttaaagattttatttatttattatgtatacaatcttgtgcctgcatgccagcagagggcaccagatctcattcaaggtggttgtgagccactatgtggtgctgggaattgaactctggacctctggaagagcagtcagtgctcttaaccgctgagctatctttccagcccctggacaatggtttttaaaattaatttgtagctggcaatgatggcacatgccctttagtcccagcactcttaggaggcagcggcaggcagatctctttgttcaaagccagtcactctatacagagtaagttgcaggacagccaaggttacagagaagccctgtctcaaaaaaacaaataatcaaaacaaagaccccccccccccaaaaaaaaaaaaaaaaaaaaaaaaaaaacccccccccccaaaaaaaaaaaaaaaaccaaaacaaaactggcttgtagtgattactgtcgagaaaaatgttttaggagttaagggaactagtatttattacttatctgccatatgctattatttattgtgttattccctgccacccagttattgtagatcttttgtggagtcacttgcaaaattattatccctagtggttagaaaaagaacttaagtcaggtggtggtggcacatacttttattcttggtacaggatgtagaggcaggcagatttctgaattggaggccagcctggtctacagagctccaggatagccaagaaagaccctgtctcaaaaattatttcagaaatgtcatcaattgactattgttcctttttaaatcttatgataccgtgatgtatttggtggggattgtctggaatcactatgtgatttttcatttaggaaggaacatcagcagtagagaacctgaatgaaatgcagtgcatgtggttccagacggagtgtgcccaggcatacaaagcaatgaacaaatttggtgaagcacttaagaaatgtcatgaaattgagagagtaagtatctaacatatgtgaacttctaattttgtttgatcagatattgaagcctttgtgaaagccatcatatctcccccactctcccctccacatttgtaattcacagcatatattttagaatagtaataccatattcagattttgtaaatgaaaacatctggtatgatcttttattcctttaagaatccttttcaaagacttcaggaaacctttgtgtcctgatgatgtttttactgcatgcagttctaacttttgaattgctgctgtctatccttgataaagatttgagcttggaagcttttttgctatctttctatatgcagtgcagttaataattttcttacaaaataatttttcagcctgggtatgctaatgtgtacttgtaattccaacatttgggatcttgggagatagaggcaggaagttctggagttcaaggcctatcaccactgtgtgtttgagggcagcttgggctatgtaagaccctgtctgaggctggagagatgactcagtgattaagaacactacttggtcttaagtggtcctgatttcaattcccagcaaccacatgatggctcagaatcatctgtaataggtctggtgccctcttctagcctgcaaggatacatgtaggcagaacactgtatacataataagtaaatcttaaaaacaaaaaaaggaccctgtctgtacaccaccaccttccagatgaaaatcattttttttttttttttttggtagtcttcacgatagatttctatgactagtgttggggtgtgtgttgttttatatataaacataggttctgttaataagttgacatttgtaatatcaaatgtagaatatctttcttggttgaactatgaggttgctgatttcttgacttattggctacttaatttttcatttacataaaagtgcatcctacatagagttcagatttagagcctcaaaaaaatttctgtagtatatgtgccaactgtatagtagcattgtcatatataccagttagtgggtagtttgtcagaatagttttacttaaatatgacttaagaaggaaatatgtatgaagtgttattatcccctttaacttatttcagttttattttcattggtgtcctgcatttatgtctgtgtgagtgtgttggatcctccgaaagtgggtacacagacagttgtgagctgccatgtgagttctgggaactgaacctggatcctctgcaagagcagccagttctcttaaacattgagctatctttccagcccctgccaactatattttttatttcatattccaaatatatcaaattattataattttatatttttatttttcatgctaatgaagcaagtaatcccaaggttttgcttttatagttttcttggacaatgttgtactccagtgtgataataaaaagataattttttttttttagcattttatagaaatcaccgatgaccagtttgattttcatacatactgtatgaggaagatcacccttagatcatatgtggacttattaaaactagaagatgtacttcggcagcatccattttacttcaaagcagctagaattgctattgagatctatttgaagcttcatgacaaccctcttacagatgagaataaagaacacgaggctgatacaggtataacattcagagatttatcattatttgctctttgtgtgtgtgtgtgtgttttaaggattttatttattatgtatacagtgttctgcctgcatgtcagcagagggcaccagatctccttcaaggtggttgtgagccactatgtggttgctgggcattgaactcaggacctctggaagaacagtcagttctcttaaccactgagccatctctccaacacccacgctgtttgtgtttataggtacttaagttaatgaataatgtagctcccttgcccccagagatttttattgagtatcttggtgggggcttgttgtccacgactagaaaatgatgggtgttttgtgaatttgtctaagtaatagaaggaaaacaccacttttatgcttccaaaataagttaagacttaatttgatgtttgattttgtttttgttttgagaagttttttttggatatttggtgggtgtctaaggatccaatgacaccacagctcattttaaaaataagtggttaaaagaagactaggaaaactgctgggactcatttttcactttaccattttttagtgaggtatcaagatttctagggagaagtgatcccttaacacttattagagaaagaatctcaaagtaaaggtggtctttcatatatggtatatatttattatatgtataaatatttttaagttatgactttactgtagtgaactgacatgagtccctttaagataatggcagatatatatgaccacagtctcttcacaggtatgaagagacaccataaccaagctcttataaaggaaaacatttaattgtggttgccttcgtagttcaggtatttagtccattgtcattgaggtaggaacccatggtgttggagaaggagctgagagttctacatctggttctccaggcatcagaaagagacagtgagccattaggcctactttgagcttctgagatctcaaagcccatccccagtgacacaattcctccagtaaggccacacttcgtaataatgccactctccatgggcctgatggggccattttcactcagaccaccacatatagtaagactctgttagaagagctaaaaattggaaaagtaactcagttggttcttttctagcacgtgtaaggccttgcagtatagttcaaaaaacacaatccatttgataaaatgttattagagcataatgaaacatatctttttttttaaaagattttatttatttattatgtatgcagtcttctgcctgcatgccagcaaagggcaccagatctcattcagagtggttgtgagccaccatgtggttgctgggattaaaggtgtgtgccaccactgcctggctacagtgttgtttaatatgtaaacaatgttactatatacaaaataaagttagtttagaataaataaaaaattaaaagcagggagtggttaagatcatatcctgctcttggagaggacccaaatttggctcgcagcactcatgttgggtggctcacaattgcccatatctctggctccaggatgtctgacattgtcttttggcctttgtaggttttgcattcacatgcctctcaccctttaaatatttagttaaataactaaagcctttgggggtaaaaattagagtctggtgcgatagctcagcagttaagagcacttgctactccagcaaatcatctaagattagttcctttgcacactcctgttttaggggctacagtactctcttctgacctctgagggcacctgttatacatgtggtacacataacataaatacagacaatgcatcttatcttagtcattgttttattgctgtgaagagacacaatgatcaagattactattataaaagaaacatttaagtgagctttcttgcaatttcagtctattatcatcatggtagggagtgtggcaggcatgatagtaaaatagtaaaatatatcctgcttttttaggcaccagacaaagagaggctggtcctggcattggcttttgaaacctcaaaggctcacccccagtgatacacttccttcaataagccttatctcctactctttctcaaatgtgccactctgatgactaagcattcagatataggtgcctgtgggtgccattcttattcaaaccatcacacacctataccaataaaattttgaatgttgccaggcggtggtggcatacacctttgatcccagcactcgggaggcagagacaggcggatctctgtccgttcgagaccagcctggtctacaagatctagttccaagacaacctccaaagccacagagaaaccgtgtctcaaaaaccaaaaaaaaaaaaagagaaagtttctcaggtagttacagtgagttttgttaatatgtttataattctgtaacacttacttcctacagcaaacatgtctgacaaagagttaaagaaactacgtaataaacaaagaagagcacaaaagaaagcccagatagaagaagagaaaaaaaatgcagagaaagaaaagcagcagagaaatcagaaaaagaaaaaggatgatgatgatgaggaaatcggaggccccaaagaagaacttatcccagagaaattggccaaggtatttcatagttgtgcctagcacaagtgtgtgagtgccacggcaaacttttggctttgaaaattccaattatctttatgtatttgtttgtgtgtcttttgtgcagatgtgtatgtatgtgtgtggctgtgcttgtagagattagaggacaacttgtggaagtctagctcacctaggctacctaaccaagaccctgtctgaaaaaaaaaatttattttttaaaaaatcagactctggctgggcggtggttgatactcgaggcagaggcaggcagatctcttgtgagttccaggccagcctggtgtacagagcaagttacagaatggctccaaaccttcagagaaaccctgtctaggaaagaaaaaaaaaaaaaaaaaaaaaaaaaaaaaaaccagactctgatttgtggattttaatcattgtacccaaacctaaatacttaataattattatcacatgagttattttgattaataacctttcttttgaccacagcaattgtattttatgggggtaatggttgtgtaactcatgtgttaaatggatagaataaatgcattttagcgtcactaatcatttgaaatttgaatttcaattcctcctttagaaagttttcctgagtctgagctgcagtgttgtttttgtgccaggtgtcacaatatggcctaatgattattagtagctagggttatagattttcagaactaagtttctgagtgcattgtttgagaacatagaaggaacccctctcatagattgtttctgacttcatagtattattacttgcaaggaacataagggctcctcttttcctagtataagtagctcaaagatgctcttatccagtagcattctcacttatttggtagtgtcaaggctagattacatcaagccttccataattagtagttgcaacttgaaggatattctaaaagtcaatgccaaatagcctaaagtgctgtgtgtgtgtgtgtgtgtgtgtgtgtgaatcatctcaagatagcatatgtatgacatagaacaataccattaaatcagtaattccgtccatggagaaatggaaaatgctgtgggtttagttaataagtttggtactcagtcagctaaagataaacctaaaattttcatgaaagcttgtttgtttgttttgagcaggggctcatcctagcccaggctattctcaaccttgtggcagttctccttcctcaagtgctaagattacaggcaagagccaccatgcccagcatatgatcttcaaattacaaattgccttgaaatctaatcttcatgagacagagacatactgttttattttatatgtatgtgtatttttcttgtgtgtatgtctgtgcaccacggagtgcctggtgctggcagaggtaagaagatagtgttgaatcccctagaaatggagttagcacatggttgtaagtctttatttgagtgctagaaaccaaacctgggtcttctccaagaatagcagttgctctgaactactgagccatctctccagcacctagttgatttgtttaaaattgttcttctagaagattagcatccattttgtggcttacagaagtctgaactccactcccaggatatctcacactcttctggcctctcagggcactgcatgcatatcatgtacaggcacacatgcaacaacaccaatatacctaaaaataataagagtttttaaaaatcatttaagaattctagagaaaaaagttgtcttatgaaaggttaaaatttgacagtgtgtttctgggtaactggtaagtgcttttttttttttttaacttttggcaaaagaaaacaggagtttaaattaagttcatattcctcaagaatcttacttccttttgtataatgtcttttattttgttaggttgagactccattggaagaagctattaagtttttaacaccgttgaagaatttggtgaagaacaagatagaaactcatctttttgcctttgagatttactttaggaaaggtaggatattaggttacagtggccctgataaaactgatcactccattttttaggattagtgtcacccaccactgttgcatttcttggcagaggccaatatagatttcttgtagaaatgcatgctatgcacagaatgttgtgggagaatacagtgatactatttgacttcttcgagaacacaaagcccaacagtagctgcatacctgggattaagtcagaggtagtaatcacgtcatgtgtgattcaaggaacaaatttaggattttgtggataaaaattcttaatataaatgtaaagcttagccaggcagtagtgacacatacctttaatcccagccttttgtaggcagaggccagcttgttctacagagtgagttccagatcagccaaggctgcacagagaaaccctgtctcagaaaaagaaaagaaaagaaaatgtaaaaaatagtgggttctacagttaagcatcaaataacttttatctgttatgagctgataacataaataaaaagtagtttctgagctggatctttagtcttcatgattgtgaaagcgagtgtccactaaaaatagaaaatgtcagcagtgttggtgttggcgatattggaagggccagaagaatggtcttgtctttcacttttagaatgctcttgtgtacacatgtacatacatatgtacgtacatacacacatacacacagtttcataataatgaatttgtgtaattcattggaaaagtttattatggtagtatgaattgaaataaaaggaaattggttattagtaagatcagactaaggctgttacatcaataagtagtttttgtgaagctagtcccagctactgggaagttgaggcaggagtgttgtggcccatgagttcaaggcccacatggacaatacagatagactgtaatgtaacttttattttgaaataggatgcaaaacttagtattaattgaatgtttaattgtttatgaagacaagtccctgtgttttcctgactgggctggaactcagtgtgtagaccaggctagacttgaacttgtcagcagttctcctgcctttgcttcctgagtctgggatcatgggtgtgtgtcagtatgcccagctgttaacatatttgtatagatatataatacagaagtggctaggaagaaatggatcaatagattgcagttgtttcttgatacatttttaagatgttaaaatttatcttaactatattttctatttttcacaattaaaactttgaaaataagtttattaaataggtaatttttatattttaaacacttaaccctccttttggggaggggcagggagataggatttcactatgagcaatggctggcctaaaactcatagaggtcctacttgcttttgcctcctgagtgctggatttaaaggggtgcaccatggtgcctgactaacccagttatttttaaaattaatcttagagggccagcaagatggttcatcagatacccccaagcaagacattttgagtttcaatctcagaaaccatttggaagaaggagaaaacttactagtataattcagtgacctccactagcacacacaaaatcaatacaattcttagcacagtagtacagtgtagcaactgttcctgtaatctcagcaggaggcgaatgagttctaggccagccaaaacatagtgagaacctcgtcttaaatgtaaattaaaaacaaaagtgtttctaggtggaatcctcagatacactaaagttttgctgcttaaagggataatggagggctctgttgaattggcttcttggctgtgttctaatttcaaaggtgcctcagcatctttcattgatttctaatagatgatgattaaagagcatggcaggaattttaatgttttctgagttttggggccatgggaaaggaattatttcagaataacttagggttttctactttgatatttgaaacatgatgccaaattaggaaagtctcaacaaagaggtgactatcaagaagactcagtgtaagtttctgtttaacaggtggaggcaccgctgagacttgggaaaggtaagcaggtgggaatagggatagtgtagagcaattagaaaatatagtctgggtagatggcatccagagatggcagaggagtcagagatggacagagtcaggtggaaagggaattgtgtgtcattgaatacagaaaaggagagtttttctatggaatgtaacatgtctttgtttttattaaaggaaactggaaacaaattggttttaaattttgtttctctgtttatatgatactagttcatatatcacagaatgccgtgtaagttattttttgtggaaccacttgaagaatggcatatgaacataactgacatgtagccaattggaaggaaaatgtttgcttcaaagatgttatagctccaatatgattgagtctaaattcactttttgtgtttctaaggtccctggcccttccaggaaggataacttattttatcaaattatcaaaatagtatttttttctctttatagaaaagtttcttttgatgctacaatcagtaaagcgggcatttgctattgattctagtcatccctggcttcatgaatgcatgattcgactctttaattctggtaggtttttattcccatacttcacatatttgattagtagctcatattgaatgtcagactggagtgtggctcattgggtcagagattttgctgctcctccagaggacttgagtttgatttacaggacccacattagacaaatacctctaactccagctctgggctaaccaatgccatttttaggccccaagcaacatctaaaaacacatggcatacacgtacataagtaaaagcaaataataaatattaaaaaattaaaaaaaaaaaagtatgggggctggagagatggctcagaggttaagagcactggctgctcttccagaggtcctaagttcagtgcccaccaactatatggtggctcatgaacatctataatgagttctggtgccctcttctggcatgcagacagaacactgtatacatactaaataagtctttgtgtgtgtgtttgtttttctgagacagggttcctctgtgtagctttggagcctgtcctggagctcacactgtagaccaggctggcctcgaactcacagagatctgcttgcctctgcctccctagtgccgggactaaaggcaagtgccagcactgcccggcctaaataaatctttaaaaaaataaaaagaatctgaactaaactcagtcattttaaaggaattgcatattcagttagctaagagaaaaatattgttcttttgtgatgaagatttaattttaaagtccataaatgctatgtagtgttggtatacaattgtgtggttcatgtatttgagaatcttttggctctctttctctgtttctgtaatggagattgaacctagacctcatgcttggtaggcaaaacatgcttctgctaagttacaacctatctataagtaaattttgttactttaaaatagtcacctaaaagctgggcattggtggcgcacgcctttaatccccagcactcgggagacagaggcaggcagatctctgtgagttcgaggccagcctggtctccagagtgagtgccaggataggctccaaagctacacagagaaaccctgtctcgaaaaaccaaaaaaaaaaaaagtcatctaaaagcaatcatgtgcttttcagttattttgacaatcagatcaatacattgatttcaatttgtattagaagcttaaaataaacactgttttcaagccctttccctccatctgggatagaaatgttagtgttactgatgtgcctgactgtatttggctttttaacccaaggttcaggaattgagctcaggtccacaggcttgtttggcaagtgcttttacctactaagccatctccctggacttcttttgcccttttttactttatttatttatttgttgaggcaagttctttgcacgttgtcacgactgtcctagaactcagtgaatagaccaggctgactttacactcacctgcttctgcttactgagtgctgggattaaagacatgaaggaaaatctacttactgttttcaaaagtatggtaaaatgataagtataatttattgaatgccaataacataattttagagctttgacacatagtagcttttccttaaggcatcttttaggttacttctcaccctctttcaagtttaaaatgaataaccccatccatggttcctgaagataaagattagtgaagttggtcatatttgatttttgctttaactagtaaaggtgctttgggtgtagaagacgatgaactattacaagctttatcagagtatcaagctgctaagagttgtctttttaatttattcaacagtgtgtgaaagtaaagacttacctgaaacagttagaacagtattaaaacaagaaatgaatcgtctttttggagcaacaaatccaaagaattttaatgaaacttttctgaaaaggaattctgattcattgccacacagattatcaggtaatcactttatttggtccttccagtagccttcttgaacaactttagtattttaatgaatcactgtcaaggtaaggtatatattttgctcaaaatggcaatatgcactacacttttttagtagtaggaaaacaggcagcgtgtagttgcttcttctatattttaaatttttgtgaaacagaatcgttacagtaaaacaagatatgttgtttctactggttcagaattaacataaataagtacaactgattttttttgggggggggagtaaggtctcactgtgcacccctgcctgatgtgaaagtcactgtgtaaagaaggctagcctctaattcacaaagatctgcctgcttctgcctccaggttctgggactaaaggcttgtgccatctcacttagaagtacaagctgaattaagcaggttttatctccagtacccaccaccccagggtgaatttgtatatattataaaactgtgcaagtaaagcttgtgttcttctcatgcttccattattgtgattataaagctcacttaatgtgattttgatttctcatgcttatgtatttatcagacttggtaagctaaacacctgaaaaccatcttacatttcagaaagtttgaggcaataagagtcagtcacagtgaacaaagtctgggctttattactgtgcttttataagattgttgtcacacactattaatcccagaactgtggaggtagaggcagatggatcttgtaccttccttgtctacctagcaagttccaggccagagctacacagtgagctctgtcacagacaaaacaaagcaaacctggctaaagcctagagctttgtatgccattgtaggaaggtgaatgcaagctttcatcttaggccattaagctcatggctgtttctctcattgccttttcccatgtgaaattactgaaccatttgaaaatgatttacaatcttattacaccaacacaggtattaaagagtgtttgtattgcctcatgttgtttgattatgtatggtttaactaaaattctgttccattgggcggatctcttatgtatcttaatcctttaacagtagacagtccgatcctcttagggtgttactgtaataacagtgtctctctcccatggctataacatatagcactgcttgtgcatacgttctattttaaatcagaatgagtagatgccaagactgttcaaggttcttaaactaaggcgcctcccctttccctcccatttagctgccaaaatggtatattatttagattcttctagtcagaaacgagcaatagagctggcaacaacacttgatggatccctcaacaacagaaaccttcaggtaaccgggtctacttatttatttattttaagtaatctctctgtaagagaaactaactactcttttacttctcactaaaagttttaaggggttatgtgtttgtgtgtgtgtgtgtgtgtgtgtgtgtgtgtgtgtgtgtgtgtgttcttatgtacaagtatgccaggttagttggtatatagtaaatagtttcgtgtatataacctgaaataactttacttaaaaaatatgttatgataaaattacgtgtactcaggctggagagagggctcaattcccagcacccacatggtaccctcttctggcctgcaggcatacatatagacagaacactgtataggtaataaataaataaatgttaaagaaagaaaatgaggaatgcacataacatgaaacattttaaaatgcagatacaagtgtgtgaaagaagtgtgtgtgtgtgtgtgtgtgagagagagagagagacagagacagacagacagacagacagacagacaggacctgtttttctaatcactttgtactggacatttttctgcttattggggttgtttgtgcatcaaggattgctcttttaaaaaatatatttttgtatttgagtggttttgcctgcatgtatggatatgcaccatatgtatgcttggtgttcttaaaggtctgaagagggctttggatctcctagaactcaaggtagggatagttgtgaaccaccgtgtggatgatgaaaaccaaacttgaggcctctgcaaaagcaacaactgctgagccatctctctagcctcaacattccttgatttgaatttggggtttaatgataacaggaatagattttgctatttgttgagagtagccttggctggaatagaactcactatatataacatagaccacactggccttgaactcataagggtccacttgcttatgcctcacaagtgctgggattaaacatgggccaccatgtcctggccagtatttgtcgtggctcattgcttccccaaaagaaggaaagttaatgtcctatatgcagagactggcagagactggcagagacattgtaagtttaacatttatacatagggtaaattaatgtcatttcataaggttgtgtacttgctcaaagtacccttttaaaaaacagtacttttagcctggtggtagtggtggcacacatctttaattccagaagcaggtggatgtctgagttcttcgaagtaagccagggttatacagagaaaaccaccccctccctttttgttttgttttttgttttttgttttttgtttgtttgttttctagagaaaacagtgtttctctagctttggaggctgtcctggcactcgctctgcagaccaggctggtctggaactcacagagatccgcctgcctctgcctccctagtgctggattaaaggcatgcgccaccaacacccagcacccattgcttttttaatgcctgtgtatctcatcaaatgtacatactcttgtctttgtttaattttgctataaacccccatttcaaccccatggttgaaatgtctcataagacctgttttgtgctgaattctaacatgaccttttcttttttagacttgcatggaggtattggaagccttgtgtgatggtagcctaggagactgtaaagaagctgctgaagcttatagagcaaattgtcataagcttttcccttatgctttggctttcatgccccctggatatgaagaggatatgaagatcacagttaatggagatagttctgcagaaactgaagaactggccaatgaaatttgaacatcattaaacagcaaatggaatgactttggaccatatctagtgtataatatttttgtcacgcacctgctgcattgctctaacttacacagaatgagaggagtaaatgttcttgccttcaaatagtcttttacgttttttatcctgctgaaaactatatataaaatatctaacattacaggatataggttcagtttcttaaaaattaaaagctgctaaaattgaggggtttaaaaaaaaattccatatcgtactcctaccttccccgcccatgtttttaaactaatttatataaaatctggaggctattacagctaacatagcaggtgtgtggcagaaatattactttaaatttgtcttgtgagattttactatatctcagacagcataaatgctgttttagcactggattctttcactgagcacaaagagttgttggggctttagcatctgactgattttgttacggggttgattcttgaccataggaagtatgcaatgtgaatcactatgtacagagccatctacaacagacgcttgacgttgtagagactgggacacatagctaccaagcagattatatgaaacctagaaggtgttcagtacgtgtgttgtgtttccaaaatttgctgtacatgatcagtttggtgttcttgtaccacagtttttaaccgaaggaaccagttggaacaatctcaattttaacaaaaacttgaagaactaaaataacaatgcaaatctttagcattgttttggccaaacttgttaaaactgtaatgcaagaaccaaatgcactgtgatgtggcaccaactaattagcaagcatgaatttttcacctgagagtgaaaaaaaaaaaaaaaaaagaaaatctaccatggcttgaagttaaagagcagaactcctgactaccattctatgactgatcaagagactaatagctaaaaacctcagcaggccttgttcacgatatgcagaaaaaagtgctgcagtttagatacctctggaacttttccacagtgtcacaggtttgtaatacttgaagcccttcatttctaagaatatatttcttgctcagttgtttcaggcaagcccaagactttgtaatttttaaaggtcccaagattttcatttcaataacagaccagcttctttttcctgcagttacaaatgtaatttcttttttgttgtcaaacataaggtaccaaatatgatgcaataaattgttttgaaaaacagttgtgtgaatatttccactaatccgagttgggcttctgtgaaatacacaggtggaaacagaggttgcaagccagaggcaatgaaatgcactgtagagttagtacagatgggagctttttagagtgggctaattgatggtgtcagggaagttccagaataaagtagaatgctgctcctttgttcagatttcactgagggctaggattgtggcaggtcctatgaatgtaattcataatctgaaaggaaaactaaacacgactattttgattgggaaaatgagccttaaacatgtcaaacctgtacactgagaactagcctcaggctcaatattctctttatgtttgcaaggtctgagcaattaagtttaagtaaaatgaattaagtgtatataaaattgaacttttgtagtattttagttatagatagttcatacgctaaagggaattttcagaagatcaaatccttttatttcatagtacatgatctgcattccacatcccagtctaacaggttagtgatgcaaagataatcgtagtctgaactccagtgctttgctttaacaggccctgtctcaggaacatcttaacagatggcaaaaaaaaaaaaaaaaaaaaaaaaaaaaaaaaaaaaaaaactcttcttaaaacttaaaaatttctcctatgagtggcaactgagactcttattgtatggaaaaaacactagtgcttcctctgccactaattcagtgttggaggaggcaccagccatatagtaggcgcgagcgcgcgcgcgtgtgtgtgtgtgtgtgtgtgtgtgtgtgtgtgtgtgtgtgtgtgtgtgtgtgtgtgtctgtgtgtgtgtgtgtatttgtttaagctctactgtatatcacaatgaaatccgtctatttgtcttgacaatgttcaaacaatgtagattgtcttagaaggactcagaaggactgagactctaatgcagatgccacccgagaggagctaaattcctatcatgtatattgtatttcaacccaattttactggaactattgaataaatcttttattttctttcaggtttacttgatagtgtatacattgtctggtgtcaaaggaccttgactgggttcacctaaaacattgtactgtactctctgagtatatcaactggatcatttcacatttgccccatccatattcagttaaaatccagtgatactgtgggggaaaacagggttagataaacaagttggaaaaatgcagtgtgatgttgtaatctaaacaagtgccttatgtttattgctaagaactggtgttatcaacccttttaataagaaggggttctctcggcctgtattaatataggaaagtaaagatccttttgtttttctttatatttccttattgtcatttctcattgaaaagctaaactctgactagcttagtttacttagctttaattagatagttgagtcatacattttcactattttttctgtatttattatgcacaacaataaaatgatctctaatagcatgactaaaagtagtgccgatgtcactggaaagctttctgggtcttattaggccctgcttttttcaccatgattgtactgcatgctctattgctctcggagctgtgaaatgaaaactgtgattgtatgaagagctcagagaaccatggtccagaatcaggttggttgtaacaaactcagagaaatctgttttgatcacttggtaagacttatttccattgccatgcatagcatccatttggggaaagcttaaaaaggagagtattgaatatggtacgtgtttcttttaggtaattactgtccttgaattctatagataatgaagctaagagaattcagaccaacctttctgatggacggggtcttccttttctgcctcatgcttgatttttttaattgaaagattcttaataccattttgctattgtccaagttttgctaaatcaattaagtctaagacacaaactctacgaaatagctatgtcacaccacaggaagcagaaattgtctcagtttttgctggttagaaactacaatttgtagcaataagttttgggaaaggttatttatcaagtttcacttttcccttctacagctatgaaatgcatatggaaagtcttttttagcgtgtaggaggttctggagaacgctgttatttaacaaataatgtcttacatatattctagttcatatagtaaaataactaattccatgaagacatactcatgaaaatactaaaaacaagcaaagggtgctgtgtgtgaggatgcattcctgcaaccccagcacttaggagatggagttgagggccagtgtgaaaggaaagaaagaaagcttaggggaaaggtattaagagtctagaagtctgcagtttgttagttcatgcagttagctctgaggcatcattttgggatggtagctagaagaaagagaagtttggtgtaaattggaaccccagtgttctgtgtacctaaaccagactatagcctttgtttcaaggttgcttataccaaatgtaaggatattactagcagtgctacaaaaccattctgaggcctgtcatattttttgagacagtatctcactatgtaccactgcttgcctcaaacataaaggtctgaattcctctcctgagtgccgggattaaatacatgtaccattatgcctagctatgaaggtttaagatgagtgggggtttgcacatttgtgtgaaaatgcatgttgtggaggtcaggacaacttaggaatctcaccatccacccttatgtgtgtttcagggatcaaactcaggttaccaggcttcatggcaccttaacctgctgagacatttcactggcccataagtgaggctttggtctctagttcaagaaactatttcgtgcaagatggtttgtttctacatgttggtaatctcattgtattgtaaagatgtctggctcctctgagaatgcactgtcttctcatttaggaggaacaggaagtgaggtgattttgagagtgtggtctagatcttgagttgatttcaactaatgatgcttgtcttctatgtttacatgtatatgactggcacagggaccatctgtgctgtctgtggttttccattatttggtcctgaatgaatttgccacctgtttacattgtaattggagtttttcagaacacactcaaggctacattgttcttccaaactggcttttcttaggagctctacctatcaaccctcaagtaatcatattgctgctttgtttcttttaaaatgaaaaagttgccatttaaagtagatggtaacaagactatcacctggattctggaataccaaatactcataactcttctgttagttaacttagtttttttaaaaaagtgagagtaatacacatttaagaacatgtattcagcattacttgttcagaagttcattaaaaaggacctaagaataataagccaactgcttcagttgtttttttttttttttagagttgaaaaagttttaagcacttcattttcagcttactgactagaactatgtaaatgaaatgtccagttgtatcatgaaattacgtgaccactgctttggctcaaattcctttaagtccacacacacctttaatcccagctctcgggaggcagaggcaggtggatctttgagttcgaggccagcctggtctacaaagtgagttccaggatgaccagggatgttacagaaactgtacacccccaccccccaaaaaaataactcttctgtaagtccattttaaaatttgcctttattgtatattgtgtgtgaacttggagatcaaagaacaatttgcagggatcagttctcttcactcatcatgtaggtcccaggatttagattgccaggtttggtggcaagtgcctttacccacttagtcaactctcctgtctgtaaatctataaaaatcttaaaacagccaggtggtgtggtggcacacagccttaattctagtactctggagtcagaggcaggagggtatcaatgagttctaggacagcctggttttcagagcgagttccaggagagccaggattgttacacggagaaaccctgtcttgggggaaaaaaaatttttttaaaaaattacatagggatgagaacaatgcataatagatattcaaactcttaggaagtagcaatgatggtgaacttaggtcatctgcaaaatcttaaattttctatccttttatctgtggttatagaagagtcatcttgatactatctgttggccataagaaatcatctcaaaatattacagatacatatttattgatgttatcagtatttttccacatgtaatttttgctcttttttttttttttgtcagaaatggttgtggcttactttgtagggcacaggtgctggaagtaccatctgtttaattttctccattgttgtgatactggttggcagtgaatgggttcatcttatatctttagcaggctctacttaggtactgacatgcctattagaagtgactgactgcaaaggatgccacttcaaagaatataaggcattggtgacagacatgctacatacctagacttttaatggtctagtatctttaattttctagcttctccacaccatagtcagtcaatgacagccatcagctctagtctgccagtgccttcctctatgtgattcagtccttaaaattataagcttaacactggttctgtattcaactcccaggagaaatctgaaaacacctgtgtttcccaggcccactaggaaagttgattaaaatgatctgcagctagtattaataatcagtattgacagctgcctgaccctgacctttccaagagattgtaaggtacatccaaagtttagaggcagtctcagtctaagtgtgtgtatgcctttaatcctagcactgaggactcagaagcaggtagctctcttaaactttgaggatagcctggtctacagaatgaattccaggagggcctagagtacacagagaaaccctctctctaaaaataaaaggaaaactatggaagtacagagattgtggcttctcttacactaagtaaatgaatccagaatttttgttaacagcttcctgattggtttcccatccacactgatctgatacttcaatcatgcctactatactgagatacgagtagagaacaaagaaaaagccaacctatttacttcattgaaacaactttaaattttcccaaggcacagcactttgtaagtggacgcttgagcttttaaataggtagatctagtacttcctgaaaacaactgagtctggccctttgttttccctataagattgcatttgctataaatgaaccattattacaagtgttagttgtgacaggaattttggtagagtgtttggtaaggaggttgacaggctctagagtcatcaagtaaacttacctttgggggtgtttgctcagcaccctcagatctagctagtatttttagttaataaaaggaagataacttgtcaccaagcctcatttgtgtctggggtgttttctgctggctaatagttactggacaagtaggattgatgctattccttgccattcttgggtttatgtcttttgttcctcaccttggcacacctgaaagtctacacttgccatctgtcttcacagaaggttctccattagtaggtaaatctctttgatgttgtgaatcaactgtcaagtaccagtacaaaccctctgaggtttagttccccggcagtataatggagttaggacagcttgtagatgacttagatctctcacacactgtacaaaaaattcttaggtcaaatagttggaagagttaatgtagatgggtgtttttgtcctgtttagtcccaaataaacacacagcttatattaattataaactgtttggccgatggcataggcttcttactggctagctctctcttaattattaacccataactattaatctgtgtatttccacgtggccttatcttaacaggagaatgctccggcatcctaccttcccagtagctacatgaagtctccctgactttgcctctgtccctgtttggatttcccacctggctgaatcctgcctgtcccttggccgaaacagctttattcatcaaccagtaagagaaacattcacagtaataggacattgccccatcatctttgcctctatgtgtttatttgcaactgaactgctgcaggaccaggcaggaaagaagcatccacctacaagttaacactttgattactgcagcccaatacagagtaaacacccactttaaaaaatgaagttattctcatcagtattgcaatttttattattcttgatcatcattgtctactgtggtacattgggccaatatttcaggaagtagtttattttctgatgcacttcaattttaactattaaaaattatatttgtataaaatgcaagagtatctaaaagggatggataagtaaactatactttggaaggttctgtagctaaaatgaatggattgacagaacttaattaagaattaccttccatagagctagcgagatggtttcattggtaaggccttgccatgcaagcatgaggacctgagttcacactcctgcatctacatgaaaaactggcctcctttcagtcctttcaggacttagagatggaaggatccctgggggtctgctggccagccaggctttaaatgggtgatttcctggttcagcgagagaccttgtctcaaacactaaggctagtgagatggctacaggtgaacacattagatatcaaccccgatgacctgggacctccataatgtgtgttgtgatgtgctagcccacatgtacacaaaaatgtaattaaacagataagatggatcaggtatcaccattctgcagacagaggcaggaggatctgtgattcaaggctaccctggtatacatagtgagctccaggacagtcagtacccggtctcataaaacaaatggcaataaggcagaatgtgggtgtgtggtgggacatcagttccagcacttgggactcagaagcaggcctagtcaacataacaagttccaggccagccaatgatacatagtaagagattcaaaaaaaaaaaaaaaaaaaaaaaaaaaaaaaaaaaaaatttcccccctcaaaaaaagaggctacctgacattgacctctgactccacattaacatatactatacatagatttaaacataaaggaaaaatgcaatgcaactgatacaaaatatcccaggaagaagaaggagtagggtgggggtgtcaaagtcatcacaagggaatccacagaaacaactaagctgggctcataggtgctctcaaactctggaccaacagctagggagcctacatgggacctacctaggccctctacatatatgtgacagttgtgtagcttgttctatttgtaggactcctagtagtaggatcagggcctgtccctgtggtgatactttgcttaagatctaacaaataaagcttgcctgaagatcggagtgcaaagctagccacactagttagccatagaggccagacagtggtgatacacacttttaatcccctaggagcacttaggagacagaggcagatctctgttaaatcaaggctaccctgagctacacaaaattgatccagtctaaaagagaaacagagctcaaagatgatctcagtatttgggatcccatacctttaatcccagcactagagaggaatataaggctggaggagacaggagctcagcgcagtctgaggcttggtggagacagatgcagtctggagatgcagtctgaagacaggatctcctttcaatctgagcattgttagaggtgagaactctctagtggttggctgctttgcttctctgatcttcagctttaatcccaatatctgtctctgagtttttaattattaagaataattagaattcttgcttcatgtccctaatgcaccagctggctctttggaacctattccccctactaggttgcctcacccagccttaatacaaagggaggagctcagtcctacctcaacttaattagtatgccatgctttgttgatacccataggaggcctgcccctttctgaacagaagcagaggaatggatggggggcagggcaaaggggaggggaggaggaaggggaaattgtggtcctggtgtaaaataaatgaaaatttttaattaaaagaaaagccaagaaaatattccaggaggaacaatttgtacctagttaaagaaatacacgaagaatgtgaattgtaacgagaaatgaagtttcaaccagaaagaagtctgagtagaggcttgccacaggaaatgggtagagtccagaggatgatcttgtttatctgattgcccagctccacctcccaagggccagggttcaagtgcatcaccatgcccagttttatgtggtcctttgagttggggctttgaatatgctctgtaggctctaccagttgagctacatccccagctgaataagtgtcttggattttttagtgatttttaaaaatgactatttctggtactagagataattctgtgcctcacacatgctgagcatgtgctataccattcagcctggcattgtgtcacaagtctattagtgttactgaagatggtagtgggaaaactagagcatccaaacgctgtagccaccagagggcgtgagtgaaaagcttagtggccatcccatcctattttggagaaatctcttttttcactatacaaatccactgtaggaaaaaaccagatttagtcatttataaacattgttctaagactgttgacatttttaaggcgttttcttcagcattggggatctttgtgaggcaagtgctactgagcctcatcctagctctgtgttgacattataacattttcttcacatatatttttttttatttgacattatgtggacacattaggtatactgttgttgtgtggactctgttgggtatactgtttgtttatttgagagcagatcttgctaaattcagcaggttgactttgaacttggcatcctcctgccttaccctcccaaggttcccagctatgtgccacctaacctagttgacaaacttcaacaaatttttttcttcttttaacacaatgtattgaacccatgccttttatatgccaagcatatgttctaccactgtcttggcaatgcagataggattttaaaaaaaacctttggtattttatctagttgcatattcaggagtatttccagaattggaatgcctaggcaaagcccatgtgctttttttgttgtcgttgtttttgttttgttttgttttttgtaaaaaccaccaagttgtctctcactatgtttttgtgcctggtagagcatggccccttatcattaccatcctttagactatgacaggccataccaaagtgtcagatttcttcatgaaatctgaagtcattcttggatgactccggcccttgctttgacagttttgccgccatgacaggctacagaaaagaccccacaagatgtagccctgaatcaacaggatgtgctgtgcccctgaccttacctgaccttgccctagataatgggaaaaaatacaagatatcccccatgtggtaaagagccagtcagaggctaggctaacaggctctggacccgatttactgataaggatagaatgtagtaaccacagcaaccgccaccagatgccgctttagttaaccagtcaccttagaataggtacccccagtctggagatgtgccaatcctgagacagttaccatgcagcttacaggccccaagatcccccttgctctatccctaataaatgtcctgcatgactgtggctcaatgtctctctcctgcttcaccactttattggaaggacaagagacctgagttcaaactcgcaattaaaaagactctttgcttttgcatcggatctggtctcttggtggttttggggggtggggtccaaactctgagcacaacaatcctgtcaaattttgcaccttactttcctctataaattccatttatttggctatatatggtggagcatgactttaattccagcattagggagacagaggcaggaggatctcttggagttcaaggccaacctgatctaaagagggagttccaagatagtcagaactccatagaggctctgtctaaaaaaaaaaaaaaaaattcatttatttgtttgtgacatggtcagggtctggctatatatctgaggttgggctgaaagtatgtagcccatgctttatttgggagctggttggtggccaaaagaaaatgccaactacagttatcttcctgccttagtatcctaagtgctgagattaaggcatgcactaccatatccagatctacatttccacagaatttaaattggatccaaacctcaagacaaaatgttcaaactgcccaggatgtaataccaaattactgagcacacaaagaatgaggaaaatctcagttctcctagaaacaatgatgccaacactgaatgcagatggcagagttatctgatgaagtgttaaccacttaatgaaggttaatcctcactgttctctcaagtctgcagattcaggcaaagggatcatctggtaggtggggctacaagatgagaagaatgctggggagaggaggcagaaagaagctgccagggagacacaccatgtagtcgctaaaggaatagcatgctggagcctttttggtaaaataagacaatgtagaaatacatagatttgtagttatgggttaataattaagggagagctagccaataagaagcctgagccattgaccaaaaattttatagctaatataagtctttgtgtgtttgtttggggcaaagtggctgtgggaccaggtgggacaagaaactccatgtacaaaatagcacccaatgtgaggcctgaacccacatccctgagattaacagtctcatgctctactgaccgaagcctgagccagtggccaacagtttataattaatagacaactctgtgtgttcatttggggctaaacagctgtgggaccagatgggaaagaaactccatcaacaaagcattatttatgattcattaaagcttgcctgaagattcagaaagcaaagccagccacaggccatagaagccaggcacatacctttaatcccagcatcgagaagctaggaggtagtggtacacacctttaatcctagaactgaggattaagaggtacgcagatctctgtgagtacaaggccacccagatctgcacaagattgaatcagtcgaaaagagaattataatttgcacctttaatcccagcactagagtggtctaaaagccaggagcaggaagtcatgatgaggcatttgttctccagccacactaaggagaagcagcagtttgagacttggtgaagaggtcgtgtgtggatcagccctttcagtctgagctaaaggtgagagctagtgaccagctgctttgcttttctgataatcagcttaaaattttaataaatcatttatattactacaactatcactctccacgataaagatgtgcagatttgtctgccacttatgaacagtttcctgcagagccattgtcctgtaaagtcactacttacttaaggcaggtatcaccagggtctcaaagcatccatgccgggaatggggcatacatgctgatactctgcctctgatgataggtgccctttctttctcacccaagagtctcatgtctcctgttcattactggcactcaaacttgttaacttacaaagttaatagatcagagttcttgactctaaaaattctacatgtaaccactagcattgcataggtcacgcaggccttgaactcacaatctttctgtcccagccttctcagagctgggattataggcatatgttattatactcgacttcagtagcattttgaagccattggaaaaatccagccaggcatagtgctgccatctgtagccctagttctcagtgggctgagacaggattcccacaaattcagagctatttaggggcatattgtgagttctaggccagcttcagctacaatatgagactttttttggtgggggatgagaagatgacttagtgtttagagtgtttgcagagcaagtaagaggctccgaatttggatccccagaacctagagcaatgctgagcaggtatggcagctctcctgtagatcctactttggaagattgagacaagggatctccagagcaagctagataccaagaggcctgaaaatcaagggttgtagcatgcgcccaaagattaactgtaatccgtgatggtaaagtttctttattcaagaaagcaccagggcaaaacgcaggccggagtgaggttataaggacccagcaagcgcggccagaaagagggggctagggtctccacgtgcagtctttaagaagcttccctatgtcaccttggctttccttcaccacgcccttatggcgagtcccgggtctgcctggtacctgtcccaggactattgggcggggctagggtgtctccctacaatttcccttttagtctaaaagaggattaaaacttaatagtgtaaaatatccaaaactaacaatcataaaggtgaaatacaagaagatacaacaatctgctatgacacatcctatgtctattccagctaagttttaaaatcatgtggaaaaggtgtttaacttgaacacctccttccaatcccaactctaaacaataagaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggactcaaacataagtgtcatcagagaagtgttcgcttgttcatgtatgtgtactgggaaaggaaatccttgaaaaacaacaattatgagagggtgtaggccttgaaagaaaaagccaagaaaagacaaagatagtcttcttattcttcatttattctgtattacagcaattggcttcttgatataacacagaaacttttaaatgttgttaaataacatgcttggattttagagtaggaaagccaaatccaactctaaatcccacatcgatttaattgaatagggactaggaaatgaagagacatagagttatttgagagacagctgtaaattttgtaaattttgtaaattttatggcatgttccttttgttcgatggttatagctacattctttccttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatcttgatcaattttgatggtatccaaagattttcttttcctgtggagacaaatacaaaacccctaccccaacgtaactcatgtccaggtttccataccgaggtcagcacatctttgaaatacactggttggttcagttcagcagttttttccgtagtccagtgtctttccgcagctataaagcattatgcaatctatgtttcgggggtttcgacttaccagcttgcctatggagcatctccttaagtgtcctgttagacctttcaacgactgcttgtcttgtagggttgtgtggtatacctgtgacatgcttaatgttataatatttgaagaactgttccatttttgtggagacatatgctggagcattgtcagtttttatctgcgccagtatacccataactgccatcacctccagaaggtgtgtaataatggaatcagcttttttagagttgagagcagtagcccattggaaacctgagaatgtgtcaatggtatgtatgatgcacatatttcaaatttccaaattctgtaaagtgaaagatatccattcctgcgttatctttttttcagcctgtcatggctgtagaattgtcaaagcaagggcctgggtgagggcctgagtcattcaaggatgacttcagatttcatgaagaaacactttggtatggcctgaaatagtctaaaggatggcaatgataaggaaccctgttctaccagacacaaaaacatagtgagacacaatttgatggtttttacaaaaaaacaaaacaaaaaaagcacatggtttttgcctaggcattccaattctggaaatactcctgaatatgcaactagataaaataccaaaggttttttttttaaaaatcctatctgcattgccaagacagtggtagaacatatgcttggcatataaaaggcatgggttcaatacattgtgttaaaagaagaaaaaaatttgttgaagtttgtcaactaggttaggtggcacatagctgggaaccttgggagggtaaggcaggaggatgccaagttcaaagtcaacctgctgaatttagcaagatctgctctcaaataaacaaacagtatacccaacagtgtccacataataacagtatacctaatatgtctccataatgtcactttgagttcagagtttgactaagagatcctgcctcaggctgggttgatggctcagaggttaagagcactggctgctcttccagaggttctgagttcaattcccagcaaccacaaggtggctcataaccatctataaggagatcaggtgccctcttctggcctgcaggcatacatgcagacagaacactaaaataaataaataaataaataaataaataaataaataaatagagctttaaaaaattgcctcagagagtaaggtgagaaagagtaggcatgcatgtgcccactgcctatgcaaacatgtatcacatacccaccacatacatacacatgaactggagtaaaaagggaagaattgaatgagtcaccaaagtggcaaagaagtgaatatgtgaagaaaaaacatttgtttcgttttttttttttgttttttttatggcagcatctgtttggacctggatgtcttggaactctatgtagatgagaagactgtcaaaattcaagaaatcctcctgcctctgcttcccaaattctggcattaaaggcctgtgccacctggtccagtccaaaccaatatttttgttttgttttgttttgttttaagaagaaacaaatttagctgggcatggtaatgcacatttttcatcccagcctgggaggtagagacaggagtttctctgggagtttgaagctaacctggtctatgcagagtgccaggacagccaggactacacagagaaagaccttgtttaaaaaaaaaaaagtaattttattgatttattcttgtttgcattgtttatcctctgtgtgggaggtttttgttttcaagataggatatctctgaatctgtgtttatttttccaatacagactttctccttatagcccttcctgcaacttgctgtagacaaggctagcgtccaaactcaagagatccacctgctgggattaaaggtgcatgccactaggcttgatgaggtagaatctcttatagccaaagctgccctgtactttacaaaatttcccccatataattttaggcccattttattagtttcaagcaagtttattctttctactaaattcagcctttcattaggtaattcctttctactactactatttttttttaagatttatttattgagtatacaatgttctgcctatgtgtatacttgcaggcccaggagggcactagatctcattacagatgattgtgagccaccatgtggttactgggaattgaactcaggacccttggaagaacaggcagtgctcttaacctctgaaccatctctccaaccccctttctacttctagtaacctgtttttctgccaccacgacaagctagattgtcaactctttgactacacctgtttgtttgtttgtttgttttgttttatgatgctgggatttgaaactgggcttcgtgtatgcaaggaaagcactctaccaaatgaactacatccataacctgcttgttttttgaagacagggtctctatagtggtggacatgggttcaagcaaatagaaagtctttatttgggacccgagtacagtcccaagcctttctcaaggtgagtttttaatcacagaagaaagaaaaaaaaaatcctaggttgacatactttacaagaacagttagccgaactacagtagccgaaaagcaaggttactacattagagaatttcccagaactatggatgttgatggattaggtctttgttttctctctcttcctccctccctccctctgtctttcttttttggcagatattgctgcctaagtgctgggctccaaggcttgagtgatacttctatcatactgtcaactgtgctaaggtgcgagggcctactgagctcggcggggggtgggggggtttgttaaggtcttggctgtcctggagcttgcaatgtagcccaggctggccttgaattcatagagattctactgcctctgcctttcaagtgcaggattaaaatctaggctcccaaccctgaggactccggacttcacatccttcttctgcctccgctgaaactagcaggccttctaaccgtgggttaccacgcccagctgcgtaaagaatttggatttcccaagagtcccacagagatatctacgggatccgggatatttaaagcaagcaaggcttgggtgccaagatccgaggttactaccgcggcgccgggaaaggctcgggcccaggggctgagcagcctcgcactctgctgcccgcgcggagtctggaggaggcggtgagcgtgggtaatgcgccggcccggctgctccctcccagctgctggcactggccagtggcctttgccactgcacagtcgcctctcgcgagacagggtccgggccgcacctccttcctctctgccgactctctccccgcccctgaggagctgcgccgcttcctcctgagccggggaacattggacgtggcggggccggtccgagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccgggaaccctgtcgcggaggaggcgccattcccgaggcttttctcctccgcatcagctcggagagagtcgggaggatggcttcggagatggagtcgtctctggaggtcagcttctcgtccagctgtgcggtgtcaggggcgtccgggtgtctgcctcccgcccgctcccgcatcttcaagatcatcgtgataggagactcgaacgtgggcaagacatgcctgacttaccgcttctgcgccggccgcttccccgaccgcaccgaggccacgatcggggtggacttccgagagcgagccgtggagatcgatggcgagcgcatcaaggtgagccgatggcgggggtgggttgggggctgtcactgcggagggctttgcaggtatctggaccgcaccgtggctctgtgcaggagtgtgcgccctgtgtgctgccacgctggcgtgcaaagtgcgtttgtaagtagcaaacttctgaggcactgttcccacactcctaacgtgcatcagttttacctggggcatcttgtttttcaaaaaagcacgtatgatttggtaagctcccaaatgacgcacatgcaacgagtctgtggaccacactttgggtgtcaatagtgtaggggagagccattaattccccacccccattacctgagttaagtgctgggaaatattttcaagcatagaaaactcagttatttctaagaattcatttgaacattgcatcattgctaagtattgtggaaataaagcctgttgagtttgaggcagtttctgtatgataatcaatttgtttaggaaaaaaatctatattttcctattgaagcattatatatgttatggttcttaagtgagttgccaaaatcatatctcttgatgcaagcacagaccctctcccaggtggcttctaagacatcagacactgtagtcatagtaggataggccgagacagccaggactgggattctgaagggttgagctcctgggactgcagaataaggatccttgtcaagtcaggaaccttccgatggtgtaaaccttgacactctattgcaaaaccactaagtttacttaatagaaatccttaaaacctgtgaagtggggttggaggactgcagtgagaccccatctcaaaatatgaaaacaaatcaaaacctgcacaagaaacctaagaactccgctgacttccttagcaactgcttttactttgctttacattgggtcctctacctcagtctacttggaagagctttgatttgctcctcctaccttctatccttgaggcaccgagtttctttctttctttctttctttctttctttctttctttctttcttcctttctttcctcctttccttccttccttccttctttctttcttcctttctttgtttctttttttgtctgtttgatttttgagacagggtttctctgtgtagttttggagcctgtcctacaactcactctgtagaccaggctggcctcaaactcacagagatcttcctgcctttgcctcccaggagttctgggattcaagacatgagccaccaacaaatggccaaagtttctatttctttgctcaccacccctccctgccctcaaagagcttttaccccttgtaaagaaatgggggagttatctgagtcaagagaccaccttctctaggccccttggcttttccatgtccatttatttttaagtgtgtgtgtgcacatgtgtgcataagtgtgtgtatgtgggtggggctaagtctagactatatgttcatgccagtcttctgaagttgctctctgccttacatttttgaggcagtctcccaatgaatctggagctcactgattctaatgagacctatctgactaacaagcctcagggatcctcctgagtctgcctccctaggtctgggattgcaggtgctgaggtccaaatttagtttgacaagtgctttcttaatttttatttttatttttttgggatagggtttctctgtgtagttttagagactgtcctggaactcactctgtagaccaggttggcctggaattcacagagatccacctgcctctgcctccagagagctgggattaaaggtgtgtggcactactgccacaaccacccagcagcaagtatttccttgactggacggatcatcttgttcaggctgccagtactggtcatttgggtacactgtagtataaagtaaagggagatttatgagactaaggtatgattcagtggtagggtgcttactagcatatgcagggccaggtgttttatccttagtgggagctgaggaaggagatttgtatacatggcaagaagagctagatgagtagaaggtgatttttttttttttttttaagcaaaactaggttagagatggaagttggtggcaggagaaaagattgaggcttccggtgtgtgcatgtttagcctggggtaagcagttgtggggaagttgctcaggcttaggagcccaactcacacaggtacaagtgtgagctgctgaaaagctttgggttgtggggtagcttgaatttgtctcctgagttcacgtgttggaaacttaatttccaagtccataaattaatgagacttggagatgggacatttgggaggtgattgggtcctttggacttatgaatgggttaatcccttcgtagattaattaatctaatcttttgatggggcaagggattagttcattcataaattagtggattaatctcatttatggattaaagggttattgggagtggcttgtccacttataaaactgtgaaccaaataaaagcctctattctcctgattagtcagccttggaaagttttgttatagcaacagaaaacagaccaatgtatagggctgtcaggctttttgcttttctgtttttttttattatattttttgtatttatctatttaattttgagtcttttttaaattaaaatttatttatatttcttgtgcattagtgtttgcctatatgtatgactaaactgggtgctgccatgtgggtgctgggaattgaacctgggtcatgtagaagggcagccagtgctctttttgtttgtttgtttcaagacagggtttctggatgaaggctctagcatggcatttaaggcagtcttcaatttgattatcagagaacggtatttaaggtagtctcttactattgcttagattcttagttgtggtcatccttgtggatccctgggaatttccctagtgccatgtttttcattaagcccataatggctccctctattaatgtaattctttccttgctctccttctctgttctccccccaactcgacctttctgatccctcatgttctccttcccccctccccttctcccctcctttttctccttcctctgtccctctttcccccatgctcccaatttactcaggaaatcttctccctttccccttctcagggactccatgtatgtctctcttagggtcctccttgttcatccagtaactaatggaagcagaaacagagatccacagctaagcattgagccaaactcctggaatgcagttgtagagagggaggaatgatgagcaaaggggtcaagaccatgctggggaaacccacagagacagctgacctgagcaagtgggagttcatggactccagactgacacctggggaaccttcgtgagacagaaccaggcccccctgaacgtgggtgtcagttggggggcttggacagtctatggggctgctggcagtggaacctgtatttatccctagtgcatgaatgggcttttggaacccattccctatggagggatactctgttagcctagatacagggtggggagggcctaggtcctgccccaaatgatgtgacagactttgatgatccaccatgggaggcctcaccctccctggggagtggatgggcatgctgtgcatggaatgggaagatgggggagggagaatgggaggacagtaggagaggattagtatataaaataagattgtctttaatttatacttttggttgtgagcctaacctttaatggctgagccatctctccagccctgttttttgtttttttgtttttgtttttttttttggttttccgagacagagtttctctgtgtggctttggagcctatcctggcactcgctctgaagaccaggctggcctcgaactcacagagatccgcctgcctctgcctcccaagtgctgggattaaaggcatgcgccaccaatgccttgctccagccctgtttttaatttaaattaaaaaattaaaaagaaaaaagacaaagtttctctgtgtaacagcctggctgtcctcgaactcgatttgtagaccaggctggcctcctgagtgctgggattaaaggcatgtaccatcagccagtgctcttaacccctgagccatctccacccctgagacagtctttctatgtagccctaactgtcctggaaacctctatgcagaccagggtggcctctaactcacctacattcacctgcctttgcctttaatcccagcacttgggaggcagaggtagacagatctctgaattcttgcctagcctggtcacatagtgcagtggctctttttgtttgttttattttgtcttttgagacagggtttctctgtgtagcagtcctggctgttttggaacttgctttgtagaccaggctgaccttgaacttactatgatgtgtctgcctctgtctcccaagtgctgggatcaaaggcatgcaccactgctgcagtggttgttaacctgtgggttgcaacccctttggggaggggtgttgaatgaccctttcacagtcacaagactatcagaaaacacagatatttacattatgatcactaacagtagcagaattacagttatgaagtagcaatgaaaaacatttgtggttggggttcaccacaacatgaagaactgtattaaagggttgcagcattaggaaggttgggaaccactaacatagtgagtttcagaaaaaagaaaattcacaggtatgaggaatagtcttttacacctaggatctgtttaattcagtcattggctcagaataaagaatgtactttcttttatgaaaaaaaaatctcacaaagttatggagccaggggtgggtgtggtagtggccatctttaatcctaacactcaggaggcagaggcaagcagatccgaggttgaggtcaacctggtctaaatggcaagttctaggacagtcagggaacagtgagaccctgtctcaaatgcctacctgcacgagagtgcgtgcgcacacacatgtacacacatacacacaccctctccatcttgtccacctgttcagtgaatctgatagatcaccttagtctcatctgctagagaagtatgtattggttgtggtggcgttggtgttagggctccaaaccatacctgttaggtgagtgctctaccacttctacaactaagctacacccctggcacttaaaaatattttttatattatgtgtattggtgcttcctgcatgtatgtctgtgtactgtgtgtatgcagtgcctacagtggcattgggttcttctggaactggaattacagatgattttaagccaccatgtaggtgctaggaatacaatcctggtctttggggagagcagccagtgttcttaacctctgagccatcactatagccttctatgccttttttaaaaaagggtctcatgtacccaaaggtgacttcaaagtctatataatcaaggataacttcgaactctgaatttgtatgtgtgtgtgtgtgtgtgtgtgtgtgtgtgtgtgtgtgtcccaactaaaaccctacctatcacataccctttctgctcctggggacctggatggtgaggccttccatagggtgtcatcagagtctgtcatatcctttgggatagggcctaggcctacccccatgtgtcttggctcagggagtattcctctatatggaatggactcccaaagtccccacctatgctagggataagtactgaacttctacaggaggtcctgtagatttctgaggtttcctcaatgaaatccaagttcctggggtctggatcagtcccatgctggtatcccagctatcagtctggggagcaagagttccccaatgtccaggtcagttgtttctgtgggtttcaccagcctggtctggacacctttgctcttcacttgtccttctctgcatctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgctatcaatttgctcaggggatcttgaccctttccccttctccaggggaccatgtatgtctctcttagggtcctccttgtttactagtgtctctggcagtggggattgtaggctgataatcctttactctatgtctataatccacatatgagtgagtgcatatcatgtttgtctttttgtgattgggttacctcgctcagaatgcaattcttctgcaaatttcaagattccattgtgtaaatgtaccacattttctctatccattcttcagttgaggggcatctaggctgcttccagtttctggctattacaaatagtgctgctatgaacatcgttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatttatcaattgttgatctcagtgtctgtgctactggtgtcctctggcttgaggacagagtcctccctccatgagaatgaatttggtattatagttttatacttaaagttattggcttcagaaacttgcatgaatttacccacaaatgaggcagaattcttccctatttactatcaaaaaagaatcagctgcgcactttttgttgaacaatcttctttcatatatatatatatggattgtttgtcaaagatcaggtgtttgtaggtgtgtgggttaatatcagggttttcaactctattccattggtctacctgtctatttttgtgccaataccaagctgttttcaggactatagttctgtaatagagcttgaagtcagggatggtgatgcctccagaagttcctttattgtacagggttgttttggccatcctgggtcttttgtttctccatataaagttgataattgtgctttcaagatctgtgaagaattgtgaaggattttgatggggattgcattgaatctgtagattgcttttggcaagattgccatttttactatgttgatcctacctatccaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatttctccaagacctttatcatgaaggggtgttggattttgtcgaaggctttttcggcatctagtgagatgatcatgtgttttgttttttttttcctcagtctgtttatatggtggattacattgatggatttttttatgttgagccatctttgcatccctgggatgaagcctacttgatcatagtggatgatttctctgatgtgttcttagattcgatttgctagtattttattgagaatttttgcatcaatgttcatgagggatattcatctgtagttctctttcttagttgtgttttttgtgtggattgggtatcaaggttattgaagcctcataaaaagagtttggcaatgacccttctgcttctattgtgtggaatactttaaggagaattggtattagctgttccttgaatttctggtagaattctgcactgaagccatctggccctgggctttttttttgttgggagacttgtttggtaaggttggataaaggtttgtctatgtgtgctggatcctgctgtggagatcgaatccggtgggcaaatccctggggtcagatgtctctgagcagggccaccaaaccacatgccttcaatcttagcactcctgaagcagagatagatagatgtatgtgagttataggcctgccagagctgcataatttgaagttgagccaggaggatggccttaaattcaaggctagcctgactacttaatgaattgtctcaaataaccaaaaaaactgagccagacatgataacacacctttaattccagcactcacagatctatccaaaaagggctcctcagactatgcagctaggcagttgaactgtgtatcaatggctaccaagccttaaaaaatagtcttcctttttaattccaggacagccagggctacatagtgaaatcgtctaaacatacgcaatacaaaagaaaacaaaactacagaaagtctgtacttgctaattgatttctgagtgctgaatacatacgcttgaaagagggaaatcttgttcacagaattttggcaactgaattaaaatgaattccttaaataaaaatacatttgactttcaaattgactgtcttaatccatatgtttcctccttggctgtttagctgtgttcctctctcaacagacattttgtcctggcaggtgcttcagtaaagcctgatatgttgagatttaatccagtctttcatccagggatcagcagtcactatttaaatatgtcagttgtttatagtgggagaagagagattttgccatgttaaaaatgagatgttaatattaactaaggagaaacaactgagatatttcctccccataaatcaaatatatgaagcataaagaatgctattacattgtaaggagtaggaaactgacagtcaagtgctctacttttgtttttatgtggcatgccatctaagaatgagttttgtattattttctgtgctggggttgaactcagggcttcttcattacatgctacacagccagtactcttatcactaagctatacccccagccgtgtttttgtatggttggagaaaatgaaaatgatataaaattcagaatctaccaggtcatcctgatgtaatctttaacttttactccctaaatccaactggcttcctactgcagtttttcctattactcctctcattaaaattctagctgcaatatttcttttaagcctccctttgaggtgatggagcactagtgtgtctggcatgttcaggacaatgaatttcatcctcagtactgggaaaaacttcagacctgactttgaacttttagcagctcagttgatcttatttaggaacagttaacacaagccttcctttgtcgggtgcctgctgcctcttccttcagtcatcctgtagttgagccaagttattggctggtttctcactgtttgcttggaatatccctcctgcctgtattttcctgaaagagtttcaacttctctttagaatcccagccattctgctttcttctatgggaaccccttagcactcctatcaaacatgaccatcttactgtgttatgcatctctctttcctgttagggcaggatctggatctggtaatgcctgcagtattgggttaaagctcaggacctaagtgttcagttatgcaaacaggtcagttgacaaagtgacaaagaaagctaatgaaaacacaggtgacaaagcacaaaatactaggtgactgttgaagctaaagccaaaggtttcagtatctgtcttttgttgatgaagggcgcccacctaggcaagtcatggtaactggaggtgacaactccagaacagaggtcatgagagttaggtggaacatcaacctttaggattttaaagaaaggtttggtttatttttattttatgtgtatgagtgagtatgcatcatatgtgtgcctggtgtccaccaaggggctggaagaggatgttgggttcccagaactgagggctaggtggatggtccaatggctagaggcacttgacaccctgcatcccacaagtgttagtggagagccaacctctgagtcgacctgacctgcctgtgctcatcatggcatgtatgcacctttatacatgcatgtgtgtgcatacaggataaaaattaaaaaccacttactcagtacatttgactcggtgttggcctctgatagctccagcctacaaatattctgagtgttttgtaacctttccccctctattttctttaaaaaactaaacaaaacaaagcattatttttaagactgtacttttcagattttataatctatatttaatagccacatgatgactagactagaatcatgaagtctagactccgcaggtaacacagaaaagacaagctcataagtggcaaggtattagggagcaggtagaggtggttaagttgcttgtgtcactggactgaacttgttgactttgcttcctgtttcccaccctccagatccagttgtgggacacagcaggacaagagcggttcaggaagagcatggttcagcactactatagaaatgtgcatgctgtcgtctttgtgtatgacatgaccaacatggccagcttccacagcctgccatcttggatagaggaatgcaaacaacacttgctggcaaatgacatacctcgaattctggttggaaataaatgtgacttgagaagcgccattcaggtgcccacagacttggcacaaaagtttgctgacacacacagtatgcctttgtttgagacctctgctaaaaaccccaatgataatgaccacgtagaagctatatttatgacattggctcataagctgaagagccacaagccactgatgctcagccaaccgcctgataacagaataaacctgaaacctgaaacaaagcctgcagtgccgtgctggtgctaagtcacaggtatgcccgttatgggactgactgagtctgaagggacacttctgagtaagtgtaattaagtttgtaagattaatcttaaatataatggatcatcccactgttagcgttgttgctctgccttttgtattttgcattctcttaataagtttgtcattgtgacaacacaaagaaaaggtcagtttacagctgggatggaaaatgaagcaaagatggatgagccaggccatatttccagtgccagccaggtgaagcaggcctcctgtgagcatgatacaacttaaaggcgtggtcttggttccactccatgtccctggactgtgaaagaaattcgtgtaggccacatttactgagcagagctaaaggcaagtgacgagttaataaggtgcttttaatttactgtggcatccaagcactaaaaaactaatcaaaagaacccaaacacttggagtttgttttagccacgacttttaattgaaatgtcaaagcaggttcctggtgtcccttgccctctgctcctatcagttgggagattcagggctgattctgtcagtatctgtttggctgagagctctgagggcctgcctcaagttgctgagtctacatgtattcctgtaatagtattgttgggtcaggtttttttttttttttttttaatgtctgaattttatggccacaaactgttcttatataaaaaatgagttaaatattgaaaattatgtgtccctcactggtgaaaggaattttgtttgtttgtttgtttgttttttgagacagggtttctctgtattgctttggagcctgtcctagaactctgtagaccaggctggccttgaactcacagagatccgcctgcctctgcctcctgagtactgggattaaaggcatgcaccaccaatgtctgccgaaagaaatagttttgaaaaatttttgttttgccctgaatacttttagtttgaatttaagactttgcacaaagcaagtagcacattctgttgtttgcagaatggagtgtaaatcatgttcggcctcattctgacagcttacagccctgggcaattttaggggaaattaagccaaaatagactttacttaaatattttcagaatgtaggaaacaaaggcactcagacctagtttcagatttttgtttcattattctgaatgtctcaattggaaacttcagttacaaaagcaagtttattttacttaataaattactaagtgaaagtaagacttttaagaaatggttgtacaattttaaatattagggcccaggttggctttatttgcactgagagagatttttctttttcttttttaaaatagggtggtctcactttgtaggcctgattggcctgggaccagggcagcctcagaccacctgcctcatccgccaactgctggggattaaaggcttgtaccatcagaactagcctattacatgtttcttaatcatgctagaattaaagattaaaaattgtcttacctaaattaatgctgactcgtgagctatttttctagtgaaacatggctgtagtagctggtggctgtagaagtttttacagaagggaatctgttcattgtttttcacactgtacaactggggaaagagcaggtaggatttcccaacacatctgtgctttccttctgtactgtcctcagtgttttttttttgttttaaagtaacagactgtttctttttgtaaggagttaatgagcattctttacaattctgagaaaagtctcatttcttccctttagtatttattaatttaaacatttgtatcttagttgtaacaacctatcactttagtagtttctttttttaaaaagatacttatctggagagcaagattctgcctttagatgtattccaaagtgtttgtgaaacacttgattgactgttgacaccacttccaaaatgatggtgagctgtagttattaattttttaagcacaaatcaatattttgtacctctgtgaatttattttatctgacatttaattggaagtatcatattttaaaaaaatcttaatttgagaacccaaagcaaactactttagaatctgttgtgtttggctacagactgcttgattgtattgctctttcatgtttcttcaacaagttcagtagttttgctatatgaaactcttacatttctcctatgaagtaaaataaatcatctttgccatgaagaaatcgtgttctgtttcctttgttttctgtgttgaatatgaaattgaagaacatacctcctctctgtctgctgtagtttttagaaaatatatatagcctacatttccttaatttgaaaatacaaaatctggtatttatttcatttagaaactttcagattttggattgggattttttagattgggtattctgaactgatgaagttgatgtagataactaaaaacaaatccaaagtgtaaaacataagggggttcttgtaatgataactcttcaccagcctcctgaattctgccatcacgttagggccccaaaataacacagagagtcttatattaattacaatactgctggccaacaactagtatttcttatttgctagcccagtcttaattatcaaccataactactaatctatatattttataaagacttatcgaggacgccggccttatgcatcctgttttcctgggatcacatggcaactcctgtccttactacatttcccagaatcctcctcaactcctagccccacctaacttgctttcttattggccaacagtgctttatttatcaaccaataagacaaacatatacacaaaaggacttctcccatcaggttctcaagaatacttggtgcagacagaccaagctctaaaaatggctggtatgtttttagcagagtgaacaattacttgagatggagaaagaagagtttgtctcaggcacaagactaacctggaccccttggagagtgcagtggtggcttttcagtggatactgcttcctgctggtcagctgcattaagttactcttgtgtttgaatgctggactgcatccagagacagctgtcttcatcagttactgggttcatcagttggccacatccttcagacacgtatatgcaggtgtctgcagcccagaagacagggtcagatcacctggagctgtagttatagatgcctcaggcacccagcatggttacgggggacttaacttcttggtcatcaattggccatgtccttctagatttgctagaactagcatatgctaatttacttggtgtactgaactaatcttatctatccattgtttaccaaattccagctatgtgttctccagtggtggtaggctgtggagttacatgaacaaataggatggtctttgaagagtttaaaatgtacataagggactagggagatggctcagtggttaagagtgctgggtgtctcacaaccacctttaactacagctccaggtgatatgataccttctgggctccacaggcacttgcatacacatggcatacacacacacacacacacacacacacacacacacacaataataggtaagtgcatggatgtcacacttaggaacaaatcaagcttcctcttgtaatagtttgaccaagagaaagcacaaatatgaattccccatttctctcctggtgtcttccatctgtagttggtggtttctgacctgtctgtagcccttgtgttgtgtgtctgatctatccccattgcctgccctgtgtttcctgtgtgttaaacctgtcctagcaaagggctttgttctgtatttattgaccagcacaggaagcatagtatggggaagaaatgagggtttctttacagaactcttcaacaggtttacatgggaagaaaccactgacctcagctgacccacaagaacactcaaaacctcacacatgttatcaaccgatatcacttgcttctaacatttatggtgatattcgttttgtttaaggttactttctttttttttttttttaagatttatttatttatcatgtatacagtgcaggccagaagagggcaccagatccctttacagatggttgttagccaccaagtggttgctgggaattgaacgcaggacctctggaagaacagtcagtgctcttaacccctgagccatctctctagcccttaaggttactttcaacccactggctactttcagtaaacacacacacacacacacacacacacacacacacacacacacacacacactctactctggttcatggaagagtacataatttttaagagtaaagctaggttgctaggttgtaaaagctgattgcatggaaaatccaaagcatattaagagtggttacattgtgttggagcactggctgctcttgcagagattctgaggcagaggcacctgcctctgcctcgaaagtaccaggattaaaggtgtgcaccaccactgcctggcaaagcacatagtcttaaatggcctccaggtatattattaacttggcttccaagcaaccacatggcagcccttggcagataataagatctggtgccctctttgagtgtgtagtcagaatactgtgtacataataaataaacaaatcttaagaaaaaaagattggttacattgttttcttaaaggcagattaaacaggctaagcacacagtaggacagcaggtgaagcacatagtcgttttatttatttattttttcaagacaagatttctctgtgtaaaagcccttgctgtcctagagcttgctttgtagaccaggctggccttgaaccacagagatgcacctgcctctgccttgaaagtaccaggattaaaggtgtgcccaccactgcctggcaaagcacatagtcttaaatggcctccaggtatattattaacttggcttccaagtctaataaaagttcagtctctttgaaggcaagagatattttcagaaaacatcttgaaataggtaagtaggactgccatcacagtgaggtaagtgtgattgattggataagcatataccagagggcggtatacagagtggagtagtgtgaagcattctgaggcccgcatgaagtattttctaaggggaagaagcacccagatgatggctcgaggagttggattttgtgcagtggtccaggactgttgggtacaggtatcaaacaatctaaaccaggccctgatatagttggcagaatgcttgcctaatgtgctcagagccctgggttggagtgccagcactctggaatcccacttctctggcggtaggagcaggaagatcaggagttcagtgttatggttggcaacttagtgagttcaatgccaacctagactacaagagagcctacctaaaaaacaaaaattacaaagggaaaaaaagtgaaaagcatttcagaaggagtttgtaggaatatgagtcctccccttggactcacagggaagttgaggttgaccttgactttctgactgagattcacactgaatgttctccatttttctggctcagtagagaggaaattgtggtcactgaccatttctgatgctggatactgcaactatgtagacagaaataaactgtcaagcagtttctagaatggactgttgatcagcctggccaatcagatgcttgcccatgcctatcatcttaagatgaaaaaataaataaacaaataaggcagcattcacatttcaggagagaaggaatttggggttaagggagtaagaaaaggagtagttgtgacaacctcacaaaccatttgagctttactgtaaatgggtaataaatgagaccgtttagcagggtagggacgtggtcatgtgtatgctgggaattctgtggcaatgaagggtatgtggaaatgaggtcatggtgacaattgacttactgtaatagcctagaagacaaagctccaactgagacactggcagaatgcactgtacacctataatcctggcactagggagatggaggcaggaggatcagaatttaaaggtcattctcgcctacacagtgagctgagaccagcctgggttgcgattctgtctcaaaactgaatgagtgaatgaatgattaataaaaatctagaaggttagccagacattggtggcatatgcctttattcacagcactcgggaggcagaggcaggctgatctctgtgagttcgagaccagcctggtctacaagagctagttccaggacagcctccaaagccacatagaaaccctgtctcgaaaaacgaaaaacaaaacaaaaccaaaatctagaaggttgatagtactgtgccacggtatgccacttgcctaggatgcttgaagtcctaggttcaataccctgtgcccaacacaataaatacataaaataaaaaggacaggacttagaggatttggggtagctttcataatcattaggtggacccaggaaagaagtagatgtgacaaacacaagaacagcagcatccaagagaatattcacttgtcactactgctctcctcagcaccggtgacatctagggcctgtcatcaacatgtccccagagttgctgccaagtactaaagcctttaacattgtgctgcccaagagatccattcgcctgttaccatgtccctgcctgcataccctcacagttgacctataatttattgtattgaatatcatgagcacagaccagcagacgcgtgtatctgtgtagagaaaaatcgctattttaatatttgggattattgttttacttattttagagtgttgagggcagaagcccatgccttgctcgtggtaggcagactttcagcctcattcaccttcacccccctggccagcatacctgccaacatatttacatgactctctgtccacatttctagttcttccatctaaatatgtcaatatttgtcaagctggacacattttgctaaggaatcatgcgtgtgtcagcccagtgcatgtgacctgagagaccacagaactgagctgattgtcctgtgtttcctgtctgccttgatacctagagctctgctagctcttggccttgcttgtgtggtttctaatcttgtttgttatcactgggcatgcgtgtatgtgtactgcggagtggtatggtggtcagaggacaacagccctgtagaatcagtcagttttctccttccacatttatgagttccagtgaccaaagttaggcttccaggtttgcacagtacacctgctgagctataccactctcactgcctccagtctcctcattttattttattttttttgtttttcgagacagggtttctttgtgttgccctggctgtcctggaactcactctgtagaccaggctggtcttgaattcacagagatcctcctgcttctgcctcccgagtgctgggatcaaaggtgtgaaccaccacagccagcatctcttcattttagaaaagagactgacagcaactcttggggttattgtgacaattaaatgacttaatatatatgtcatatctattgttgcatagcaaatttcctagaaacttagttgataaaacaattatgtattgtccctcagttgtggtgggggagggatagcaagctgttcagctaggcattttcggtttgggtgtccaggacattatcacctgaagggtagtatggaaaggtaggacatctggggtgattgcagccattctctcaaggttggctttccttgtctccatgtggcagtttcaagtcaggcagacttcttgtactgtaactggaaaagtggctcaaggcaaatcttcatggtcctattgccacttctaagtaggcacaaatgtctctctgaagagcagttggaacagcttcctctggcttatgggggtaaactctatcagattgggaggccaggcataaacggtggccttttaacatttccacacggggactgtggatagttactgctcacagtggtctcatctgtgccatgctagagccaattaaaagccttgtgaaggggaaagctatgccatgcttctgcagagtgcacttataccaaggagtatgttaccttaatggttctttttttgttgttgttttttgagacagggtttctctgtgtaacagctctgactgtcacttgatctgtagattaggcctcaaactcacataaatctgcctacttctgccttctgagtgctgggactaaaggtgtgtgctaccaccgcctggcttctacacatatttctacacatattctctctgtcactgtctctctgtctctctatctctctatcactctctctctctctctctctctctctctctctctctctctctctctctctctgtctctctctctctccttttcctgccatcacccttaaggttcttctccatctgggcccccttttggtttcctgacccacatatattttaatgtgtatacacacacacatacacacacacttttaaatcaaggatcctcatgtgagagaagacatgaggtatttgtctttctgagtctggcttacttccctcagcataatatccctagttccacatattgtcttgtaaatgttattttacttaaaaaaagataggatgtatatatgatgtatgtatgtatgtatgtatgtatgtatgtatgtatgtaggtgttttgcctgcatgtatgttggtgtaccatgtgtatgtctgatgactgagaaggccagaagaggttgttgggtcccctgaaactggagtttcaggcacttgtgagctaccatgtgggtaccgggaattgaactgcaattgttttaaagaacagccagtgctcttaaccactgagccatccctatagcactacattctttttttttaaaaaaatacttattgtatccttcctaatgcttttcccttcctatttcatgtactctctttttgtgtgtgtgtgagccagcaggtgactgttgggagctgaacccaggtcttctgaaagaacagcaagtactcttagctgctgagccatccctccagcccctatgtagtcttttttaagcccactaagtgtagctattgctgccaatatgtgcataggcctctcaggggccacattcaaagaaaaccgattcccattcctctccatgcatcaattgccaatagtgcctcagctacagatggtttttgtgaacccttcttgaatctatgctggaattctgggtagcttgaccttaagtatgcaatcacagttactgtgagttcatgtgcatgacagcctgtggaacactgttgaagtagccctcctctggctctggcccttacagtcttccgcctcattttctgagatgccccctgaataccaaggggaggggttgtgatagagatgtcccatttagggtctgagtgctttacggttgaatagaattccatggccctgcatcacatttcctttatccatttaccttttgatggataaaacaaaacacctagtcagttggttgtggcacacacctgcacacctttaatcccagcactcaggaggcagaggcagaggccgatggatctctgtgagttcgaggccagcctggtctaaagagtgagttctgggacagccagtactacacagagaaaccctgtcttggaaaaaaaaaagaaatgaaaagaaggaaaaacaagcaaacaaacacttaagccatcccttcctcagggaggtctggtctgatgtgcttttgtatctgaagtctatgctatgtcgaaaaatgtacccaggttgatcttggcatattaaaagttagaattatctatcttgttgaaaatccttccaaatttagacttgcattagactctggacccatttgttaaaaagaaaaatgtgacacctaattagtgtgcatgagcacgctgggagagaggccaatccagcaaatgaattccagtaaagacacttttgcatagcttatgctgtaatagaaaactcagaaacagggctaagcctggcttgagacggatataaactgaggaagccatgcatggcaaaccagtaagcagcattccttaacagcctctgcttcagttcctaccttcactgccctcaaggatcaagagtgatggggatgtgtaagccaaaggaaccctttcctccccatgtccttttggttatagcaacagaaagcaaacttggacagtgtgtattgagtatgggcacacgtagaagtcagaggataacttttgggaattcaattctctatgatgtgtgttcctggaattgaactcagttctccaggcttggcagcaagcaccattactcatagccatcttgctgagaatatgtgacctgaagagtttgaagaccctggacaaacagcattgctagtggtttgtaaaccacttttcaggtgctgtctttttagcttacagctatgcgacctgtgactctgtagccttgtgatgctgtggccttgtggcactgtgccttctcacagtgggaggcacagtcaagggcttctgcttgcaggttcgtatcaaatacctcccctggctcttcgtggtgggaaggagaagcggtcttgttgattctgtttgtaatagccttgattgtaacagttcccacatgttgaggccagtatcctgcatttgattgccacacaatcatcctttctccccaaagcatttgacattcaaaaatcactccttaaatggttcctcttgactctaccaatttagctccaagggctttacaagaggaagtgtttcccgatgtgatggttgaatcacgctttgtgaaaatgagcaatttctgcccagcatgatgctctctggctttattgccttgggatttttctgggaacatgtgccttccgagagtttcattacaggaaaagcgaacacagatgcattctgctgttgacttctctgctaagctgagtgaggtagtagcatcccttccttttagaaggtgatggaggggggcatggcttacacacccaaaacctcaacactcagaaggctgagggagaacaagcaagtgtgaggctagcatgggctacatgataagaccctgtctcagaaggaaagggaatgagaataaactaatttcttcaccttcttacatgtatttcgacaaccagcaagggcctcttctgcttgttaaatctctgtgagatcccagtggatgttgttctcagcctcggccttcttgtctggagacaggtaccccacctgcctctgtaattctcaagattcttattctttattgggctgacctttattaattaaagtctctcagacacataaatggaatttcgttcttctgtaactcataaggtcatttcttacataaacacatcctaaggtgagcactttaatgtagagctgtctacatatccagtactcttcttctttaaattttttttaaagatttttatttattatgtgtacagtgttctgcctgcatccatccttggaggtcagaggagggcaccagatctcattacagatggttgtgagccatcatgtgggtgctgggaattgaactcatgacccctggaagagcaggcagtgctcttaacctctgagccatctctccagccccttataatttttaattttatatttcaaagcaggagctcactgagttgctcaggctaacctgaacacactctgtagtcaaggtaggtcttgaactcatgcacctccagcttcagcctctgcagcaagtgagacagaagaaccagagagggaggcaggcattgagctgtgcagtgtgggtctagacaactatttctgcccaggacagaggacagaggggtgggctctggagaggccctgctaacttctcacagatatgcccaccaaaactaatttattttcattggtgttttgcttgcatgtatgtttatgggagggtgtcggatcctggaattacagacacttgtgagctgtcatgtggctgctgggaattgaacctgggtcctctggaagagctgtcagcactcttagccactgagccatctctccaggcccagctggagagaactttagctttctggccctgcttctctcttccctgtcttcacggcctcagatcatctcacttcctctttggttcagttttgagcttgtggctagcagctgcctgatggaggaggtggctctggcctccagctggtgtctatttttgcactgagctgccttctcactcctgacctctacaaggcctctttaatcattagttttgaaagaccaaggagctttcagatggcctatgaaaatgttgatgactcagaagaaaacaaaaaggattgaccccaaaatatgaatatgaaaataaagtgaatataagaaactaaggatttaactaaatatctataagctaaaattcacactgacattattaattgataaatgttagtatacccttaggatacagtatgttgggaatatgtagcttagtgatagaccacaagaaagctagtattcatgaaaatagtgattatatttagagacagagaatggcacattacattatcccttttcaaaagattgacaagtatccatcgtgcatgctaagaaactgactacaattttttttttcgagacagggtttctctgtgtagctttggagcctatcctggcactcgctctggagaccaggctggtcttgatctcacagagatccacctgtctgcctcacaagtgctgggattaaggcgtgcaccaccaacgcccagctgaaactgactacaaatgaaaaggtttacttgtaactaaattattttagaggcaaaagtattttaaaagtcaggcttgcatggcaaatgcctttacccatgccagcccacagaggcaaataaataaataaaattttaagaaaagatttataatagcatgggtgcatgataataaagttagatccttcagcccaagaatgtcaaaatctatttatttagctttttttaagtatcttttttttttttttttgagacaggattctctgtgtaaaagctctagctgtcctggaactagctctgtagactaggctggcctcaaattcacagagatctgcctgcctctgtttcccaagtgctgggattaaaggtaagtgttaccactgtccggtgatttttaatttttcaattgcttgttgccaatgtatggaagtagaattggctttagcattttgatacagtaccaaggagctaaatggaacatttttttaaaaaaaattcatttatttgtctattttatgtatatgaatgctttgttttcatccataccagaagagggcatcagatttcattacagatggctgtgagccaccatgcggttgctgggaattgaactcaggacctctggaagagcagccagtcagtgctgctcttaaccgctgagccatctctccagctcctgaaacatttattaattctgaaaatttacttgtccattctttatggtactgtatattagtaaccatataatttacaagtattaatagctttaacatccttcccaattcccatacatttgatatttgtatttttgaaaaagggtcttcctatatagtccaggctaacctcaatctcccagtccttctgcctcagtttcctgaatgctggcattacagctctgtgccaccatgtgtatgcagcttcctatgtttttttaattttttttaattttttttaaattttttttttgagacagggtttctctgtgtagccctggttgtcctggaagtcactatgtagactaggctagccttgaactcatagagctcctcctgtctctgctgagattaaaggtgtgcaccaccatgcccagcttcctacgcattttttaaaactcttatcttgtttctttgtaataattttatccctcatcatgattattattgtgtatgtatggtgtgtatgtgtgtgtacatatgccagggtgtgtggaggccagatgtgtttatggtgtgtgtgtgtgtgtgtgtgtgtgtgtatgtttgtgtgtctgtggacatgctcctgggtgagcatgtggaggtcggatgtgtgtatggtgtgtgtgtgagtgtgtgtgtgtgtatatggtgtttgtgtgtgaatgtgtgtgtgtgtgaatgtatgtgtgtgtgtgagtgtgtgagagtgtgtgtgtgtgtgtgtgtgtgtgtgtgtgtgtgtgtctgtggacatgcaccagggtgagtctgtggcagtcagaggacagctttgcactgaaggttgaaagagagagctgactccacaaggctgtcctcctaacattgctttattgtcctagaccagatgtttaccacagtagttcatagaataatggcccagcacttcccactacctagtacttccattcccatctcaattgctctcctgatgtatcgatcgattgattgattaatcgattgattgatttttgccactttggctcccctgattacctcttgctgggagtcatccaaccactctgtgtgtctgcattcacactcattattcctgctgtgcactacagtttaggcccgtgtttccttcactaaagaacaatcactacaagtgaagattcccaggaaagacccattcatggtttcagtcagtatcgagtgagaatctccagggttttaggcaccatacaaagagctaatgaattctagtgagcaagcaaatgctgtagctcagcgtttcatgtatcacagcagcagaaggcgtccagctaggaataagggaaaacaaactggcaataatggagtgggccagtggaggatacctatgtcctggaaggcatctctcatgaggacatggtactgagtgcagagggtggggagggagaagctgtgtggagaacaacactgggggagatgagcaggtgtcgtggcctgtcaaatatgagataatgaaggcaggagcatagtgagaggaacagggtgtgtgtgtggggaaggtaagagtagagatgtttatcatctcagaaaatctttcttggccaaaggcatggaacatagatgactctcttcctcctccttctcctcctcatttatttattttttattcagatgtgtgtataccacacacacacacacacacacacacacacacacacacacacacggcatgtgtgtgtgtgtgtatatgtgtgtgtgtgtgtgtgtgtgtgtgtgtgaaagccagaaaaaggtgtcaggtcccttggagctggagttacaggcatttgtgaactgcctgatgtgggtgctgggaattgaactcaggccctctggaagagcagtaaatgctcctaaccactgagccatctctccagtcccctagaacctggatgttttgtctgcatgctatgaatagctctacctttgaggacagatctattaaccaaactcgtaagaccaatgttcagaaccagaattccagtgtagtcacagacagtgaaaaatgtgactgctacagggaccaaggagctgggcaaacacatctaacactatcccccaaaggcagggtgacagccagagagcagcctaatgagcatgaatcagatcgtagggttctctgatatcagtgaaacatttaatgaaacctgactcatccatttcacaatagggattagatgccaccaggcccaagaaacttaagaaaggcaattggtcagatagaattatgacaggtaatgtttgcctcaatcaagttcagtgatttttgcacttgatatgtttatagttaataacctttgggagtcttaaaattgttttatggttttttaagttccagatttgaaaacataaaatcaggcattataatataatgaactcccttgtgcccatctctcagcttccacatatggccagtctggttttatctatgcctcagctacttctcccactgtattatcttaaagaaagttccaatcctgtccttcttgttctctgatgacatcagatatcgctgcttggatcttaatagggccccagggagcagtttcaagacagtcaccaccatcatttctgtttacttttaatcttttgttaattacttgggaacactaccatgaacatcaattattggactccatagcaaggcagagctctgggtttttcgttttttttttgggggggggggctggggtcccgcccagacaactccatgcagctgtgggctctctgagactagagattgagaggcgctacacttaacaaacccttatgtaaagttattgactctactgaagttggagagtgaactcaggaatgttgtcagtgattgataaggtacagaggtggtggctgaggtgctcagaacaatcgtggagacttctaaaaaaccaactgcatttccatgatgctccccctcccctccttttgctggattttatttctcctgatcagaggctctgagtctcatatctgatgtttcatggtggccgtgtcaagggcaagtgcatgatatttgaaatagtgattgattgctgtcagttttctgactgtatgccacattctgtcggtgctatagccattacctatctaagagttcttgtgcacacacatgtacacatacataagcatatgttgatagatgcacataggctgaatgtaattttaatatgtcatgtggcattcataatactataaatatataagcaagtctcttttaggaatttttagttgctaaggggtggctgctactccctctagtatatattccactcaaatgacagactggaatactgtttttgtttttatttaaagattttatttatgtatacagtgttctgtctgcatgtatgcctgcacgacagaagagggcatcagatctcattatagatggttaggagcgaccatgtggttgctgggaattgaactcaggacctctggaagagcagctagtgcttttaacctttgagtcatctctccagtccctattttttatttttatttatttatttgagacagggtctatgtatccctggctgtactagaactcacttgtttttattgtttgtgatgtctgcgtgcgtgcgtgcgtgcgtgcgtgcgtacgtgcgtgcgtgcgtgcgtgtgtgtgttgctggggatgaaatccagggcctcacacatgttgagcacttgtcctggcactcagctataccctaaccccggcagacttctttctcctcttcctctacttttggttttttgagaaaaggtcttatgtaccgaatactagccttgaactcaagagtgtagcccaggatgatcttgaattgctgattttctagcctctgcttcccaagtggtacttgcctggcctttgtgtttcttctcaaggtacagcagaagtaagtcattgttttgtcttattgccagaaacatgagaataaatcctcaccacaagggggagctaagccacagagaaaagctgagggtgaaggctattcttgcgagagtagtcatcaggtgggagacacttccactaactgtagttttcagaccccagccacagggcttgctcttcactctcttcccagtgacttatttgtggttctggagatcaaacccaggacctaacagttgatgtgagtgcgctgtccctgagctacatttccagtcctgcggctcagctttgtcttgatggacagcccatggctggcgctggaggctctggctggccagggcactcatttcctacaactgcaaaccctaaactggtctttcacatgcaaatcaacacacccagggcctacaacttgagtcatctccacacagtcagaggatacctccccttgctctcatcccagagtcagggctccgaggagggtattggataagatcactctctgccttattctagggacagggtttctcactgaacctggagctggtctggtggccaccaagcccaaagtaatcctcttgtctccaccctgtccctgctccttgccgaacactgagatcagcattgaggtagaggccacaccagttttatgtgggtggtagggatctgaactccggtgatcttgtttgtcacctattaagccatttccctggccccaaatctgcattttaaaagcctaaccctacagttcataactgttactgttaatctttaagacacacctcaaattctgcctctcttcaacattacttcctactactacctgggcctccattcctactccagtcttgacaccagtgctggagcaaaagtgttgcacataggaggaaggtctcaggaaaagtgcagccatggcttcaagagcatttctgaggcacatatagtgatacatgcttgtaatcccagaacctgggaggcaggaggctcgcccacagtttgaggccactctgagcaacatcatcagaccctgactcaaaactaaaaaggaggctggcaagacggctcagtgggtcaaggtacttgttgccaatcctgacagcctgttcaatccctggagaggttgattggaggagaagactaactccttcaagttgtcctctgacctccacacacatgcacaggccatggcgcagacgtgcttgcctcatctctaccccccagtaaataagtaagtgtaatttaaaatattttcccaacaagcaaacaaaacaagactatttctggaaactgtaatacactcagttgaacaaaattggttttcaaagacaaacatagctttactctattgggtgtttttctgggtactctttcatctgtgacaggacctccaggtcctttggaacacaattacctgctgctcactgggcatctgtggtgttttgaaagaaaatgaccatcatagggagtggcgctaatgggaagtgtggccttgtggaggaagtgtgtcactgtggaggtgggctttgagatctcctatgctcaagctacaaccagtgagacagaccacttcctgttgcctgtgagtcaagatgtaagactctcaagtacttctccagcaccatgtctgcctgcatgctgccatgtcccaccatgattatcattgactgaacctctgaactgtaagtgagccactgcagtgaaatgctttcctttataagagttgccacagttctattcacagcaatagaaaccctaactcccactcctgctcattcatctctgctgtcagctttgactcctgaggttcctgcaagtccacacacacttatttcaggatcggggtctggatgtctctccccagcctgggatagtgattcatgatttgtctttaccctcaggaagtaagggtttccctgactcccccttacaaggctcaccctttccccaaactcttcattccttctcctttgcccaggtctacccacctgtgcacatttgcttctcctggcttgtcaatgacctgtttcccacttcctgtggactcgggcctactctgtgtatagctgaagagaagttggatggacaattagagaccatggttttatattctgccattgattacttaaaagtacgccctacacacacaggaagatacttatctctgagtacctgtcatcaagggggtcctagtcagctgcagctgtcaacctgatggagtctagagtcaaggctcttatagaaagaaacagggagtgatgattttttttttaaactaaaattttattattactggcaggggttgtctgtaccatggaatacatgtggaggtcagaggacaacttgtagaagttagttgttttctttctaccatgagggtcccagggattgaactcaggccaccatgcttggtggcaagcacttttacctgctgagccatctaaatcagtcctcataataagattttattttaaagattcattttatttttaattatgtgtataagtgtgtgtctatgtgagattatgcacacatgagtgcatgagcctgcagaggccagaagaggccgtcatgacaatccctggagttagagttataggcaggtgtgagccaccggacacggttgctggcaattccagtcctctggaagagcagtgtgtggtattttcatttgtttggttttggtttttcaagacagggtttctctgtgtagccctggctggtcccaagctcacagagatctatctgcctctgcttccttaatgctgggacagggtcatctctgtggaatcctggctgtcctggaattctctctgtagaccaggctggtctcgaactcagagatctacatgcttttgcctcccaagtgctgggacttaaggcctgggctaccacctggcttcagtgagtgatcttaatggaatgagtaccactgagtcatgtctccatcactgcgctaggatttctaaacagattccaatgtaaatttcatttagtaatttaataggtaggcacaccatagacatttttgctgtttttcttccctagacaaccaaaaaaaaaaaaaaaaagacaacagaggattgtgtattttgtttaatacttgcattgtttctatagcgcaattatagcaatctttaagtttacttttcattacaaatatttgtcaagttttgtttcagaaacagttttcctactttcttgcacatgcgcccagacacactacaaaaaattcattcataacacagtaagggcaaacattactcatgtaaacatcttccattaatttcccataattaaaaaaatcatagaattatagatattgaataaggctcatagatttagtttaaattccacaaaagaccaaagatgggtggttttttttttgtttttttttttttttttgaactgtgatatggttgacttttggttacaatcaaggccggaaagcataacccctggcttccattctgtaaacatacctcacaacccaataaatgtatttttggatggaaagagaacatagaaaacccaggaggaaaaacatttggagaagggagctacaaatcatggatataacttggtaactttcttatgcaaccaccaggcatgacatacatagtccctgtagtatcaagggtaattatggaaaccaagtagaggagtaggatgcattggctcagtgttcatattgctagtgtacacagtgaaaatttgtcagattattgtttcattatatccagggccaaaggcgggttggggaacgcactcgagtggcatatcactgttaaaggattttttgttttgtcttgttttccagtagcatcagaagagttgggaggcatgtcttaggtacatgaatgaatggtcttcatattaaaatgacacttaacaactgcgcataaagtcacagacaggaatcaagggtttccattatccgcggaagtctccctctctggtgaagttgggtccagagctgagacaggatacggactgtgctgagaatggcccccccaccagcggctgcccgccctctctgggagagggagggcagaaggcaaaaagcattggtaaatctgtgaagtcccaccccggggtctggaccccaactccactgagggtagcctccctgacattgtgactaggcagttaggggtggcgagagaaggtggccgggaaacccagttctgaggtccacacggccatgtctggtttctgattctgttgccctgcaaagaaattgttgtgctccgataactgcaccgttgtctctaatgcctcgattcgctctcaggcccctgggaggcctgtagggaatcactaaaaggtaaacacacctccattagcaccgaacttaccaccagaaagcggctgaggcactggggaagcctacctcacatcagacaccaccccaccaggaggtggtcgccaatcagaggactttgtaggcttttgatttctaaaaatgaaaattgatctgcattatatctcaatagactcagataattctcaccaaaaattttgtcatgtgtttaaatagcactggaataattcaacttcatttaaatatattcattctaccatgaaaatatttcatacaaacatctatttacatacaaacacattaaaatttgtgaaaagggtttccacccctgtggctgtatggcttgaaatagtttcattgctttgaatatgtatgcacacgtttggcaaataaaacttttaaaatttagtatttttgaaaacaaccaaaaaaaaaaaaaaaaaacccaaaccccaaaacaaacaaaaacccctcaaaaatctccacaagaaaccctcaaaaaaacaaaaacaaaacaaaaccccctgacaccaaggcttaacatttctgaatggaaaaaaaaatccaaggtgtgtgttggggaatcaatcaaggtacctcaagtacctgaaaattgaatatattttgtgaacctttgatctgcagcaaataaacatcacaactatccatcttgcaacatagttttgcttgtttgtctaaaacaaaagatgtctggattctaaatcactactctgaagacagaacttgaggtggctgttggagaacaaataaaatccagaattttttactttcttggaagattttaagtgcatttttgtaatgagaaatttatattttttaaatctattaagtgaaggttaataaaagtgccacatactgtctcactaagacaaacttttaattaggtattcataattgatctcccctgcagtattagggatgtaatccagggcctctagttgctaggcaaatgttggaccactgagctatatctatacagctcaatgcaattttaattgtcacaattaaatgctgtatatggccttgtcagtttgcatgcttgtgtgtgtgtgcgtgtgtgtgtatgttgtgataaggaaaaagtttttcaagtgtgataaatctcaaagggtaatgaatctgaactctagttccagtcaggttcaaagaggtcttgacaaaatatttccttcttagttgctaggggagatctgggatcaagcaggttaaaataagaataggtactaagaaactcaagtcctccccacctgttacgttttagcctcattattcttttgtgtcctaaattcaatccttacatctgcttgttagttcgaatggatgccccactaggggacatgctctgtagactagttcctattcctaagtctaacacaaggtaatagttcatcatagaaaagatgctaatgatggatcaagtcatgcagggttgaactgagatagctctgaatgaatcccttggagaccatggcgtcagggagtgcacaggctccagctgtttggaagacagcagaagggtaattcttttttccctaccgcgtagaatctcaatcatgtctgtttgtgattttgatcctgatggaagaccagatttacctgcttcctattttcttttacaacagatgtgaaatagaaggtgaattctgaggcttttccactttgcgccaaacaaggaacaaacaaaccccaagccccctcagtagttaattctctaagcaacctggaccctgctgacttctctacctccacaatgactcttcgtcccctttaacagttgcaacttgagacaaagccggatgtcttggggagggggcaaaaagaatgactggaatgagcacgaaggcagtgtagcaagagaggagaggaattcaagacataaagaggcagagcaatctgctgggctgccattctgcagactccaagggttctcacatagcagaagtaagagagctgaaagacaaaggaaacatacagggaaaaggaaggcaggctcagctgtgtgaactgtttcctgtgatttgtctaagggtcacgtacacagcactgggcttgaagcccagactgtcttcctccagtatggaatgtgaaacgtagattagctagctcgccagccacagttcttcaatcctgctatatatttttaaaaaagattttttttgtgtgtgtgggttcatgcacgccatactctgtgtggcagaggacagctttcaggagttggcttcctccttctgctatggaggtcgcagagatgaaactcgatcatagggttggcaacaagtacctttacctgctaaactattttgctgaccctcaagccaccaaaatttgtttttgagttccatttgaatgagattgctagagtagccctttaagatacaagttgagcccccactgcagctgagactaggttctgtctccaggtgtgggcacaccacccaaggtggggcctgacctctctccctctgcctcatctctcaacctcgtccaacaacctgactgatggagctgtaggaagccatctttttcccgaaggcagccaactctctttggacacatttacacgaaagcacctctcagaattcaaatccacagaccccatccttctgtcacagtttactaaacagtctctttctacagaatagaagcaatcctatcctggttgacttgtagtttaaaaatgattcagtcattttgcaggagacctccttagaagttctgaggatatttctcctgagtgaattatcttcttaagctttcaaacagtgatgtgaccagctctcctggaaagtaccaccacctaagtgcagagactgaagctgggtgtgtcaggaagcttgagagcccagggtgtggctatcatagctgagggcagagtcctccattctggggctgtttgatggggatcatttgggaaagctgttgttaagagcaatgtgcaactgacaaaaagagcaaactgccctctacctatcccctctctccatttctacctgctcctggcaagcatctctatgaactttgagctccctcaaaagcctaaacccacccaggcctctcaggtagcactgttgacagtgacaggcttcagcaactgttgtccctaggctttctggtgatggagcgacgccttgggggaggtgtcccccaaccccagaattcattcagagcaatccagttaggtaatagatctaatgtgctaaactaaaatagtgggcttttctctgtattcctgtggctgtgattacatatggcttacgaggtggcaatatgctattattgatagaaactgcacaggtgtgaacttgtggcttacagagcctggaagcagttaagtgcttggagatcactgtggtgaaaagcttagctacagatctgatttacacctagtaatcagcatgtctgtcttcctggcactgattttaaagagaattctgcattctgttttggaatgcacattgactatcatattttgaattccatgagctgtgtcacaagccagactgcactaggttatgtacaatgaatgggtaccagaggagaaaaaattgccagcactactgaatatactgcaaaattgccacaatgactgcttagaaatactaattttcctctcttcttcctgaaagtatatcttacaactcttttgtaacttaatgcaaacaaagtaaattcatttcttctcacatctgaaagcaaagatatctttgtttacatgcgagaataataagtctataacaacagtctggccctatgagccagttctttatatcaggacataagaatgaaatgatagagaaagaaccagagagacctgtacactgctatgaatgcaaaatccatttggaagctttctcttgtaaaggatagctaagatagggagtgaggctaaagaaaagactcaaaagcctgggctttgattcactagaagagtaacaacaaaaacaaagccattctattgcaagatacagatcaaaggttaaaaggcaaatgaccctacatttatataaagatgtaataatccttccaaccctgcaggtggcaacatgcaagggtgatcgaacaccatttgcaatagccatagaaaaaacatcattaaaaaaaaaaaccttcgatgaaaaatgactgaagaatcccatttccctttttcagcctaatcatttggtatctctgaacgtggtccagatttagacttcaatcatcaaagaacatcatgctgtctacagttcgacagtacctctcagtagggcgttgctgcaaggctagctaattttaaatctggtatgagtaatacagtcaaacctagttagtacgcgagaaagtcgttgctaacgcagggtgagaggatgtgatgtcacagcatgaacagtccctggttgtcccattgtcagataaatgtagtgcatagatccaagtttctattccaggtctgtggaccccagggccaggtctttcacttttgctgggtggcctggaaggccttcagctccacctggtaccactcaggggcttcaggaccactcttccctggggggctgtggtcatagccataagcaacggtcagctcttcctcagcctccacagcttgcagggtgcggatgcacttgataggcccaaaacgggggtggacaaacctaagcatcaagatgagaaaggtcattacagtgccaacacaggacctcaggggcgaaggggaacatctcacccatatacacaggcatcactcctgtgttcttagagtatgggtaaagctctatcagcttcagctggagcttgtaagaggagtgtctcagccctagccccagatctgctgggttagaacactccaggcaggctggagatgtagctcagttggtagagcattgacttagcatgcatgggatcctgggctctctcagtatttcataaaccaggcatggtggtgtatatgttaggaggtgggctaggagaatcagaaatgcaggttatccttggtttcataatgagtttgaagccaacctcggatatataatattctgttttaaattccactatgtgggtcctggggatcaaactcaggtcttcaggtttggtgaatgcctttacctgtggaggcattttgctagaccgtgtctgcatttagatccccatgacgaatgtaagacagaggacacatcaaatgggaaggagccagctttaaaccatatcggtctctgtggcctgatggggctaagcatttggctgtcttctctgtttgtggaagtaagtgtcctgaccatgcactcaggaattcttggttattgtggcttttggctgaggatatagctagtggtagagcacttgcctggcatgtaaaaagccctgattttgattgctagcaccacaggatcacaattctgtatgtatgtacttatacatgcatgtatgtgtctgtctgtctgtctgtatatctatctatctatctatctatctatctatctatctatctatctatctatctatcttctatctgtgtatctatctataaacaggcatggtagttcgaatgaaaatggcccccataggctcacagggagtggcattactgggagatgtggccttgttggagaaagtacatcagtggggtttcagaagcccaagccaggtccagtgtcattctttttttctgctgcctgtgatatgaatgtagaactctcagctacctctccagcaccatgtctgcctgcatgctgccatgctttctgccatgatgacaaggaactaaacctctgatcggtaagccagctccagtgaaatgttttcctttgtaggagttgctgtggtcatggtgtctcttcacagcaatagaaaccctaactaagacagaagtgtattactgtgtagctctggcttgctgggaactcactaggtaaaccaggcttgctttgaacacagagagattcacctgcctctgcctcctgagggctaagattaaagacctgagctaccatgccagggaattttgtctttaagctgacatgcttcattataatttgcatcatatgatttcagtatgaaaatgaaataatgctcctgaaatggagctttgattaactttctggaacatccactggcgtgagggaggggaatctgatgttgaaattttgggcttaagacttcttttccaatgttcttatagctttattctcatgttcattgtcacctgtcatcttttcattttgatgtgttttttgttgttgtttatttttaaattaaattaaaaattttttttcaagacagggtttctctgtgtgaccagtctggcctcaaactcaagatcctcctgcctctgcctcccagcactgggattaaggaactcattctcctcctgcctcaggagctggggttacaggtgggcataaccacacccagcacattattagtttgggtagacagaataaaaagaaagaacttggtttcagatgttaaggcttgcccagggcagtcagtgcacactgcactgggccactttccttccagagctgaggcctgactgggaattcctgggaggacagactgagacaaaacatgtaaggcatccagagtagggctagggtacatggacagagtatgagtttagcagtgtgaggccctgggttcaatctctaaccctcgtggaaggaagaagagaaggaagggatgaggggacggagggagagcaggacccagaaagaatgatcagaggccttggctacagaagtagcaatgaccccaaacctgtgggaccttagttgacatgctaccatatttacaggtagggaagtacttgtgttattgtccactgggcatttcatgccagacttccgtgcaagcagcataaagaagtgctgtttcacttacattaatgcatatactaatgccagtgacttgagaaaacacacagatgataggaacttggatctgaagtatgcatttggttattattcaaggagtcactaccccatataagtgagttttggccatgctgggcttgcaaaacaaatactaacaacaaaagaaagaaaacagccaggcagtggaggcatatgcctttaatcccagcacccaggaggcaggatctatgagtttgaggccagcctggcctacaaagtgagttctaggacagtcagggctacacagagaaaccctgtctcggaccccccccccccaacaaacaaacaagtaggcaagtaaacaaccaaaaaaccctactaccaccaccaacaaagaaaacaaacagaaaaatcaaaagtaaagcctgctgagcagaaactgattttgaacaacaaaaacttctcttgtttccagttctctattgcgtttggaagaagagctgtccttgcagtgaagtcacagacaggcttgattcaaatgaagggtctgagtggtatttagggtggttagttacaggcattaagagaccattgtttatgccagcacagctgagaatgagtgtcagccaaatgcacactagctgtgaaagccccgaagctttcacagtgtcagtctcatttcacatgacacatgtcctttgccatttcagccagccctttagaggcagctggagcaccaatacttattattggctgccaaggagagctagtcattgccaggaccatttccagggcatctcaaggacgagtctcaggacatttcccagcaagctccagatcctggcaaggtctcagatgaaatgcccagagtgtgatcttgcacagcagaggactgaagctatggcacgaagcagggaagagatgctctatgaccatgctacgctgctatatctattgtgtgtgtgtgtgtgtgtgtgtgtgtctaggctaagggccaacttcaggtgtggtcctcaaacagcatccaccttgttttggggcctgggtctctcattggcctggaacttcctgattagtggcccaggctttcgttctgtttctgcttcctcagtgctcagattctaagtgcccttccccacattcagctttttatataggtgctgggtggggactgaacgcaagtcttcatgctggtgcagcaaacacttggatgataactcctccttcccaccccagtcctgcaatgcgatctttaaatgagaaaaaaaaagggcaaataaggacagcagtaaaacatatttctatgatagttctgcttttgaaatcaccttttcatctcaaagctagaaagcaggctgtttagatcttgaaccttagacgacaaagctgaggctcatggcaaatgggccacttttcccatgccctcctgggtcctggggcccctaggcatagatccatccagtcactagcatcctacttacatgtcatagatgcagtttggagtaaaggagtgattcgccttgtgtcccaaggaggcacagtacttagatacgtggttatagggctcaggcacatcaatgactgtctcctcatcaagggagagagtgttcccattcagggcccaatctctgctgtcgacctgcagaacacagggaagtggtgctagagaaggcctttctcacagaagctcaatgcacagcagaggcacaaactcatttatcttagcacttcatagtttgagcactgcagacatgaaagccagccaagacatcttcccacacaaggatggcgcaaccagacagctcaacttactgcttattgtattttcctcattttatatagaagaaaaggattttgattctttacaaagacacacaaaaatatcagataaacttgaactaaaaataaatgaagaagagactgttgagatgtctcagtgcgttcaggcgctgactaccaagacagactgtctgagtgttcagtccacagaattcacatggtcagaggagagaactgactcctggaagttgtcctctgacctccactcttgatcttccaaataaataaatgttttattccctgagacagagtttctttgtgtagtcctggctgccttggaactccctctgtagaaacaggctggcctggaacttggagttctgcttgtctctgcctcctgagtgttaggactaaaggcatgcaccactgcctaaccatcatgtttttcttttttttttttcttttttttttttttttagttttttagtttttcgaggcagggtttctctgtggctttggaggctgtcctggaactagctcttgtagaccaggctggtctcgaactcacagagatccacctgcctctgcctcccaagtgctgggattaaaggtgtacaccaacaactcccagttccatcagtgtatttaaaattttttctataaaaagtcccacacctctgcttcactggaggagtcagggtgagtaggaggcagtctccaagccagcgtgctatgagtcctacctatgctaggattcatggtctatagcataaccaattggcttcttcaggttggacattgggaggtcagcagaatagcctaatggctcttataaaaaggatcaagtttttgtagaacttgtaaatgtagcaggcatgttcaaccttctgtcagtgagacacaactgtcatctacaattcatgtttgtgagccaaacaatcgagtttaaaaataaaacaaaacaatctctcttaagttttcaataaacttacaactttgtgttaggctatgtctgtagacatccttggccccatgtagcctgtggttcagaggatggacacttctagataaatcaacccttcttcctatacattacatttatgcatgacagtcaataaaatgggtagctgccacaggcagcagtatcaaacatgagaaagttccccttaggtctcattattcccaagctatcatgtaaccacataactgataggctgtgtggagtgttgtttgctttaagctgtactaggtatatagcagaatctaaacctcactgtgtgcaaagggtgtaggaatcacacagcagcaaatgctagccttacttgaactgtccatcttattgcatttgtgatcttgggcaaattgcttaatctctttaggttttcattttctcatctgcaaaatgtatgaatgaagaagcacggtttaatatttaaaagtctagaatgcttccaaattcaaaacttttcgaggctgatatacgattggaagaagccgcacctgaccccatatgacaggtcacaggcaaaatgcagacacaataaaaatatagactaattgcctcccagctatgtacacaggaaacactaaatttcatttagactatggtcccattcctaagatgattataaaaatgcaagcatctaaaaacaccagattgctaacatttttggttccaagcatttcagttaaggggcactccacctgtaatgcacccttatcccaaatccacccttctctgctgagtgtcttgggccttctggagggctggtgaagtacggccacctgtgtggatgccatctgctccacctgagcattttgttgtctttcccctgcccagttgctttgaatgtgtgactaattggaacatttcgtggaacgttctcttattatccacaggaataagtgacaatgtggagacctgatgtgagatatcagcaatgagcctgagccctgtatatttattaaaagtgtgaccgtgattgtgctgggggtgcagactggcccttagacagacaccgaggagtcagctacaggatgaggatgagccatttatgaagctctaaaatatgctaaagactttgtcttaaaggcgagaggtggtgcatgtgccacaaatacatttggggaggccagagagcaacctcaatgtccttacccagggttccccatgtttgtttctgcctttagttaaaccctttagtcagctaggtcgacgttcacctctttccacttacctcttggtgtgtaattcggactccattataaaaagacattacagtattgggtcccactgctaccttggaaaatagtccttctccagcactggagatgagagagtcggcaacataaaccctaaaataaataaataaataaataataaatgaaatgtgagtttcccagtgtgatgtgacagtgttgatgtcaatcactacaattccattatggttactaaatcccaaaggacagttcccagttgttcaacaaagaaggaagcaagggtaagaaattaaaccacagtatgttggtaacagtcatggaagaaataacttttatctctttaagagttgtattcaaaacgacctctaccacctcctttagctcaggtatctggctcagggtatctgcctcagacttgctctgcagtcaacgacaatcaggaacttggtcatcttttttttttttttttttttgagagagggtttctgtgtgtagccctgactgttctggaactctctctgtagaacaggatggcctcaaactcacagcatctgcctcctgcctctgtctcccgagtgtgggattaaaggtgtgagtcactgggcctggcaacaaccacctggtgataactagggacttctgaacctgcccagttttctgtggtgttggagctcaaacttaggactctatgaatgctaagtatgcattctatcaactgagctccagccccaggcctcaaatgtcttttccagggttggagagatggctgttcttccagaggatttgggtttgattcccagtacctacatggcatcccatatccatctgcaacttcagttccagggctcttttttgaaaaagatttttatttatttatttatttatttatttattatgtataaaacattctacttttgcacaccagaagagagcaccagatctcataatggatggttgtgagccaccatgtggttgctgggaattgaactcaggacctctggaagagcagccagtgctcttaacctctgagccatctctctagccctccagggatcttatagctggctcttatgggggcatttccttaattgaggttccttcatctctgatgactctagcctgtgtcaaggtgacatacaaaccagccagcacagtacttgatattcgttttgaaaaggaagctaatgtttatagttaatgacaagaaaacattttccaaagtttattaacactgtgctcaaatttctcagatgacagaggaagactattgtttggttaaagccaagatgtttatacaaaaaaaaaatgacagttaatgagatatatccaacaagtatttctcaacaaaggggttaaagtagaggtcagttaactacaggtcaaatctgactgctgcccatttttgttgataaagttttattgaggcacagctgccttccccagtttgtttaagactgtgtcaaaggcagaggctgagtctgtacaatagataatacagggtctgtaagctcctgaattgttacttggtgttcttccatagaaaaagtttcctaaacattgctttataagaaaagcatcctgtcaggcagtagtggcacatgcctttaatcctagcattcaggaggcagaggcaggtggatcactgtgagtttgaggccatcctggtctacagagctagttctgtagctctggtgaatttttgcctgtcttgaaacacccgcccccccccaaaaaaaagaaagaaagaaaagcatccttggctgtggaatggaggtaataagagcttatgttctaccaacaaatctttaatctcttcgtttctttgtgcactgtgatggatggccctgttaggaggtgagcatctgtaattttggcttattttatggactggaaatctgaattattgcttttaattctgcttgctcctctctagtgacagaatgatacatgtcacccctttgccaggtgacctcatgacacttctttaggtgcaggtggggcatacatccccaccctgctgactctgctagctggacatggaagagggccttgctgctgggtctcaggtgttgagagacatggtgagtttttgccagtctctgccagtttctattgtctccaggagaagaatatatcctgggaattgttgttcctttagccagagtcttggaatgaagagatgtgaaacagacctgaacccaacttgaatcctggagcccagcctaatccggctgagcctggtgaaaaccaagtaaagatggctgaacctaagcctacccacagaaccatgagtataacaaaacaccgacctcggtaaacagctaagcagtttcagagtattgctatacaggatttcacaacagactagattgatagatttcagttgggcttgtggtgttttggggcgaacacagaagccagtctacacccactggccctgggccagaacctctcgttaaaaatgaggacattctctccctgcctgtggcactgtgggatcagtgctgtcatttagaccaggaagaagcttgtttctcagatgggagcagaaagtaaacaagaggtaagccacgcccccgggggctgtccttactcagccaaccagtcgaaggagaattctgggcacttagaattcacgttagagggcagccatcctcataggttaggtatagaaaggacagacctgacatggagggatgcttttacgcttagaaaggacagacctgacatggagggatgcttttacgcttgccattactgcctttgcttatatcctgtcttcccttatgaataaagaagttgcttagtgttccaaaggtcaggctacagagaaaaggagttgtgctggaggtgtaggctagacttgaaagagcatgggttgctcccctagaagactgtctcatcaagaaccctgagagggcctggaagattgcagtgggcaaaagcgcctgcttgtaagattgagccttttccacatggtggaaggaaaaaacagttttaaaagttgttctctgatttctacctgcatgcttctccaacttcccagagtcccgagaaaggctgtctgacccaaagctttacctcgagaggtcattctaggacgagagacggaccttcttgctaacttagaaaccttctgtggacagcctctatataagaatataattagtcttcctcagaatacacaaatacttccttatggaggggcttggcttgagcaggagcccagcctgagcagagagcagcagaagctcacgagtggccaccaccagggcataaacagtacaatgaacgccacaaggaaagagttacctctcggactcataagggtctggaaggagagcatcactagagatgcaggaggaagtcgatttatcaaagtggtacacggaacctaaaaggcaaaccaacatgtcagtttaggtgcagacatggctcccaagtcacaggatcatccaaacagtcacaggcgccattctggttatggcagctagaagagctaagtgggcatttgccaggtttactctctgattatgttctcaaatcttgccctttttcttttttcttagtgagataggatcttcccaagttgcccagcttggcttctgggttgggattacaggcccacatttaccaggacttgtttatttaagtcttaatgtgccaccaccagactaaacacttaagattcctatttgttgattttcctttattcaaatgtcttaaactatttttgtgtacttaaaactttaagcaaaacacgttgtcacagaattttcaggtttctatggtcagagtaatctggactttagttttgaaatttcttggaggttttctccctaccggacagtctgtaaactgtacagccgagcccatcaggtgactcctttggtgagagtaatctcaccctcacagagtatggagaacaacagctctccaggctgcattaagagtcatggtggctcagaacctgattggtaatcagtccccatgacaaggtatgcaactgtcctagaattactgggggctttctgttgaccctggcaaatcctcacagggcacaagggatgtaggattctctgagtgttcataaacaaacaagatttggaaccagagagtgaactcctgcaaagccaatcatttttagcactgacaccattaaccatcccatcaatcttctgtaatcaccatggttaccagacccctttcctgttattcaaaatacaatgtaaacctaaatgaattcctcaaacctaagttagaaaatggtccaaaccagtcaatgactgcctaggaaacagaccacttgagtatttcaggaggaaagggacttggttatataggagacaggagagccatgaagtcaaacagagagccaggaagaatctacaagtggacgagagcaggaagcttcctgcccactaagctggggatgggagaggaggtggagtgtgttcttccctggccccataatgcatgtgcagatagcagcctcgtgagggtttaaacaaactcagaagtcagatagatacacaggagccgggggaaaggagcagctgcctgcagaagaagcaggcagaggaatacaaaggatagtgtgacggctattcttggttgccaacttgactacatttggaattaactaagacctaggcggctaggtgcacctgtgagagagttcctttcctttttccttttctttttttttgtttttggagataggatttctccatatatagccttggctgtcctagaacactctctgtagatcaggctggccttgacctcacagagatctgcctgcatctgtctcctcagtgctgggattaaagatgtgtactaccactgcccagcttagggttttttttttttttttaatttaaattttttacaaaagaacttcattttaggattaaatgaattaatttaaacatgtgtgtctgtgtgtctgtgtgttgttatgaatgccagcgatgttgtatgtgaagacaaccttcagggttttgtcctcaggttctgttcactttggttattttattttatttttttaagacagggtttctctttgtgtagccctggctgtagaccaggctggcctcaaactcagagatttgtctgcctctgcctcctgagtgggattaaaggtgtgcattacgacagctcagccaccttgtttttttagacagggtttctcagcctggtgctggctactaggctccagggatctccagtgccatgtagataggttttagagactgaaccctggtatttaagcttagatgatgagcactttgtcaaccgaactatatctccctagaccctggaataacagtaaatacatagaaaaattcaaagaaagaaatactgttcccactatttctcctaaagttaactattaaaaggggttttacatttattatatgtgtttgttcatgcatatgtgctctctctctctctctctctctctctctctctctctctctctctgtgagtgtgtgtgtctgtgtgtgatgcatgtatgaagtcagagtacaactttcaggagttgacacttctcattcactatgtaggtccctgagattgaactcaggttatcagcctttgaagcaagctcctatagcctcagagctatctttggcttaatcagctatacaatttataccgattttgaagtctatctcatttgattctttagtaacataaaaatgatgactccatgttttagagatacagatatttgaaactggttgcattgcctgtcacttcttagtcctgtacctacttagagtcacctatggatgccttctcatgggacttcttagcatatctcactgaagtacatgctatagtttctctgtctcactcatgctgggctttgtcctgtgacttgcaacacaaatgggggaaagttccagggtgaggctttaggaggcaccactggtatctgcttatatgctgacacatctgtagtccacttgagaaaacattgtccaaagtggcctctgtgccttcagactggaccccagagtaagacacagactagcctagactggctgaaccttgggacacagcagacctgtggttgctgccataaacagggaggggttaagggcgggggatctgttttttgttttttgttttttccttggcaaaagctggctgacactccattaaagtgggttccacagaggaaaagaaagaaagaaagaaagaaagaaagaaagaaacctcatcatagggcaatgtggtgcacacctttaatcccagtactatagaagcacagacaggaagttctttgggagttcaaggccagcctagcctacctagtgagttccaggacaactgggctacacagagaaacactatcttgaaaaacaacccccccccccccgaaaaaagaaacctctttaacctgtcacccactggacaacttacttccagatgtcagttcaaagtgtggcctcccttcttcagtagccatgagggtggccagtttcccctcaatcatctctccatcaataaactttccatagagtgcagtcctctgatcagggtagacataggctatcttctctccagtcatctccccatcttcattgacttccccaacgaggctgcctccatcctggtgggagaaaccacaactggagatattgtgtaaaatattcatctatgggatgtgagtttaagaagttcgttttctgaaatgcgctctgtgaagaatactgacaccgacaataacggtataagaatccagagcttttgagaagagtgagactcttcatgcctctgcaggtagtacctttactacatgtaaatacacttctggaatgttctatgcactggaacatgcatgcctcatttaggttaggagactgaaatttactttgtaattctggactagttactggcactctagtttggtgtgttatctaagaaacaaacacattattatcagaacagacttgcagacatttaagggaaatataattaagcacacacctgtaatatattaagggaaatatattataggataactatatcacaaatatattacagcacacaccctgtaatcttagcactatggaggcagaggtaggcggatctctgatttccgtgagtttgaggccagcctaatctatctaggacagccagggctacatagagagaaaaacaaacaaatgaaaaacaaacttcagttaaaatgtgcttttctttttctttttcttttcctttttgcagcactggggtgaacccagagtccaggacctttcaggattgtacatgctaaacactctacctctgagctaaatctttatgcctttaaatgtacttaagaattaatttggtctacccaactaaaaatagaattgcttgtattttccgagtgataaacaaaggcccttgtgtctcccacatcagttcttcctttcattcttcatcttcggctctccagcctccctcccagagaagggccagctttgcttcattccacaggacaaatgctaccggaattctatgtcccactaagtgctgggtcacagcaggtgactcacaaatacctgatacttttattttgtgtgtatgttcctgtagatgcgcatgtatctgtgtgggtgagcacgtgccatggtgcatgtgtggaggtcagaggacaacttgcagaagtcagttctctccttccaccacgtggattccaggggacccatcacactgccaggcttagtgacaaacacctttattcatgaagccacctcacagacaccttttagttgaactaggatacccacagcattatggctaatttcgtttaagatgcaagagatgggcccctcccctggaagtcctaactgcgtaacttaccaatctaagtcctttgtaagcttgctaaacaatttgataccatggcacgtggggtagcttggataatgtcctcactctagtatctgggaacagctattcaaggcagcaattcagggtgaccctcagtgctgcttactgagacagcaataagtgacattacacaagcattacaatttgcatagctcaccacataaactaaaattcggaacttttgaagaaaaacacacagcattatttttcataggcaggaagcccagtagggtgacacttgttgcttgttgtccttctgaagttaattcttactaatgcagtgtaaatggggatgacctttctgtgtgatctgccttcaggctgctgctgagcctcagagtgttagagcatgggtacttcttttacctgccataactaacagaacccaccatgttcctgctcatttgaagcagaagtctgtgtttagggcctctcgccttttccctcaaaagttgaatttatttctttggactgacaaaatagaaatcctttgattttctaaagttatgaatcttttaaaataaaaaagtgcattggaagttaaaaaccaaaacagaacaaaagggcttagtggggctgcagatgacatcttttggtaggacactcagctagcacatgccaggccctgggtttgaatctcagcactgaacaacctgggtatggtggtgacacttgtaaccctggaacttaggaggcagaggtagggggttcagagtcatcctcagctacacagagaatctgaggccagcctgggccacacaagatggtcttgtaagaccctcggaaagcccaggcttccagaatcttagcccaggactgcggccaccccaatcacagaatggaggcaaaagtttgatgcaaattgcatgagactttattgtagtttaacgagctaaccccatgttagctcgggtctttgatccacccaccatggtggatggatagcaaagacagtttgaagctgctgtgcacagatttttatagggcagtgtaaggggaatgtctaggggtatgcacaggctcaggattggtgtgcctccaggcttggagggcttgccctgtgttgattggtcaactggttgttatggcccataggccctctcagggtggttgctatgctttctgtgtcattgctgtgcggttgtccgtaaagcacacccagagccataaagcatagcgccaccagctaacttccgattggttccttgccacaagacagggatctgactttctagtgactaacttctgattgtttccttgtcacgaggcaggcatgttactttctagtgtctaggacaaggtcacagaagcaagtgttcggccgttatggctgccaaaagggaagctggtcccttcagtctcaaaaaccaaaacatcaacatttctatcgtggttcttagagtgatcctataagtatgacagggagaatggttctgtttttcctacccttattcttgccatgtcacaaacatggcccaattgctctatcaaggggtattgaatgggaagaggccattgccttgtttcttctgctcactggctccctctgtcagaaggaggcgttattgtgattggtgagaaggcaggtcaaatgcttgctgacaacccatttctctgctggtggggattaacaaaataaaggcagcttttggcgtccagttttacttttcacttaccctctctcccaaggttcctaggcactgccttgtcaaccccaagaagtcccatatctctcaagagaagcttatttcttttctttctttcttttagtgctctgtctgccagaagagggcatcagatcttattattgggatccacaatgtggttgctagaaattgaactcaggacctctggaagagcagctactgcttttaaccactgggccatctccccagcctgctcaagaaaagctttagcagtgctttagcagcagaagggactgagaggccagttgtggctttgggttcacaccatgcctccaatccaaaggtattacaatgaaaaccagcaattcagtccttgacactactgcctatttctttattgattcagactccagacagcagaagggtgcaatcagccccttctactgtcatccgataccacacttaaagcaggtgccattgactattctgaaagctaattatttcccaatgcttccttcccaagtggtatttgataagaccacagggcaaaatgttgctatagcagctgataggtggcccgcactccagtggctggccccacctacgtacctgcagcagtgcttattggacacgggattataaaaaaatgagaaaagaggttgggcggtggtggtgcaggcctttaattccagcattcaggaggcagagataggtggatctctgtgagttcaaggccaagcctggtctacagagtgagtccaggataggctccaaaactaaacagaaacactgtctggagaaacaaaatgagagagagagagagagagagagagagagagagagagagagagagagagagagacacacacacagagaagaacataaaggtgggaactcgagctgacatgttggggatacctgggggattgggaagcagagttggggttacatatgatgaagacatgttgtacacatgtgtatcaaattgacaaagaacacaaaatattccccaaaaatgtcgctgtatattttaagtttcaaaatttggctccagtcagtgagatgaatgcaaggaatggtctcagtgtaccttggatctcatcacaggacttcggttgatcctagtcagaagtaaaatgacagggagtgggaggctctgggattcctgtttcgtctctctcccatcctctgcctacacagggcttcactcgttcttctgacaactccctctttcaaatgtcagtagctccccagcacaggcagcatggagctcagcctggccactctggaagcccactctcagccttctggacctgtagatcccttggcacctgtctatctgcttgtctgcttctacctagacagtcacctaaatgatatctcagggatcagagctgaacaagaggagacttgcatgtttgggcaagtcttaagacaaagagtagccacattcttcccttggagtatagtttctttttaaaattctctctctctctctctctctctctctctctctctctctgtgtgtgtgtgtgtgtgtgtgtgtatgtgtgtgtgtgtgtgtgtgtgagacagagagaaagagagagagacagacagacagacagacagacagacagacagagaggtattggatcccttggagccccttgtgtggatgttgagattcaaactccagtccttatgatagaacatcagcaactcttaactgctgatccatttccccagtctcaaactcccaggtttaagcccagttgtctcaggctctcctagtagctgggtccacaggtgtgtaaactgtgccaagtttaaccaatgaaaaacacgattgtgttttctgggcacagtgtggtgtgtgttcctttaatcctagcactagggaggcagaggcagttggatgtctgtgagtggtctacacagtgagctcccgtactgtcaggaatatgtagaaaatccctgtctcaaaaattaaaaaacaactgtatttggatgacattggatgccctgctctgtgtctctgccttattcccttgaagcagggtctcattgaacttggaggtgtgccagcctcagattctcaggaaaggtgttgtgagtgcgtaagtgaccaagacaggctttttacttggtttccaaggatttgaactcaggtcctcatatttgtagcaagtgatcttatctgatgagccacctaaacagtttctaaagaataatagggtgggactgaagatagatggctcagtggaagagcactggctgctcttccagggtcctgagtttgattcccagcaaccacatggtggctcacagccatctacagtgacatatgatgccctcatctggcactaagtcgttcaagcagatacagcacttatatacataaaataaataaatgaatcttggaaaaaagtaaaagtatgaacgttgtgtatgttgtttaaagcaaaaaagagcaatgtgagctggtgagatggctcagggagggggttgggggtgggggaaaggtgcctgctgtacaagactggagacctgagctcaagccccagaacctatgtaaagttggggatggatcctacaaattatcctcacctgtcatacatatgcatgacacatacattcccacacaccatgcacactcatacacaaataatacatcaagaaatataacaatgtgtaagtacatttgctgggtatcacttttcttgttttacatgtaatcatttgcttttttgggacagagttttactatgtatgtagcccaggctgacctcaaactctgtaggtcgttgagactgaccttgaactcttgatcatcttgcctccatttgaaaatgctgggattccagcaagcaccactgtgcttggtctgttcttactaattcagagtaagcaaaaaggtattttcagttaagctctggatatgataaaacagtaaacaaagtatatctgaaggtttattcctttcaaaacacagttttaaattcatcaacaacagatggagtatttgaaatgcaaacaaaagttattaattcccaaccatgggctttgccatatctatttgctgtagttgactcaaaaccagcattgttaccaaacacttaaaggcaagttaggataaatcatcttaatgctagcaatacaatccatgacacaccttcatagtgaggggattgtaaaaatccagctgcagtggtgtagtgactccaaaaggattcagtctcactataagagactagataaaattaagcaacagctgggtgagatggtgcatgcctttaatatcaatacttgggggcagaggcaggtggatctctatgagtttgaggacagcctggtctacagactacatttgaggtcagccagattacacagtgagagcctgtctctcccccatagtatttcttttctctctctctctctcttcccctcctccccctttttttttttttttttttggcacaaggtctctctgcatactcctggctgtcctggatcttactacattctgggattagaggcatgtcatcacacccagccatccctcatatgtatttcaacaatgaaatatcctaccacttccttctacatgccaatagagttaaaagcaacttatcttttactttatatttttggttgtgagcctagcctttaacagctgagctatccctccagcctatcttttactttataaatggtacaataaaactagtttgtgccagtgatgagtaaatactcaggaatatgctatgagtcagaagaataattaataaccatctaaagcctagtcatctaagtcatggagaaccacagcaggtaggtgggcatcagacactctcagctctagcgactgacccatggcttcacagtgaatacattttactgtttatcatgagaagtcaaaacattgtctttagacacattcctttcccttagagcgataggtgccagcttactgggtaatggatccaacacactccatgtcgaatgttgtctttgtattgccccttgaagatcagcctcccatcggtgtcatactcctgggctggtccattcagctcaccatcgacatatgtgccttggagaacacccccatcctcataggtgtaaacaccctggccctgcaaggcatcatccacataatatccttccagggtgctgtcagacaagggagaacagaaaggaacagtcagattacacagcactatccatagttctctctctcattctctctctctctctctctccccctctctccccgtctggcatacatgtggtgggtagaggatattttgtggtctttggttctctctttccactgtgtggggcacagggatcaaactcaggttgtcaggcttggtggcaagcacctttactggctgagccatcttaaataaagggtcaggtacaagggcccacatgcccagctctgtgtccaccgtttcatgtattcaggacaagatctgatctggaattcccatagatgggtgactaggaaaaatgcagagaggtgaataatagttggtgatatcggctcattggtagagtatttgcctagcatgcccaggccctgggtttgacacataacacataacacataatctccttaacacataatctcctgattcctcagaatctcttctcttttttctttgctaaaataaagagagaaaaaagccccagaggttgggctgagaacaagtctcagctacccatgtctccatggccaggcagatgcccagcttacgctgggcactggcatttctactgttacactctacttaacagtgaggagcactatgcttctctctggggttcttgaggccctcttaaacagcttgtatacagggctcttcagtcatactactaaggtttagcttatgcaaatggccatcttactttcaagttactaatattttattctatagtagcaatgttaattggcatccaatcaaaagactctcctttgaccactttggaagatcgacgaggacttatttttgtgttatacagtcatgtgtcccttaatgacagagacaggctctgaaaatgtattgttagatgattttgtcattgcatgaacaacacaagtatgcacacacaaatctagatgctatagctggctccatactgaggttacagggtaatcttgcaggacttttgtggcatatgatgttgatggagtcatgtgtgtggcactcagctgtacacatgtgctcatgtgcaccatcatggacaaaaggatcagtgggataaaggagggagattgtaggctcaaccctgcttgtcctgctagtaggctgataaagcccaagccccatggctggaccagaagaaagctcacagcatactcaaggtgatttaactgttcttctcttattgctgtcctcagaaaacacgtttggaagttcagaaatatgatgtctatattcttatgaaatggaagtaagtgtatcacaaataccatttggaataaagggaagggcagcttaaaccattttttaaaatttaaatgtaagagttaaccagatggctcagtgggtaaagggcacttgctaccaaatctgagcatctgagtttgattccctggacacacgtcatggaaggagagaaccaactgaggcaagttgtactctgacttccacaagcaggcctatacctccctacacataacacatatacacaaaatgaacaaatgtaatttaaagattaaaaaaacaaatgttatatattcagaaacaaagatggcttgattaacacccagcttttagtcacagattcagctagtaagtatcttaaggtatgcattctatatagtgaggattgtatggggcgctagccagcatggtgaacaggataactacagcccaacagtactgcctagtaagcacacgctgctcaagaggccacgcaggatagaccacaatacatactaggtaggcagggtaaacacatgccttatactgggacacgcatacactgtgtactggattaagtaggacaagcaaacatcatgtactggcttaggtaagacaggcacacattgtgttcccgggcaggtagaatgcaaagtgacacacagggtttgagcagcctgtccctgactgccgagtgacatcttgtcttatgattgagaatgatctgtaattattaaatgaaatgcacagcctgaacagtgacagcttctcatttcattgtaattacactatttgtggtctcccaaggagataaatagttctctttcccgtttgtttgtattatcaatgacaaataggcttattaaaatcatgaatggaataaagtatactttaacatagcttttgcataaataatcaaaactctaaattcagtgaaactgaattaatgagattcaactgtcattagattcacacaattaagagaaggattgctaatcaacagactgggtgatgtgtgcagtgcagggaagcggttcagtcatctctctccatttctgggaggcattgtgaggtaagatacaagaacagccaggtggtagtggtgcatgcctttaatccttcaacttgggacacagaggggcagaagggcagaggggcagaagggcagaggggcagaggcaggcagatttccatgagtttgagaccagcctggtctacaaagcaagttctaggacaccccgggctacacagagaaaccctatcttgaacctccaacaaaaaaagatagaatatgctcagtgaattctgaattttaggcaggttatgaactttagcaggagcatatcccaaatattgaatataagatacaaatatagacatgttgtgtctgaagttttgatttaaccaagtgctctcagtttttatttgctagtcctggcaacccatttgacttcagatttccagcagcattcagaatgtatatttgggtattttcccaacagacaagtctgcaagtaactctcagactcatgatcaaatctaaaagtcacaggtctctcagacaagttaaaaagaaaagaaaagaaaaaaccagcacagacttgcacatgtttttgtgagtgttaagttcacgaatgccagggctggcacacggaggtaagaggacaacttttgcgaagtagttcttccttccactgtcgagctcagataaggcaagacactgagtcatttttttgtttctttggttttgatctttcgccatacagggtttctctgtataggtctggctgtcctgaaactcactatatatatagtccaggctggtctccaactcacagagacccgcctgcgtctgagtgctgggactaagggaggtgcctctatacccagctccactgagccatcttattttgatctcagtcccaaccatgtctgatggcttgctattgcctcttcgcctgtgagcctattctcacttccctctcaagaaacagtcattttcctctttgcacagctgacttactacacacagtgcagtttaaggcaggacagcaaaatgctctacagcttagctaaattccagagccctcaaagccacctttttagggaagtaagaaagatgcttctccttctgcagtaatttataaatgatccaatttgaatggaagaaggaaggaatggatacctttaatgttagaaataaaaaatagtgtgtttttttttaacaaaataaactaagtatcaccaagctacagaaagtatacagttttactattcttgtactaagtatttgactgactttttatgtaaacattacacatttccattctccctccccatcctctttctttccctcctccatctctttttttgttatttggtctccctgtgtagctcaggctagcctcaaactcattatccttctattttttccttatgttgggattacaagcttgtaacaccatgctcagctctgtattttgctgttgtttgttttgagacacgctcctgtgtactcaggcgggccttgaactcactatgtagctgaggaggactgtgaactcttggtcctcctgcctctacctcccaagtgctggaattgtaggaataggccaccactaacagcccttgctattttaattttcttttttctttttatgtgtgtatttgtggtgtgtgtgtgtgtgtgtgtgtgtgtgtgtgtgtgtgtgtgtgtagaggccagaagagggtgtcagatctcttggatctggggttacaggtagttgtgagccatctaatgtgggtgctgggaaatgaacttgggtcctctggaaaagcagcaagtgcccttaaccatggagtcctctctctaggcccagcttgaatgttcttaagccgtgctccctaataacattttggcagactcctcaggatgatagtaagaaataacaaaaatggccattgggttgtttaattttttctggcaatggcatctaagcaaacaactggaaaacttaggggatatgaaaacatcagtttaactacatttctttctcctctacatatttaactcctctacagtttaactacatatacaggcccttttattttatcaggtgctaagtttccaaaaacaattaaacaggaaatataacttcaaattgtggagaaatttagcagcttctcaccccaattgatgcacctgtacttaatttaaatactactgtttcattgacagccacctctgtagtgtttgaatacacaagagcagttgggaagcttggcttttcttcatggtttggggactgagaagtttctgtccttcccacctcatgggcctgcctaacagttgttccttttctctaacagctgtgtccaacctgtagtttgtgggctgtgtatggcctgggacagctttgcatgtggccaacaccaaatctcaagcatgcttaaaagttaagattttggggagaggtgatatattctttttcttttggtaactattatattgtgtttttcaagtctgaacttttgtagatgataacattgtgtccaatacaaaaggttggacacatctgctagtgtattctcatcaacataagccttgagaaggaaacttaaaaatgaaccagattctactttaaggacctatctctaacgattcaaactgtggcttagtgcaaaacactgttctaggaattatctcatgtggctgaattattatctcatactgcaagccgatgaaggcaaaggagccctaacctatctgttaaagttacttccagtggacaccttccaccttcagaagtgtgatgggcaagcagaaggaagtactttctgcaggtcctctggccatatgctggacactttcaaagctgctcttgtctttgtttttatcctttcacagaggacatgtgagtctagagaatctgatcagcacaaaggctcaaaataacagcaattagcaaaatatagttctcttctttaaaagaacaccctaaaaatgtactgctttggactgaatgtttaggcccctgtaaaatctgaagccttatttcccaatgtggtggtcctaggaggtgggatgttggggaaggtattaggttatgaagtcagagcccttctgagtgcacttactgcccttataaaaagacacaagggagcttgcttgctctggctcccttctccattctttgacaagttaagcaaccatctgtaagccaggcagcagatcctcaccagacatcagtctaacagcttctgatctcaaagccctcagccctccagaactatgagagatgaacactaccctaggtggacatgacagagctgaattgcaatgtgtgacgatggttggtatctggtactggattgcttacttgatgatgggggctggtgtgtgtgtgtgggaaaaccacaccttttggagtagttgattgttgtgtgagtgtagcaacattaaagacatttgacacttgcaagttttccctaacaagtagtcttctaggccattgtaatcaactaagattagagtaacatcaggattggtcaccatcatcatcctccccctccagcagacacttgccaggtgtgctatgtcttccaagatctttatggcttttctcattcaagcatttatccccatcctacaaatgagaaaacaggagtttggagaggccactactaaaaatgaccccttaggaacaccttccatcaacctgctgggcttccagcaaatgctaaagcacctatagaaaagcagctggccaggtggtggcagcacatacctttaatcccaacattaggtgcagagggttgggggaggggggggcagaggcaggcagatctctgtgaattcaaagtcagcctggtctacagagcaagttccaggacagcagagctgttacacagagaaaccctgggtcagaaagcaaaacaaaacaaaacaccaactaaccaactaaacaaacaaactaacgaacaaaaaagttaagaagtgatcttaaagaaaataaagaaagcaaggaaaaaaggaagtcgacccatcactatttcctcacttatggtcagaatggagtggcagatgtagaaaaaaaaaaaaaaaaaaaaggttgcctctaaaagtgaatttagtcagtgtttcattcctgtaatctcaaaacctggaaggtagaggcaggagggttgggagttcaagatcatgctcaactacaccatgagtgcaagactatcctgggctacacgacaccctgtctgagggtagtggggagaaagcaaaaggaaaaaaaaagaaagataataaagaattgaattcacatcaactctaactcttactaactaggggactctgggaaagttatttagcctctccaagccttagtttcttcataaatgaaatgggattgtaaacccaaatatatttatttgctgagcttgatggtcaagaacacagaaaggattttgcctcacatgagaggctggaattcgtgacttcaaaagttcatttccactgcagcttctcggaaatgtgaccaagcaccttctaacaacctgggaaatgtcaccatctgcccctcagcacataggatccctctcagcaggacacagcagtacagggaaccagcgttagaaaacaactttgggaggccggatgatagctcaattggtaacctgcttgccttgcaaacagaaggatgtgcatcagtcccttagaacccacttacaaaacaaagccaagtgtgatggcatggattcgtaatctctgtctagccagagagagaccctatctcaaaacaaacacaaaacacaccagatggctcatcaggtaaagcacttgccaccaaacctgataacagctttatctctggcacccacatggtagaaagagaaccaactcttgcaagttgtcctgtggcatggttagctcctcccaaaaaataaatcaatgtaataaaaaaaaactataaaatcaagactcatggcaatgaggagcaataatggagttttttatcctccacacatgtgcaccacacatcatacacaatacacacatgtgcatcatatatacacttatcacacacataaacgtatatatacacatgtacatacacatgtcatacacacacacacacacacacacacacacacacacacgaaaatgacttgggtacagaaaactaaaggtatgcagtagcaaatactttgaaaactagttggcatagctaagaaaagcatcaacaataaatattcacactctgggttctatggcacacaacgatgctcccagcattttatgggatgaggcaggaggacagcaactgtgaggacagccaggtaactagaaacagaattgaaatagcaggagatgaagcttggtggtagatcacttgcctggcatcatgaggtcctgggttcagtccccagtactgaagaacaatcattcatataataaattacctcacttttaccttgggctaaggacaacattactccctaatatgaccattccaaagcctcaaaatagatgctgctgggtttgtttgtttgtttgtttgttttctttctcttttcccagttctaggctagtgacaagttctagctctaggtttacaaattttggtgacacagagaacagctaaactgtacaaaacatccagattagaggttacaatcaatcagaggtgcagatgtcaaagcattctcagtaccagagaaacattcctacaatatcctcaggaccatccacgtggtcaggctccagaccacgtggcacctgatggggagtctccatctctacctgcccactaaaggttcagtttcttgtggttaacggggagtgtattttggcacactggctcaaatcttcagggtagcttattaatgttcttgtacaccaggtctgtaaagctgataggtaaatgccaccaaatacaaccaatttgatggattattttcctaagagtcagtcaattgttggctatctttatctaactaccaaacttaaaagatgaatatgctcatgtgtatgagtgtgtgtgtgtgtgtgtgtgtgtgagtatgtgtgtgtgtgtagccatctggataaattctaacttgctttcagctcccacatccacgtggcaaggactttatcattgttttaaagtatcacattaagggaaagtgtcataaagtacagtagaatgtcatagatagagaaactctccttaggtggggaggagaaataagacatttacaaaaacatatattgttgaatgaatacaaatataatcccagcataaagtaaaaattgttatttcccagtaaaagagctttggttaaattgtcatgcaaatggaacaggagaattacttttaggacagagggattctgaaagaggaggcaacaccctgaaagagacccctgggggccagtgtgtgtgtgtgtgtgtgtgtgtgtgtgtgtgtgtgtgtggtgtgtgtgtgtgtgcaatgtgtgagtatgtgtgtatatatgatgtgtatgcctgtgcacattgagcatatgtgaggatgggcatggtacatggggaggtcagaggacaactttgggggttagttcttgctttccagcttgtgtgatgtcattgagctatgttacagtttttgaactgtatttgaaatgaatgtgtgcaagatggggccccctgaatctggcttggcagaacatcactgaacagacacatgccagactcagcataccttagactggcttctgcacagccaccactgtcatttctggtcaccaaagccttgcatacatgttgggattactctcactcaccttttacatgaggggtatacagactttgaattgaattcttgcatttgtatcattctttgatttgaaataattggagacaacccccaccccccactgccagccccaaactaaacagaacagagagggctacctgccgtcaaagaagaagaacttcccacgtccattcttttctccatgcacaaagttgccctcaaatctgtctgtggaggagtaggtgacagtgcagaatccgtgtggtaatccatcatcatccaggtgtcctggggaaagagaaacaggccataccttaacaccagactcaggatgcaaccgccattggctcagaacttccaaaggtgccccttctttgtgtgggggccagaagagggcatcagatctccctgtatctggatggctgtgagctgttggaatgggtactgggaactgaactcaagtcatttgcttgagtaagtagcaggtgctctgaagtgctgagccctcgctccagcccgctttttctgtgtcttgaaaggactaagcatgcagaacttgatgttttgtatactttcatgcatgggctggtccacacagaaaggcctgggcatgtttgaagacacggagtctgtaccggcttgccttttccctgggattgggatttattatcagtagggccatctgcagcactagttaccacttcccaagcttccccatgtttggagtgaagatcccagcttctcatcttaactgaaatgtggctcagatggcactgagttataatcttattcttacatgttgcaagcatgcaatatgattttacatgttatcctagagtatgatattgagtactagtagagtctggatgcaccattttattttacattcagacaacaaaggagtcatgtgcctaaaactgccctagtgtttgttttttaaatggagatgaacatgtgcacactgccactgaaatagggatcttggaccccagaaacaattccttacgctcacctttgacctgctggtgcttcctggttacacagtacacatctggagtcagcatctaagtatctaggttccttgtaactacatgtttcacaaactcaggagcccctcattaacatccccccttcatctgggggagtagattttgcagaggtgagtgagaataaaggcagcaattactctattgtcttttccctagagttaacaacctggatcatgggtgaaaatattaaatactgtgcattgcacaaaaatgtgacttccagaaggctcactggcataaaaccacaaaccttgccgccacaatgaattgctttaatctcctaaaacttttattttaagatgatagagtaccaggctgaggatagaacttagtggcaagtgtttagatagcatgcctgagaatgtaaataatccccagcactcaaaaaaaaatagaaaaatatagaagttacaaagaaaggagtagtcataaagaaataaaatgttctttttattattgactactgaaatgttttaccgctctacctgactctatgtggaatgagttacctatgttgaactaagtacaacaatacatactattacttatttgtttatttatgagtgtgcctgtttgagttgatgtgtgccatacacatgtaggagccgtcggtggccagaagaggccactggatcctctggaactggagttacaggtggtgagccatcatgtgagttctgggaatctaactaagatcctctacacatgcaagcagtgctcttaacatgagctgtctcttcagcccctatatggctatgcaaacacaccacagacggccatatatggctctgtaaacataccacagacagccatatatggctatggaaacacaccacagacagccttatatgactgtggaaacacaccacagatgggttagttcctttctttaaacacaaccttttcctacaagggtcagggaatcaatcatcagcagggaactagcacaaaattgctttattttggtagaaaaaatgaattacatgatataattctgacacttgagtcataagaaatgttttggacaagtctttctaaatatctattgatgacaatctttcattgaaacagatcaagtttagttttttctcttttaataaaaaatactcaatatagggctaaaagctttctcttatgaaacattgaaatcaattaagtgtagccattagcattccaatgaatgtagtgtcctacttttgatttaggtagagatatcagaataattaggttattctctcaggagagtaattgctggcgtgttgaaaatgctcccacaatagaaaaggttcacacacttcagattttaaacagcagttgttaataaaactgtttctcttcttgaaatcaagagaaacacgataaacatgaacacagaggggaaagaaaccagtgaaatcctccctactttgcttcctcccttgtcctatttctgaaccaaacactgaaggtatgccacactctgcactgaactcagatatgaaaagaaaaaccggaagttgttgtgtaactgaaagcaggcacaggtcacttctgactccaggtgagagggcacccaaatctcatctctgctccatttggaccccttctgcaacaacccaatggaaaaggaaccctttcactgtttcctagagggctgccaaatgacagacacttctcaggtgaccttgtgcatttagaagaagatacatggatgggtgaccgttctctgctagtctggctgcatatgcaagttctcaatctgtaggacctcagcaggagttccatcttgacttgttctcttttgcatccttagatgcaggcaatgaaaagcactaggtgctgtgaactagagagagtgtctggaatttctgtaggtttctgggcagtgtaaaactgagaagtagctaccccatacatcagcaaaaccaacaagctgggtatggtggcaaaagcttgcattcttcctgctggggattgggagttcaaggaggacctcagcacataggaggtttgaggccagcctgggctgcccaacattctgtctttaacagaaaacacaacagaacagaacagaacaaacagccccagtcaaaacaataacaacaaaaagacttgcaaagcagaaaaggctagggaacagattagattgttacaatcctgttgccttggtacataagtgctgtgagagatctcagcacaattcttcttcaaatgctgctgagacaacaaggttatgtgttatcacaaccttagtagcaagcctatggggaggaggctactatccagagggaaaaaaaaattgtgaagctactctttggggcagtgcatagctagactaagtgctttcttgttacctcttttaaacctcacaacagatgactatacactaccacaaaaccttcaagagaatgctgatcactttaaatgaaaagcccctgcctcgaacacaccaattcactttctctctagagaaaggcagccaagattggtgctctttttccttgctgatggcaagagcgggaggtaccacacagcagttaaagggctttctgttctatccagcatcacattgggctgcttacaaatgcttgcaactccagctccagggatcccaacccctctcctgccttcccagggcaccaggaacacatgaataataggagcaatctaaaaagaaagtgaaagagaaactgtttagggaaacaaaggagactaaagggcaggcaggagactatggggcaatatattcaaagtaaactacatacgactatgaaaatactcttacataacccagaaccaagtatgatgaaaaggaaaaaaaatacggtaaaaaaaatcattgtttcaagttttatgaccgtgtaaaggactatgcactattgagccaaatagtgtactgtgatttggtatcttctcatataacttttcaacttaaaaatttatctttaaaaacaaacaaacaaaaaacaacccactagcaatgcccaggctctttatagtgaaatgcaaggagtctttgtgggctggctgcagagaattgccaagactgtcaacatcagaccttggttgcaaattcctagcccttgcctgtgttgcctaactccgtgtggaaactctagtctttgctgaagactacagaatgtgccgagtcagccaaccaccttccaggccagttcccactacacagaaggtgggcatcaggcccacaaaacaggccaagttcactggaatgaccactttgtgctaataacacagcctcagcaggcgagccacccagaatctatctgcagacagcctgaatggtagccagagaaaaggggaagtaacatgcctcatctccccctcccccattttgttctagatatttttctctaccagaagaatacaaaggtaaaattttcccccgaagttacctctgagcagagttttgttttgtttttttcttaacttgataagattagtctgttatggtgctcactgtggagcagagatgggcccctgaccatctcctgctgacccacagagatctgacagtgctgtgtctatttccctcagagcaagagaccctgacctatgcatactgctagttttgctgacaaaacactgctcctcccctccccccacaaaagtcatttaagaaaaagcaagtttattaatgcaaggactgtgccttctttatgacgtagtcacagtggctgtgaaaggcacacgagctcaaatgtgagggtcgtagttttcatgtaaatttcatggaatgggtgcagtcagaacacagcacactgtcccaggcatacaacacagatgcgtgtaagagacaggcaggatcggacagttgctaataaaaagaatccatactgttttgaggtgattgggacagaagaacatggagctgcttgcttccttcttggctccttgttctgaggattctgatactttctcattttgaacacttttccttagtgtgtcttatgcatttccagccttttcttttcttctctttttctatcctcataactgcacatctggtaccacaagatccttcaggtgaaggcctcagctattgtttcagccctccaactgcctactgcgtcagacaatggaacttcctgagcagccctctggcctgtcattcttcgctctatggcctccattccaacatacagcctacgctctcagcctgtgaccctttcttttctcatctgccccttgggtgtcatttcttcttttcagccccatgtttcagctagagtgaaagtattttctggatgggccaaacaattccacacctctctccttcactcaccaaactctactcttagctcaatgctgccacttctccagggcagtcttatcccatctgcttctctaggctgcaaggaattgtgagcctcaaggtgctctcacacgtgcatgcctctgtgtgtgtgtgtgtgtgtgtgtgtgtgtgtgtgtgcgcgcgcgcgcatgtgcatgattcttgtagagaactggggttcaattcccatcacctacatggcggttcacagatgtccacaatgccagccccaggatgcacatgatacacagatgtacatgcaaggaaaacatttatatacataaaaaaataataaatctaagcaaaataagttttttttttatttttttaagggaaatgctttaaaaaagtaagaagatgtaggtgggtatggtggttcatgccatcattctgcattcaggaaagttgaggctggaggactgggttacacagtgagttccaggctggcctgcgctacataatgaattccaggctagactaggcaataaaatacagaatgagacattgttgagaaagaaaggaaagaaaatgtaggtagacaatcaaaagaaagaacagtaggacaattgacaaaggaatttctgcagtctatcctgtctcccttctttgacaggtgttcttaacttctctaagtttctctataaaatgaggataatatagtatccacctcctaagactggatggataatgtctgagaagcacttagcacagactgcacataataagagctaaacaattacagagatgatggtaataatagctgtgacaaggaaaccagtgagaagacaatgtgtatgcagagttgagtagctggtgaagaatcatcaagacacccagacgagtttctatttaggaaagaatcacagccgtttataccagttcagagatgtgtgttagattttaagcagtgcaaagtgccaaggccaacagtatctggagaaaagcccaaggatacagtttcctgtgagtacacacttgctccaggcaacctgaaaatctcagcctgagttgagtctaaaggcttttcatttcagatttattttattttatatgtgtgagtgttggtgtccacagaactggagttactggtggttgtgggttgccgtgtgggtgctgggaaccaaatccaggtcctctgaaaaagcaaatgaaatgttcttaagtaccaagtcatttctctagccctcttctcttttttttttttttttttttttgagatagaatgtaactattggtctaggctctgctggtctaactctgttagttgggtcccagccttaagtgatctgttccctctcagcccttcaagtaactggaactacatgaatgtcccacttttcctggcttttctaaggactttaaaatcttaaaagttactttggggctggggtatgtagctcagtggcatattgcttgcctaacacacacagcaaaataaataaatgaaattttgttgttgttcttttaaaaattcaggtatagttgctcacacctgtaatcccagcacgtgggtagaggaatgctgaaaggtgaagccagtgtgggctacagagatcttgtttcaaatcaaatcaaatcaaatcaaataaaaccacaaaaagttaaacaagaaagttactctacttttttacttttagaaaaattgagtgactgcccaagacatgcccaggtttaagcctgctgttgtagaataattattaatggtgcctttcttgctcaaatgaacacctgattaatagtaaccctgctctattagtaggataatgtctgctcatcctatataacaagcctccctgtttatggaaagaaactttagtgctttgaatccactggaataactcataatcaacatggaaacatacttttaaaaatttgagacagagctggcgttggcggctttaatcccaacactcgggaggcagaggcaggcgaatctctgtgagttcgaggccagcctggcctccagagagagtgccaggataggctccaaagctacacagagaaaccctgtctagaaaaacaaaaaaacaaaaaaacaaacaaacaaaaattcgagacagggtctcctctagttgaggctggctttgaatttgctattcagctgtggatgaccttgaactcctgatcctcctcctgcctccacctccatatgcaggtgtgtgtcaccacaaaaggtttttattcacataccaatgctaggagcataaatagcagcgcccattttcagcacagaagcactggggaaggtggctcagtctgccgcactatctgtgatcaatggtttgtttttcaaattttaagaaaaaacgaaacaagtaaagttgtaagtaaaaacaaaacaaaaacaaaacaaaacaaacaaacaaacaaaaaacagaaggaggagggcctggagagatggcccagtggttaagaacattggctgctcttccagaggatctaggttcaattcccagcacccacatggcaactcacaattatctgtaactccagttctagggtatccaacactctgcagacaaaacaccatagcacatgaaataacaataaacaagttaaaaaaactaaaaatatattgataaaaaagggaggaaagagagcaacactagcaatttgttaagaactttccccccccatcataacagaaaggtacaagaagtcaataacttgaaagttaaagaaggattcctgtggttgatttctctgggcctccctaaatctcaacattgagtttcctttgagagatataagctctgtgaattcacaacatttctagtctcttctgaagttacaagcaaaaccatgcagtttaaaattgttttttaaaactaaatgaagaaataagtttcacaacttaaattagaacggatgcctttccaagaattaaaaagaaaaaattattctacttcatcacacgctaagcctccagcagcctgtaaagcagttatgtttttgagcacatcaaaatgggatttctcccaaagtagcactagcaaatgcatatccatatgcattgtgaaacaccgccactttatttttctttatcgtttgtcagaacctgttcatacaaattagatcgaaaccagattcaaccagcagcttaaaattatttactgcgacgctccgtttaacaaatcccggaacgacactactcaatcttgcaaaacatcacgggaacattatctgggatagggtaaaataaataacaaatacgcttaagagcgttttacagtgttcattgttacaaaatcataacctctcatgacacaaacaacgagattgtataacgtccccaccgtgtcttttagaagttgggggcttaaaaaaaaaaaaaaaaaaaaaaaagaggcggagaaactcagcaaaaacattgtggcgacaaaagtcgggggaggggcgctcgagaaggggcggagaaacctgacacccaggcggtgatatcacccgcagccaacagcccggaattcagaaagttaagtgtcacccagcaatttcgttcccggctcgagtgcccgcaccctgttcggaagcagggagggggagggagcgggtggctgagttcgcccgggggcggcgcagccctggactagccacctccggagcgccgagcgttcgagcccggtggggagcgcggtgtgcactacctagcaatgatttcatcttttttttttttcggagggttggccggggctgccatgtgcctggtgtgcagccgggtgcgttgcgatgggagacccacctagacacgaccctggtggccaggggacgcagcgactcagcttggaaagggcagagggtcagagaggggaagtcgaggtggctgaaaggcagcttctcctcggagatcaccggtctaaagggactgccctccggcgccctcccctcctccatcccctcaaggaccgaggccaaggtgctggggcagcttcacaactcccagggaggatgctgctgtggcccgtcgggatgcaggggccgagccttcccagggccgtggaacccgcggggctccattccccgtctgtgccccgccgcgcccggcgcgctcccggcggtgtggcggtggctggggccacaccctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttccagtccctccgggtgctcgcggcagctgagcgagcgctggggctaagccctgcgagtttggaggaggaggaggagggggaggaagaggaggagcagtaggggcggatcgcgatgcctccccctacagtcctttcaattcctcggcctgccgcggatgccgcagccgccgtccctcctcccttcgtcccggtccccgaggctccggggtgcagccgccgctgcaactttctcctgtgatacccccctctttgttatggagcagctgatccgctgacatcacccggcgccggtgcgctccctccctcgttgattgacagttccctgtcctttcccagaagtgaggatccttagaaccgaaggcacttcggggtcgcgccgcctctgctaggctgtgggcaggcccggcggcggttgccttttggcttggggctgagagggaaagcnnnnnnnnnnggtcgccgccagctgctcgatagccctgggaatcgcgggggtatcccgcccgggggttggcggggcctcggagagcagctaccggagactgggaaatgctcggcgcagggttttcccaccactacccccctccaggatagctagagctcacgcggagctaaggaagcctttctgatgctcctgagcctcgactatccctctcgccccggcgctcccacttcacccggcttgccaccaccggcaaagtgcctcgcacacaggagcgcaggtgcctctccccccccccccccatggcccagtgtggcctccacaagccagtttcccagactccagggagcgacctgcgctccagattccgcccgacagcacgtcccacccaggtgtccccagtctccaccctctttcgtatctctaggcccctgggaagatccaggaattcaccaaacacaaatggcagcaggctggtaatcaggcctcacccaaggcttggcaggttccctctagcccttgtcttggagatggagccaccaagtggagaactggagccaggaccccgtgtctagcgcatctcctcacgccttctgtcctgtcctagatgtttttctggttttcccaagtgccagccacttctcagattcacgcatctttgagcgaagaaaatccgggttcccaccccagacacttaaaaatgtcattatagctttacctcttacaggtggcagtaaaggacctctttaaatagcgggttaaacggatgcagatgtacacaatgtaccgtggaattaccgggtgctggtctggccttctgccaagaacagctaccgcggcgggtgggaggggtgcagcaggaagcgaagaaaagttgttccatttgattttctgaacaatgaatgagctaggatttcagagcacttccaaggcctgggagagtcagcgtcctcaacttcttcccctcgcttcttaaatgcccctccccttattttttaaagacacgatctcctgtagcccacggcctccaactcactgtggaggataatcttgaactaatggtccttcccccatctccccagcgcagcaataacaagcactggccagcatgctgagttcatatgacactgaagaatcaattcaggttttgccacgctagcacatactctactagctgagctgcatccttggccattatggtaggtttaaaaaacaaacaaacaaacaaacaaattgggcatggtggcgcaggcctttaatctcagcagtgggaaggtggaggcacacagatctctgagtacaaggcaagccagatctatacagctatacagcgagttccaggtcagccaggggcagagaaatcctgtcttgaagggggaaaaaaagcgtctaagagaacaattatagagtcccaaatactatcaagacgtttaggtccatgctgacccctttggaaagcagagggtagtggaagatcagttaggattagtgaccctctgtgccagagagactgctttagcagtctgggttcctctttctgggcattagctgttctggtcacatcaggagacactcctctggtttaggctacacccctgtagggacctatggctcaggctatactgttctgaacttttccagacctttcttgatgtctatcttaggcttgacttccttaaggtcttccagggcaggcacctgggcccctaggctacatagaaatctgtttctgcagtgaaagtcgaaagagcaccttccgattataattgaaattttaattaattataaactaaatataatttaaaacatcttttaaaaaagattttatgtgtgtgtgtaagagagaaagagagacagagacagagagagaaagagagagagagagagagagagagaggagactctgtgtctctgtgactggatactgtgtgtatgaaggtacctaagggggccagaaagcatcagaacctaggagctggagctacagacagtagtgagcccttggatatgggtgctgggaaccaaacttgggtcttctggaatatcagcaagtgctcctaactgatgagccatctgaggccccattgtgcatcattttaaaacatgaactaccgaaacaagattttactgagtgtgtacatatatatgtatgtgtatgtatgtacctatgtatgtatgtctgtgcacatgtatgagtgtgtggagccagaggacaacttcagattttttttttagatttatttatttattatttatacagtgttccgtctgcaggtatgtttgcaggtaagaagagggcaccagatctcattacagatggttgtgagccaccatgtggttgctgggaattgaactcaggacccctggaagagcagtcagtgctcttaacctctgagccatctctccaacccaatgtgttttttgtttgtttggttggtttttttcaggggataggctctcttacttgcctgggactcacagagtaggctaggccttggaaatccacttatttctgccttcccagtggctgggattatacccctggtcctccgaatttgtctctatttcttttaaagcatgcattctggagattgaacatcttcccgggtctcagtttgattttttgaaaaggcatttactgcttcatccctttcaggttttgagctatatgatattccctcttattctcagattttacatatcaccactttccttacacatgatgctggtgtccaaagaatatcaaatactcatctccttcaggtactggacaataaagatgctggaaactgaaggaagaagcaaaaataacatatttctttactgaaggcggggtaatgtcagggcaggaaacgtctcctcagtaaacgagtgtgacagagtctcatggtgggagagtatgtgtggtgggaaggctgggtgaggagaagggtctgtcacaagtgttacctcttgtctttggtttcagagtaaagtcctcttgaaggagtgagcttttcccagcctatgttttctgagcagtctacctgtgttatgggccttccctgtgctactttgatagggtcccactccctcctggaagggatgggtggagagcagcccgaaccctttctgggttgttgcaggactaggaaggaactcactagctctttccacaaggcaggctgcagttgggacagtgcatctcagctcccttaacatttatccctcttggctttagaccacaaatttaggccaaatgtttttgctggttccctttttgggtgttcaaacctttacaaaaaaaattttttttttgtgctaagtttctagcctgatagatctttatttgtagttccagaacccaactgagcatctggaactaaatgtaggatgaacgtttattctattttctgtcaacagtgctgagttttcctcagacttgaccctcttcctgtgatttggccaaacgctttgtttcaacacaggtctgagcaacatcttttgcattgtcctgctggccccatctgtcttgttctttcttatagagctcttcattgagagctcatttggtgaattctccttccaaccagcttcccctgttgtcctctgtccttaccaatggggtcatgggccagaaaaccaataaagctcttaatcagagacactgtgcagcaacagtagcagctggccggtccaaacccatagattctagtatggtaagatatgcaaaagatagtcaacggggagccctggtatgagacttgcttgcatgctcacatgcagcctagcttttctgcttttatttattaatttattctggttaatttgttattgcgatgttgaggctctgtacatagtaggcaagcatgctaccactactcctaaccccttgcggtggagtcaggaaggctcctgtctattagctgagcacaccctcagtcccacaggtggattttagacaggactttgtcatcaagccactactccctcaacccctatctcctaggagcattccactgctaagccattatcccaatgcatggaatgacttttctaagtttctgtggttcagcttccactgtccctacccatgtggcccatctctccagactcagtgtgggaaacctaagtccctcctccactgtccagctactttgagtcatgtccccacccagagctttcccgaaagaactcacaggattcatttccttgcaaaagtgatagcacggtcacagtgcaaatagttctgtgatctccctatatttaaggcacttcccatatccagggtaaacaagcttgtgggttagcagctgtgcattcggagcaccctggggaaacagccagtgtggcttcccttgtcttggtggttagtgaagaaatactcctaccctgccccagcagatcaggataggaagaccccaagcatccttcaggtccaggtgtgcctgggtgtttaggagcatcctaggattgaaaccaggagctcttttgaaaaaaaaatattttatgtatgtaagtgtatgccttcttgtatgtatgtgcatcaaatgcatgcctggtgcctgtggaaaccagaaaagggcattggatcccctggaactggagttacagactattgtgaacggcagtctgggttcactggaattgaacacgggtcctttagaacagccagtgcccttaaccactgactccaaccctagtcagcagctctagaaagcttctgttttgagaaaggtttttttttgggggggggggtggtttggaccttgtgatgtaatcacaaggtttataggtctagtcctaccgtatctaacccagtgaagggattttttttaatttaaattttattttctaatttttaaaaatttgctttttgagacagtgtctcatataacccattttggcctcaaactactgatcctcctacctttaacccgtgagtgctgggttacaggtgtgtgccacaacctgttttatgctgtgctggagatgggattcagggcctagctatgttcccaacccaggaactcttaagcagtcaagtcccatttgactctggttattactttaacaaagttgttttctgggctggggagatggttcagtagttagaaacatgtactgatcttccagaggtctggagtttgcttctcaacatccatattaggaggcttacaactgcctgtaacccgaggggatcagatgtcctcttctggctcccattgcacccccctcacaccacagcatatgatagataacagagacacacatacataaatgacaataaaatagtgtgattgaattttcaacttgtgtgttttggttcagctaagaactagcaactaggtgatagaatgctttgtacagaggtagattgggacataccaacactctgctcaaacctattcagtataggttgggagggcagggtaggggcagtgagttgggggctcatggtttaagcaaagtaaatcagcaaagcccagcaccataagagaaggaaagggctgcatacaggctgactgacaaactgagcgttcactttctcgtgcaatcttctcatagtatgaaggaaaacaccaagggagagcctgagaggccattttcttgacccctgggagggatgcataggcttttatgaggaccatggttcttgggttctgaatcactaaatcacactaacccagtgcctaacagtgacaactgcaaaagctggaggggaggggagaggggtagggataggagtgctggggagaagggcatggggggggggggaggagactgcatgaaaagggccatgctgagttgtggccagggagaacaagaaccgagggcaccacatgacaatgtccagggagcaagggaggggaggagaaatctcatcctgccggaaatagacatgactacagttaggagaagactcataaattcagggtggcctgatttgattatgacaacaggaagtgcagggaggctgggggtgggtgggcagaatagcctgatccgaggaagtgaattaaataatagggaagacttcacagttgccatggcgttaaaatacctccggccacattaaacgtcttcctcttcttttgcttggttcctgttcttccaacaggctcatgtctctgcagtgtatctactaaactaaatttagaccctccagggcagcgaggaagggaccgtgtagctcagatctctgtcttctcgtactatgggccgcatctccatccatgacatgtttgggtcttttgccttctcagatctgaaaacggtttagattgcatctaatgaagctgccagcacaacttgggagagggaggaaaaggccaaattggaaactgtgtaggaactgccttagcagtaacttcagaaaaatcaataagatgcagataggaggagaataagtataatttccatcaaaaccaaacatgcttccttaagtactatttggttttactagcttttaaagtgtatcgtcttgggctacagttacaatgattaggggctggggatgtagcttaggtggtaaagtgtttgacttaaagtaccagagtctgactcagtcctcagaatccatattaaaaaaaaacaaaacaagaaaaagaaacaaacaaggtaaaagcaaaatacccaaacaggcttagtggcacatgattgtaatcccagaactgggggtggggaaagacatgggtagatgcctggctcagtgatcagctggctaaactaattagtgaaccccaggtcccagagaaagactcggtctcaaacacaaggtgggcagaacctgagaaatgacatcagagtagacctctttcctccatacacatgtgcacacacactcactcatatgaatacatagaggtaactggctcttgcaatctccctgtagagatgcagacattggaggaggcaatcagtcaattgcatattcttgcgtttgtgagacactgggattagaacccaaagagtatgtatactcctttagctttggaagactcagtatggagctgggtggtggtagcacatgcctttaatctcagcactcagaggcagaggcatgtggatctctgagttcaaggttagcctggtctacagagagagttccaggacagtcagtgctacacagagaaaccctgtcttgaaaaccaaggggaaaaaaggacagtattaataaaagatcagttccatctgatatattgactacacatgttgaaacactctcctggactcacacaaactacattccagattgatgtacatatctgagttatgactgacagttaagaatattcatgttgtcatagggcctaggccctgcctgggatgatatgacagactttagaggttccccatggagggcctcaccctccctggggagcaatgaggcttgggggagttggtaggggtgggggaggaggggatggagagggagctgggattgacatgtgaagcaagcttattactaatttaaataaaaaactaattaaacaaagcaaaacacaaacaaaaaaagaatattcatgttgtcatgataagtacaatcctattttgaagatgaatgtgttttgagaatacaagtttctttcctttctttctttcctttttttttttgagacagtgtttctctgtgtagccctggctgtcctggaactcactctgtagaccatgctggcttcaaactcagagatcttgctgcctctggaactggagttacaaatgtatgagaggcactatgtggatgctgggaattgaacctgaggtatctctctagacccactatattttcatttttaaatctctttatctttctgatattagccttgtcactttaggggaatgagatatccacacttctttccattccttaactgtcttggcttacttctgctgaattctagccaaattttagcatgccagttttgctaatagatctttctgaaggcaaactggtcctcccaatctctgtgaagcatctcattattattattattattattattattattattattattattattattattattgtagtgtggtggctaatactgacaacttgacaggaacctaacatcacctgggagacaaacatttctggacatgtctgtgagagagttgctagcctgggttaactgtgcttatgtgtgtatgtgtgggttggtgcttgtgtgtcacagtgagtgtgtgaaagtcaaacaatttacagaagttggttctctccttccaccatgtgggagtagggatcaaactcaggcttggtggcaagagcctttacttgctgagccatcactccagccctgagtagttttctaacttgactgaatagctcttaagcttgactttggtagaggacagtgtcatgtcgcaatgttaagcgattggacaaacctagatgctgtcatctatttcttcctaggatgtactttactaggggcattgccagtttctgtatccagagtgtccttttagttcatttaaggtcctattgattctctttgctgattctatagatccattcctgggaaaaatgtctctggccaaccttctggaatattttccaggcagatttaaagagcttagctcaaatgcttctgtgttcagtatggagggatacaaaacaagtagtcccaagacaggctttgtactgtctccttggcctaaggcccatttatcagccctgccatggcagtgggtcttctgcaagtcatcagccctctttctaatctgtcatctgaggaatcctggctgggatatacttgagctgctcagtagagtggtgtgctactggcctgtagaggtgcctcctccatacttccttgcccctgctgaattctctggaatcttcctcctggacaaacacagcaagaggttggatgcaaaccatggtcattcgtgggaagatatagatgagataagaggtagaagtaattgacatacttcttcctctcccagacagtccctctgaaaatgggggctcagagtttggggattatggtgtgtgtgtgtgtgtgtgtgtgtgtgtgtgtgtgtgtgtgtgttcttgttaataaggccatttttattccaggtaccatttctattgctgcatactctttcaagctttggaagagatttaacctgattaggaagtcatttgacatctctgttcctttagacctcatggcagtcttcaaagcaagggagacttcaaaaacttttcccaggatctcacaactaagacatgaccagtgagacataaactaggactccttgaggcttcaactgccccctctcattcttcataaataggacctggagccctcaaggggttggcaggggaagcaggactaaagtgaggaagggatgccacttagagacagtcttcaatgccccagcagtttgtttcgtaagacttaattctagccaggtggtggtgatgcacacctttaatcctggcactggggaagccgaggcaggcggatttctgtgagttcgaggccagactgatctacagagtgagttctaggacagactccaaagctacacagagaaaccctgctttggaaaaacaaaaaaacagacttaattctaaagattaccttttcaaatctatttataggtgaggaatccagagactcaatgttaaataattcctggggttgtgtacctagtgagaatgggactgcataggtcgtaaaactgaggagacacagagcatagcagtgtagctgtgaagaattcattctagaagatgactgggcaaaggaaaacttctagaagataaattacatgtgtgtctgtgtgtgtgtgtgcatgtatgtgcttgtgtgtgcgcatgtgtatgtatgcatgcatgtatgtatgtatgcatgtgtgtgtgtgtttgagtgtgtgtgcacatgcgtgcactgtacatgctatgcatgcatacatgtggaggcctgagctccgtctaggatgcctttttctacctctacctaataatttgaagcaggtttctcacggaatttgtgagttctctttaggtacacctgaattccagaagagggcgtcagttcttattatagatgtgagccatctaattgaacggaggacttctaaaagagcaaacagccagtgctcttaactgttgagccatctctccagtcccctaagcttagctttttatgtgggtgctggagagtctgaactcaggtccttgtgcttgcaagcactttaccaacttagccatctccatagctttttttcctttttttgacagtgtttcactccgcagccctggtatgtagacaaagctgacttcttctaatttctgtttgatcctcctaagtgctgggaatataggagtgagccactcacctggctttttttcacactaatatttatggtgccatacaagctggccttcagcaggtaacgtaatcataaatgctacaggctcacactgtgaatgttttgctctctattttgaaagttctgggaactttgggaagtaggacctaatttgtggaagtagaccattaggggcagaactttgaggactgtatcttacccctggttttagcctggctctcagcttcctgtctgagagccatggcgtgaacaacttccatggcactctctctcaccatgacctgaacgactcgttgaggcctctgcaccatggtaaaatgataccttctgaaactgtgaaccaaagtggttatttttccccttatgttgcttctggaaagtattttggtcactgagacgtaaaagaaagtgatatagagccacacacctggccacagctggccaaaaaaagtgttgaatataggtacagcttcatggatgcatcccaagtgacctccgtatttgagatgactctctcttctttgagacctcatatttcttgttgcttctgggcatcatttcctttatatgtaatattgaaattccagtaatttctgctccatagagaggagattgggacttaccaaccaaacacaagcaaggcactttacatacatccacacacagggtgagtgtccaggacaggacagtttccattatctttttatccattatctccattatcaccaggctcacattcttcttcttggagtaagagagtggcatttcacaaatcagggccctggatgagaccctccaatgtcctggcacttggggtcaaatctgaattggcacactagaccccacttaacctctttgagctgccctctggcacctggcctctatttaggctttatactccagctacactggcccttgattccctgattaaatttaaattctagcccacatcagagactttgcggacactgttctgtctgcttgggttgtccttctcattgcctcccatagttggtttttgttttagcacagagggtgctacctcagatgggttttgttaatcccattatttaagaataagaccactaccagaatttaaagtcaaatttgaagcaagctttaattaaatattggcaaggtggatgggttctgtccagatctgtacctgtgttcccaggaaatggtctcagtcacattttgctggggcttaagaaggcaaaacccatttcctgaaagatccaatcaggagcaagtatacattctgatgtacttcctggctgcatatctccggcctacaacaatcagggggcaagggtacattctgacatatttcctgtccacatgggattaagcacatccagtgcagatgggttaaataaacttgtttaggtcagtgaaaatatgtggctgttatgacccataaacaatagccgcaagcatttcaggaactatcttgctctgttgggcaaggggcttgcagatcagaggtgttttgtttatttgtttgtttcaaggatctctcaggcatagtaattaaaacttaaaatgtaattttggcactcacagtttccctcaatgtccagccaagagtcacctctacaaacacatattattcaagatttcccttgtggaatttttatcatgacacttgtcattaccttacatagttttgtgtactttttttagtctcttacctggtgtcagtctccccacactctttgcttgccctgttagagatgtcacctgaacacttagaacagggccaggggtctcataggtgctcaacccaccatgggtgataaaggtaatgattaaacttgattcctttctaccacctcagagtgggactactttcccaaggaagaagtcagctagagactttattgccataccccactttccatccccctccaattaggaagaggatttagagcaaaccaaactgaaacacctgtttctcagatcctctctcctatgtaaccagatttgaaaagagaaccttgcaagcctttaacactgatactggcaggctagtcagacagtccttactctacaaagagaaaagtttcctggtgcacactgggaacaatgctctgggtcaggtccacgaaagcctatttaacccacaatgcaaagtagaaaaaaacgccttgaaattctaggaaatgtaacatggaaaatgaatgagaaatatcatttgcatgcttgtcttgaatgttactgctggaggaaagagggaagcgctttgaggagggtggggatgagggagccaggtctctgaggaacaggtcttagtttgcctaaggaaacatgccctcacattcacaagccccagagatggccagaggctggtgccaatgcttgtacccattgaattctagaggctggaatgaacacaagaggtttattccggaacactgagatttgtctgtgcaatgggttgactctcgagctttgtagggaacccctgctggagcactccaaggataaacagttggacagctttaaaaagaacaggttcaggtccgagaaccggagctcatctgaggctctgggtttaatctgcagctcacaaaactaggagtgagtggttgccacacgctgtaatcccagcatttgactggtggagggccacaagttcaaacttcagagcagcgtgggtctcgaccttggtaaggtcacatatcagatatcctgcatatcaaatatttacattacaactcataacagttatgaagcagcaacgaggggatttcatggttgagggaccaggttcagtttgttttcaccatagtttgctacaaaggtatttgattttcgtgctgcatctttgaggcaaaagtttttgtctcttgaaagtcttccgaaagcaagagcaatattctaacatgggggagtgaataaaaattatgatgttgtttttgaggaagtgctctttttgggaaagacctaccaacttggaatgattccagtcaacactttggaaacctctgtagaaatggtcagagacaaagaaagttaagtcccagtccttattgttttcttttgaatgtgtatatgtgtctatctgagtgggtatgtgcactgggagagctagcagaatccagaaggggagagcagatcctctggagctggtgctacaggcagttgtgagcagccggatgtaggttctgggaactgaacctactcctcttccagagcagccagcgctcagactattgagacaactctccaggctctcaatgaagtgctttaaagatcaccaaaacattgctgagcatggtggtacacgcctttaattccaccattcaggagacagagacaggcccatctctgtgaatccagcttaagatagtgacaccccgtcttaaacaacagcagccaccaaggagaaaagctgctaattatcactagcagtgtcagatctggatttagaggccagggtggggatgtagctcaatggtggaacacctacttagaatgtgtgagaccttgggttctatccccagagccaccaaacaaataagcaagcaaatgaataatcaattcaggggacaaatgcaaaaacaagataacatttctgatgacattgccatatttggaatttcaaatgcttagacaggagaaacaatactctcttgaaaatgctgttaaatgattccagaacaggctgtgtgatgattaagatgctaatattatggctgtacatgaagaaatttgaataaaattttcatgagatgtgagtttaaaaaatagcagtttgcctaatgatggtggcgaatgcctttaatcccagcacccagaggcagaagcaggaggatcttgtgagttcaaggccagcctgttctacagagtcagttccagaacagccaggactacacacacacacacacacacacacacacacacacacacacacacacaaacacatatatcccgaggagcctatcttcctgtacccacagcatctacttaggtcattaaaggtcattgcttgtccctttgagccaggtccccatagtgctaaggaaagcagtcaggctgatactggaaaatcaaagttaaaattgcttcacttggttcatgagccagcaagtcaaacattagtaatgaagaaagtgtcagcagaaggtatgtcacaacagtgataactgcaacagtcacacactagaaacaccgtaaatgactgtctttagtagaatgagtaaattgtggtatgtctgtacgatagaatactagtcagtagtgaagacgaagcacacatctcagcatgaagaaatcagtcttatgagagatggaaaccatcagtgcaacaccactccttgttgtaatgtgtgttttaaaatgaggctgaagacatgactctgtagtcaagagtagcattgatcttgcagggacccagattcagttcccagcacctatgttgggcagctcacaattgcttgtaactccaattcaaagggaatctgatgtctgtggcttcctctggcacctacattcacaagcacataccaaccccagacacacataattaaaaataataaaagttaaataaacagcatactaaatattaatgtggtttgaatgtgagatgtctctcctggatgcctatgtttgaacgcttggtcccagttggtgagttactttaggaaggttgaggaacatttaggaggtggagcctagctacaggaaatgagtcactgggggagggccttatgcattataacctggccctacttcctgttcatgctctacttcctgaatgtggaggccagttaaccccctgcacctgccaccatgccgagcctgcctgctgtcatgttttttccccaccgggaggaactgtacgcctctggaactgttagccaaaataaactgttttcccccttaagtcgtttttgtcttgtgttgtagcacagcaatgagggagtaactatgacaactacaggtatttgactttttccatgtacatccctaaaagttgatatttccagccaggctaattaaaggaagataatgccattctaaaaccagaagtcaaattctgtaagtcacttctttgtttgggagacacaggtgtcctatttcaatagcagtttgtttctgaaagacacagagcccacgggaggaggagcaggctctgggactatcacggtagctgtaccttctgggaacttacttgtctctccgtgttttatcagatggaaaaaatagaaacagtcacatttttaaaaagtcattttataaggtcttgttgtataattgggttgatcctgaaccagctatattgactagaagagccccaagcttttagtaatcccctagcctcaggtttctgagtattgggattacatgtgtgcgccactatgtcaatcttcctgcaattgtacaaaaaaaaaaaaaaaaaaaaaaaaaaaaaccaaaaaaaaacccattggctgagcttttgtgttaatgttcttttcaggctatccggttcttccagaaaccttttctatagtattggcagcttcagggccagatgactgggcaatcacagccaagttcaaacccttttcaaagctgtctgatttcttagtcttacttggtcatgtctgcctcaccctgagatggaggtgattaggatgtctgcttcactgggtaacagagaacattaaatctgcctgtaaatccagaaataattgacagccattattattattaattattgttattgttactttattcctgattttgtgtggtggggtctcatgtatcccaggttggcctcagactcactacatagctgaggatagccttgaattccttatcctctaacccccactgcaccaccaatgagataagcttacagctgttcataaccattgttggcctgatttatcatttgtaagatagatggacccaaaccaaggcctttttcataaaaaaagcaacggttatgtctttgtgtgtgtgtgttcatgtgtgcacaccaccatgcctggtttatgtggtgctggaattgaacccaggtctttgagcataatagacaagcactctaccaatgagctacatctccacctttgattaaggttcttgagaaatgttttaggtgactctgaggatgtcccccttctttggagctttgtaagtagactaactctggcaggactcaggttgaactttgggagctgaatggcatcatccctgcttcaaaagttctctatttttcttttggactttgcagttgagttatagtaacgggggtgcgtggggagaaggggcactgcatgtgagtctggtcttcatccttcaatgattccacaaatccactatctggttttgaaggctctggattctttgatggagtggttgtcactcaataacatagcatatcaacaatgaatgttctagaccaggtacagactcaggtaatttgttctctgagcctggtttactatgcaaaagaaaactaaaaacaatagaattctacattgcctgtagccatggacatagaatgtgtgtgttggggattaacactgagccagttcagtcagctgttaagtcccaagcatccttgattttgatgtgggccaagtacatccttacaggggagagttagttactcttttatctttcctttaatagatcggtagtaaacacccagatgcagcaagggatgaatagtgaagcagcagctctggttgactaggtttccctaatgtcagcaaggtgtacctgattgggaagcccagtggcttcttgggtgggggctagtgctggcggagagattgttcaggaggtggcagggcaactgatgcccttcctagtgactccatagtttatcttcatttgttagaccctgtacccttatttgaggttcccaaaactttcaccaaggtagccatggagtaattgagaatcctgaaaaaccaccgtttctcttcctctgccttctcagagtcaaaagaacaaaccaagagtcaagtggcccaagttgccttgatggtgccccgttaaccactaggttatgcatgggcagaagttagcggtgggtctttaaagtactagtcattgtcgtatctttccaggtccagagcaggaggcagagacctaactaaggaaggccagctctgtctgaggtctccaggctcattagaggatcccacctaccagtgtctaatgaaggagagctattgtcatgcctgttgcacacacagcgatatcaagctgctgaaagctgcagcagcaggtccggtggtcacgtggtgaattagtaactaacacaggaaaaggggccagcgttctggtccttccagtttggctgcctctttaaatcctcaaatccagttatagcctggggctgtgggtgtgaacaggttccattactaggggaaaggtccctcattttcccaatcgtctactgcaaacctgctttttaatttcagggataaaggcctagaaggaggtcgaataccaccctgtccctcaaacacgcaaacgcgtttgttctttcagagtctggtatttcacagcaactgctgatggagcctatatgagctggaactgcagctgctggtgagcaactgtgtgatatttatagctctctctctcctctctctctctcccctctctctctctctctctcctctctctcctctctctctctctctctctctctctctctctctctctctctcgctcgctctctctctctctgtgtgtgtgtgtgtgtgtgtgtgtgtgtgtgtgtgtgtgtgtaaagggatggatttttttccttctgagaagcattgatgccacaacaggaagtgatctcagccagagacaatgcaatcacaggaatcaagtctactgttctcaaacttgagaatgagtcagaatcacctggaggcgtttgttaaagcatactgcatgggagaagatacaggcaggaacatcacaagttcaaggtcagcctggcctacttggaacaacaaaacaacaggacacaataccacatgggctggggagagctcagtgggtaaagtccttcaagcagatgtgaggactggagttcagattcccagtacccacaaaaatgtcaggtgggtgtggtgaccctctgtaaactcagcacttcgaaggcagagattgtgtggtttgaataggaatggtcctccgtagatgcatgtgtttgaatgcttggtcatagtgagtggcactattaggaagtgtggccttgttggaggaagtgtatcactgagggggcaggctttgaggtctcctatgcttcagttatgtccagtatggcacacagtctcctcctgctgccttcggatcaaaatgtagaactctctgctccttcagcaccatgtctgcttgcatgccgccatgtttcctggcatgatgataatggactggacctctggaactgtaagccagggtcaattaaatgttttcctgtataagagttgtgtggtcatggtgtctcttcacagcaatagaaacccaaactaagatagagatggttcagtgggttaaatgttaatgatcttttgctgagtttggatgctaaggataatccatgtaagttgaggttggctgtcttcctctgaaggaaccagcttccttttggcagccataacagccgaacacgtgcttgccataaacctgccttggtcacgtagaggtcagatgcctgtctcgtgacaaggaacccatcagaagttagtcactagaaagtcagatgcctgtctcgtgacaaggagccaatcggaagttagctggtggcgctatgctttacgaccctgggtgtgctttacagacaagcacacagcaatgacatagagagcatagcaaccaccctgggagggcctatgagccataacaaccagttgaccaatcaacacagggcaagccctccaagcctggaggcacaccaatcgtgagcctgtgcgtaagcctgtgcgtacccctagacattccccttatgctgccctataagatcttttgggagcctgtaggagccctctttttctagccgtctgccatggcgggtggtgaaagacccgagctaacatggggttagctcgttaaattacaataaagcctcgtgcagtttgcagcaagctcttgaatccgcctggtgatttgggtgaccgcgaacgtggcctgggaccccgaatacttgagttttcgggggtctaacacctctattgctctgagacaggatctctaactggacctggagctcaccaactggctaaactgactggccatggaacccttgaagccctcttgtctctcctcccatcgatgggggaaatgctttcacacctaattttatacctgggtgctacagatctgaactcaaaccctgatgcttggtgtggcaagctccctttaccctatgagccatctctctagcccacaaatgattccttttgtaagaattgcacttttcagggctggtgagatggctcagtggatgaaggtgcctgctaagcctgaagacctctgttaatctaccctgaccatacagtagcagaagagaactgactcctgcaagtgctcctgtgatctctacacaagggccatggctcatgcatactcacacaaagacacacgaaataaaaaaaaacttttaatgtaattaaaaaacaaaaaatggtactttaaagccaagcgcaatgtggggtcaaagctagattgataacaggtagtttattaaagaatagtactcacgcaagggagccagtgaccaggcttgcacaagatgcctgcttgtccactcagccaggcagaagagagaaaagagggggcccgtgtccgcacctcccaactacttaaaccattgttacgtcacccaagcggaagtggtcagtggtacctgtaaacagaatttctccctatactactttcctatgtgtgtgtatgtcaatccattttctcattctcaattttgtgtgttgtagtttccttttttttcttggttacgctagtggattatttactgttgttgctcttttgttgttttgttttgtttttcagtgattcattccttcctttccctcctctgccttaccctacctttccctgtcctttttttcccattgtctcactttcagcttatactggtttagaacaaattctgtagcccaggttggtctctactctgtcctggtttccctaattctggggttacaggcattcattaccatgactagctttgagaggcattcgttatcttaggaaactttgctgtacaaaccttgaaaagataatccacaacaaagacagctggtacaaaacccacataaaattatctctcggcagtcagttcttctggctttgtatacaagttcattacaacaggcatccttgggtatacacaggaggatggattccagatacccaaatctgcaggtgctcaagtctctaacataagttctcatagtatttacctataacctacacacatacttctttatactttaaattgtctcttgattatttaaaatatctcaaacaatgtaagtgctgtgcaacagtttttatgctgtattgtttagagaatatcgataaaacatctgcatatggctcaaccttgtcagtcggtagttggacccacagatgaagaacccatgggtatagatgaccgactttggttttattttaattctgcctttctgtatcctttagattttaaaacttgtttttaagttgaatcatttccttcagattcattctccttaaacgatttttaaaattaaatttatttatttgtgtgtgatctaatggagcacagatggaggtcagagaacagcttatgagagtctgttctttcctttctcttcgtggatcttggggatctaactcaggttgtcagtcttggcagcaagtgctgtataacctgagccatggtaccagcccaacaaatgatttttagaatttggtttttccttttaacacacacacatacatacatacatgtatataaaatctttgattatatcttacagactttaataaatagggttttccctattatttgctaataatctagtcttttctttgttcacggaaatgaaggtgtgagacacaaatgatgaatcatctttaggtcttgctgttctgcgatcttggtctgcgaacgactttgttttctcttagcatctgtggattaaagcaataaagccttttaacaggattcctgtgtcgtgtgtgctccatgaggttaaattacactcctctgcaatttggaaggaaatggaactggaagatggaagttcaagccccaactctgccactttttattggtaaccaaataaataactgtgtaaagctataaggtcgcatcgcattctcttccgtgcaatttgggactgcaagggacatggaattagtttcaattaggctggattaatgacttctaggcttgcttgttagttgagtcagcttggccacgggaactggagatgctgagtacagttctcgtcatggtcaagttgatgccttggcttcctcacattttcttgtttgatgcagaggagaaaaacatccagacaactctggggactcatttttcctcactttttggaagatggaccctagaaatggctggaggggatggcagctggatgccagagcaggttctgtggagactcctcttcctggaggggctgttttcagtcaaaaagcccctgctgcctggttatctggatgatttggcattctctcccccatgcttggagattgtccaggctctttccctggtgtggctgtccttctgtgacagggacttctctaagggctgaaacctctctaggggcttgtaggtaggtcttcctaataaatcaaacaccacaacacatgtctgtccctgttgtgtagcccatacaatttgatgaccttagagacaaactttataaataattgtttcttgtactacccaccacaagcttgatgctatggaaactattccctctcttacatgggggacacctggtgctcagaaaacatgagcaatccccccaagaagcagagacagaggtaaagccccagctgcttggtttggcctaggatttcaactgcagagtgctattccctgtgtcacagacttcacagttttcctgtaggtggtgctaaagggtctgattcagtctgtctatgatgacaagatttcaataaaggaaaacaaagtataaggaacagcttttctcctttgtccaccagtcccacgggggccagcagcagctccggggtaacatgatgatgtcacagaaaaaagatcaacacagggtgatgaaaacatttccttgaggagagatttaattctaggcatgttctgcttccacagaaagtcaaacctagtttcaggaggggaaggaagtgtagagccagaagcaggaaggctgcaccttccatatgaggtcctagtgtgtagttgaagcaaccatgacttctcctcttgtttataaggcattgtgttcatatagctcaattaaaactgtaatgtataattaagaaacacagattagtagatagttatatataataaacttacagtcatgttagtttggttttctagatatgcatatgcagagatatatttcagacagagaggtaatcttcaaacacttcaaaggcctacagaatatggcatttcaagtgtcgtaagaacttagacttttcttgacaatgagacacttctgctccttgcagcaccaattacttgaaaaggatgatgggcactgaaaaagctccttatggagcttgccttctatgtggcaagactagccatttgggcaagaaactgctcctgcctggtctgcttgtatgttgtataaactggacatggaggacccacaggaaagtgactgctaaacttgtcaaaacaagacaggatggcccttcagccttcctgcttcccagaagaaactgccagacattctacaggacacagaggaaaagctgacaaactttgccaccacaaggcagaacagatcttcaaattttctgcttcattgaaaagtctgctgaatactatgggcctataggctgaagatggatgccccaatgttacaccagaactttgggtgactgtccaggaagccagatatctctgtcatctctaacattttggaagttgcttacaatgcacttccagtttacttaagtaatattatattcttctggggtttttgatggagttgaagacagatagttatagctttccttagttatgattagatataaaactttagacgcacaaaataagatagatgatagagtattttccttaattttatcacatacaaatagactaaatattataactgtaattcttacttgataaatttttttatatgtaattttactatgttaaagttaaaaccttctttttcaattagacagaaaaggggtgatgatgtgggatgtccttatgtatactgtgaaaatgtgttgcttttattggttgataaataaagcttatttggccaatggccaaacagagtagggtcagatgggaaatccaaacaaagatacagaaaaaaaaaaaaagaaggcagagtcaaagagacaccatgtagcctccatagaagtaagatgtcagaacattaccaataaaccagttgcatgtggagatacacggattattagaaatgggctaacttaagaagtaagagctagccaataacaagcctgagccatcagccaaacaattataagtaatattaagcctctgagtggttattcaggaactggcagatgggacagaaaacatccaactacattcatgggtaacaaagtaatgtagttctggggtttcccaaatttctctctttctttctttctttctttctttctttctttctttctttctttctttctttctttctttctttctctttctttctatctaaaatcccgagcacaatttcccttcctttctcttctcccatcccttccctgcctaacttcacccaccctgcctcgatccacttttcctctgtttctgttcagaaaggggcagacctcccatggctattaacaaaacatggcatagcaagttgcagtaggactaagcaccttcccttgtattaaggctgggtgaggcaatccaatatgatgagtaagttcccaagagccagcagaagcattagggactgcccctgctcccattgttaagtgtcccacaagtagactaagctacacagcatgtgtgtgtgtgtgtgtgtgtgtgtgtgtgtgtgtgtgtgtctctgtgtgtgtgcctcagtgtgccagtgtagaggtcaaaggacagcttgcaggaggtggttttcttcttcttcttcttcttcttcttcttcttcttcttcttcttcttcttcttttcttcttccttctcctcctcctcctcattctttttttagatttttaaattttattttatttaattaacatttttttcatttattttacataccaaccgtagtttccccctcccccctttcctcctgttatcaccctcacttccatctatcccacttcccatccacccttcctccatctctattcagaaaggggcaggcttcccatgggcttccacaaagcgtggcatatcaaattaaggtaggacagagctcctccccctgcatcaaggccgggcaaggtaatcaatccagcatggaaaggggagcaggttcccaaaagccagctaagcaccagggacaggtcctgatcccactgctaggcaccttacaaacagaccaagttacacagctgtcacacacatacagagggcctacttggtcccatccaggctccttaggttttcttctactcaggttatcaggcctggaagtaggtgcttttaaccactaaggcatcttgcctgcccttcctagatttcttaacactctagttcacagtttgaaatctaggatctatgtatgactttctgtgattccctggcacaactcaagcaaggagagaactttgatctcacaagaccgccccaagtatgaaagaagttttgtctcagctgcacaaatgccttttgaatctatttatttattattctgttcttttttggttcattcttttgagccttctaatatcacctggctccctgagagactgctccgtaagcactgctcatctcaacagaacttcagtaattatgaagatagctctgtttggcatttttgggggatgttccccaaggaaatattaaatcagttttatctctcacagtaaaataataaatgttttctagttataaattagtctcctgacaatttggctataaattcactcagtagagtttggactaagaaaattgagtttatttttaacagcaggtcaaaaagtacttcctcagaacatttatctctaacttttgggaaataatttcatggcattcattcattcattcattcattcattcaaaatttgcccaacaaattttcatttagtgtctaagatgtacaagggcttcttttatgtacaccagtgaacagataaacaagcttcttgtggttctcttgttcttgtcaaaactgtatcttggagctttacatgatgtgtgtttattcatttgtgtgattaaatatatattatttgatttttgttttttatattcttacctctctctctctctctctctctctctctctctctgtgcgtgtgtgtgtgtgtgtcaggggcaggagggtgttgtttgctatggggcatgtggaggtcagagggcaacttttggtgagtcacttctttcctaccatatgagtcccagagaatgaacttgggtcatcaggcttgatggaagatggccttatcctctaagccatctcccaggtctttaaattattttaaaactaatataaaaggacatttaagctacacatactagtagggtaccaagtatgatgaatattgatcatcacatttttttcttctcttgtaagacccatgtggatggggccagtgttgctaatgattgtccatctagttctcacacagtgccattttataaagaggctttcaaatatttgatgaacaaagtttctcaaggcttcatactaggatactgggtctccagtaactgatcctctgagcctatcactagttttcaggcttagaaattactcatgggcattactgtcttgttctaagatttctgtcagtcagtttttggtgaaggaataggaaataaaagtgacggtctagctagggtggccctgagcttagctttcttgtactctcagagctggatcctccatgaactctgggtgaggggcatcacagtagggtttggggtaggccagttagccagctggagaacatggaagaagcctgggcttctgtagtagaaccaggatgaattgacaaggacagagcccctctcccttcattccttgcattgaaactgataaaccagcaggccttgagccacagtggggagaggaacatggtctagagaccatctgagataaacctagagccagggtcctacactacactcagctctcttcgtgcagtcatgctcatgcatgccaaccaatcatggcagagacagatcagacaagcccttgaactggctgcttctctgccatggcgtgggtgatgatgtgaatgagtaagagcttggatggcaacaaagacagaacttgaaacacagctccaatggggcaaacctttggaacaaataaccaaattttggtgctggagttatcttaaattaggtaactcttttgctcccctctaggggaggcaaaccacaattttgtgttgggtcacatccatagctatcctagccatgggttaggcacatctgcttgggtggtgttcttcttaagtcagagtactggctgtgttctgtgctagagaagacaagcccatcagccaggatctgtattaggagaaagttggggagagaatgtgtgaaagaatggagttgttttatttttttttttttatttttttgagatatagtcttgctgcatagtacagactggtggcaaagcccccatgtcttgatttggcctctgtgtgctcccatacccaggaactttgctttctataatcaactttactgagaaatttacacatgatgaagccttagatctcaggaattcagagctgggattcaatgcattcttctgactccaaagtcaagtgttgagtttgttgtattagtggtcttgaacttcggagatcataccagaggtttgcaaaactatttcaaagggtatgtggcttaaagggctttaaagatgagctgctttgctcttccaaacccagcttgaacagtatttctgatcacatgcttttcttgtcctactcccatcaggagatgcccgagttgccccttgatcctgagtaggcctccgtgaatgtctcagctgaaagagttggcaaaagggattctctgaaacttttgaggctggatgcaacaaagtattatagctgacccttgggtttctcttaagatgcttgctcttggaacttggccaccatgagtgaggaggcccagacctcatgctgcatcagagatcctggagactacacttatgatggttcactggaggtcaacagggctctgtgtgtagttgtcattatggctgatccagtacagcaaaaggaagagccatgtagggtaaagctaggtagaaacaaggcacatgcttcttgctggtcaaacatcctgaaaacatacctctgggtgtgcctctgagagtgtctcctgaagggcttaactttggagggaagactcatcttgaatatgggtggcaccattccatgagctgaataaagagaaaccaagtgaaacatggaaatctcccccgccccagtctggactatagataaagtgtgacaagctgcctcacactccatggaaccacctactggacagccatgctttccacaccatcacggactgtagctccttcaaactttaagttaaaataaacccttactttaaattgtttaacatcaggcattgtctttgggttcctattgctgtgaagagataccatgaccatggcaactcttaataaaggaaaacatttaattgggtggcttacagttaacaggttttgtccattatcatcatgggacaaggtggcatgatggcagacatggtgttgaaggagctgagagttctatgttttgatacgcaggcaacaagaagtgaactgtgagacactgggcatggcttgagcataggagacctcaaagcccacccccacagtgacatacttcctccaacaaagccataacctcctaatagcaccactccctatgagattatgggggccaattacattcaaactaccacaggcattttgtcagagaaatgagaaaagatacaaataatttctccagcaaccacttgaaacaacacaggtgaaatactatccacttgggggagtgcataacaatgagtgctcctaaggagcttcctttctactacttacagatcctagaccaggagggaagaaggtgttcaacagtccaggctatatcatttgccaacctccccaaatctcagtaccacaaagtcaagcaaaggccacccttgcacatgggcctaaagatagtcaggtctgccatctcccacagcactcttcccaaatgacagatctgtgagcagaaaggttgtaaagaaaggtagacaagaaaatttagcggggaggtgtggagaggcaaagagttaatggtggtccttgtttggaccaggtgtttccagactttttttttctcttccagacagggtttttctgtatagccctggctgtcctgtaactagcttcatagacaaggctggcttcaaacttagagatccacctgcctctgcctcccaagagctgggattaaaggcatgtactacaatcgcccaactgtgtttccgatttttggtttttttgttcaaagaattgaagaagtgcacacaatcagggaagaatcttattcagaagcagagcaaaagtgcaggtcgcatacactacatgagggcagcggctgagtgaggtttactcacgcatgactggttaccgcttagaacatctttttcttggtccctgaggaggggttggttgctagggatggagtgtaggaggctttttgttttgattgacaggcttggtttatataagcctttgttcactgtgcatatccttttccacggtgcatctgattttagtcatatgcatacccaatcatgcatatgcatatgatgataaataggggagtctccttaaaagtttacttagaggaagcagtttactgtgtgtgcatccctaggttagattgagctactatccccagttcctggatgtattctgggatgtaattggccacaaaagggaagttactaagggttgctaggtagctgtagctctgagtaacctgttgttggttagagaagagggtgcatatagctcaatgcagatctggtcctgaagggataagtgcaatgttcaaaaaagggttatgtgcatagttcaggccaatggggacccagactgatgaccaagcttttcttgtgctagcctgcatgagaaggagcccttcactctgtctagtctgaagattcttaccagctgagagttaggaattcaagcacaactaattagtgagagagccagtgcttataactgcggtgccctctatctccccttgtctgatcttttgaaacagggactcatatagtccaggctgatcttgaacccatacgtagtcaagaatgaccttaaacttctgcttttacttccaagtgggatttcagccctgtaccaccaggccaggcacacagattaattctatttctacctatttaccactataatagtctccaatattccttctaaaaaagaggcataacattcacaagcaagcctgtcttgttttagtaactagtaatattagtacaaagtgcacatgagataattgaaaaaggaaattctatttcatcaagagatatttttcaacaaaacaatacttttggtctttaatagtgcatcagcaaaattcatatatattcatttttttgttgatttgataggtgtcttgataatgtaaaccagagtaaaatttataaatattcagagtgtcaggaaaatttaatttctgggtatattcatggcagagacatatatgaaaatgattcaaaatactgttaaccaaagctgtattatatttgtgtaaacttttactggagaagaggcatggaaagaaaaattcaaggagaaagaagaacaaaattttccaataaccaagaagaacttgttcttgtatttcggaaacagatcatgggctctctcagactgctgtaggtttaacttaccagcaacatttaaaagagcaagctgacatttttatttttaaacatcaatatttgcaacacactaggcaagcagttctcaagccagcttcactggggattttccaggagtgcacattatcaggccccagcccagacctgccaatccagaaaccaagaacaggtgacagtctgtgcttcaccaaggtcccccaggtgatcctcctgcaagcttcacacaggattaccgtgtgaagatgacctcctctgcagcccctttaatttattatgcaggttggtggggttgtttaaaaatatgtgagcaagtctacggtcttaccgaagctcaagcagaaatatccaaacactgtagccttctgcacttcacagtgagaagcctgtcatgaagccaaacccaacgacaacctttccgaaagtgactaaagccacgaggtttgttcgtggcatttgtttcaggtacagatgcattctaactcaggattgaggcatgaaaacagagtgggaaaatgtaactgacctgaaagaaatagcaatattttgaatgattacttgggaccctcccttgggctatcagactattttaaaaagcattccaagaaatcaggactttcccaggagtctcatgatgaagaaagaaaaataaaaggatgtcttggtgctagacagagggagaacttgtcttccaaagaggtttcacacctctgtatatctcctgctttgactaaagcctaaaccttctgtcaggcccccaaagatagacatgggagtcaccagacattcctgttcttttttacaaatggccacattgagtaaattcatctctacatttttccatcgtgtctctagttggcctaatgagaataggctctgaccctaacaactccagaagtctgcagctcattacagcttatactagatagagttccttccttctgaggagggaggatggggacaggcattaagggagatgctggatggcatttgaacgtccatcactgtaggcagtggagcaagaacaaggcccagaggtggaggagtgagtgtgaatgaaggaatggttgggccaggctggaccatgatgcagaagacggtagctagaactaaatttgaatgagaagatgttttccttggctgtggtcagagttggggatagctggaagtgcagtgagtctaagaaacctcagcagatgccaggggagacccctggagcccatctgtgtcctcagaaaggtggctactcactttataatccgaagaggtccctgctgggcatcactgagaagtggagtctgataaccctagagagcaactgttctgaggtagccatagtccatctgttgctttgggttccagccctgggccacgttcaaattcttactgttttgtaagtggaaaccgtacccattgcgacagtgaggtagttggagttgctcaggctgaaggaacccacaaattcctggagaagaatttttgtttctgtttggtcaagggcaatccagggagaaaaggcattacatcatcgaagctgtctctcattggctggccatttactttgcaattgcttagttctgagagttctatgcattgtggaagcgtgttctgcagcttcagtctctggattcaaagcctccaatgtcattaggttacagccatcgagtaagataacacaatgagggggtttttagatgacggaaagcatggaccctccggtggaccgctcggaacactgtgtcgagtcactttggactctgcatcactacatgaattcataatgcaatattcgtgagagacagggataatggaactgtgacaccctctcttctacttggtgtcccatgaaatgggatgcaaataaattgatttttttttaaatcacatagtttcaatgcatagctcctgaaggattcctgtctttgtgagtctcaggtgccatttccactctcattgtcagtcttatttcttgaaggttaataacggaactgatttctcttaaaaaagaaaaagtcacacaattatgttgaggaaatggaggaaattgtcatagttgcttttcttcagactcgaatttgatgttcttttttggatgagaagaattaaaatgaatacctacctcatctctctctctctctctctctctctctctctctctcttgcatttaaatagcagcataattctaaagtgaagttttacaaaatccatcaagtagttccaaccatttgatgagagagagagagaaaaaagaacaaatcttccaagggattttatttgaaaatagccattaggcatgtactgtaataaaaaattttaatggccattttatatttcagttcctagttcatttttagtgaaattacttggtgacaaatggaagctgagtgatccactgggaggcagagcttgcgggtttctgaaataatagagtggcctctggtgacagaatcctccccgggaccagcacgtgctggaaggatcctaccgcagtctccctctgggtctcttcttgctggtgataggagcattacccagcctgctctggggcttggccttctagatgtggtggaggaaaccctagtgctgcctccagtttcctgactgtaagatccccggaaagctgaggcttccaggatcttagcccaggaccgtggccaccccaatcacagaatggaggcgaaagcttgatgcaaattgcatgaggctttattgtagtttaacgagctaaccccatgttagctcgggtctttgatccaccctcaatgtcggatggctagcaaagacagttcgaagctgctgcgtacagatctttatagggcagcgtaaggggagtgtctaggggtatgcacaggttcaggattggtgtgcctccaggcttggagggtttgccctgtgttgattggtcaactggttgttatggcccataggccctcccagggtggttgctatgctctgtgtgtcattgctgtgcacttgtccgtaaagcacacccagagccataaagcatagcaccaccagctaacttctgattgattccttgccatcaggcaggcatctgacctctaagtgaccaaggcaaggttatgccaagcacgtgttatggctgttatggctgccgaaatggggagctggccccttcactgacaacacccagatttcgaatctccggagaccagggacacagggctgcagggcagagagagcccttgttgacctgctctcctcatggagtcaacaccacgtgacttttgtgtttctagggcaaggatgccaagtcccttatggcctcttagcatcttagttcgcaaagagctgatgatacagggggcatttttctcctatgataaatttctaaaaggcaaaccaggttgcaatggtgtccaatggaacccttcggtgaaactgttttgtgagggggttttgtttttgcatcaagagattggggttgatattgtcaagagctaatgtgagggttggagagatgattcagtggttaagagcacttgttgctcttccagggaactgggcttccagaacccctggggcagcttataacctgtaagtccaggtctaggggatatgttgccctcttctgacctctgaggacaccaggtacacacatggtacacacacacacacacacacacacacacacacacacacacacacacaaaagggaaacagtcaaatgcaaaaagtaaaatgaataatttttttttaaagagctaacatggtgatgtgattaaaaccccaggcctttcatttaagctgggttggacttctggctttaatatctgctaatatttgctctcattggtaaaactttctagacttcagtttagtttcctgtaacctgccataataaattcactcctaggcctggtgtatagatgaaatgatatgttacatacataccgtccatgtagtaaatattcacatgaattaactttctttctttctttctttctttctttctttttttttttttttgtttttggagacagggtttctctgtattgtttttgagcctatcctgacactcactctggagaccaggctggcctcgaactcactcgaatccccctgcctgctgggattaaaggcatgagccaccaacgcctggtgaattaactttcttgttttttttaggaataaccctattgtgaatgtgacccatcattgaaaggctctgaattgctgaatcttttcttctctgctgtctaatccggtagaacagacctgaggggtttgggtgaggaacaaaacacttgtggtgttttactgaagacatctcttcctttatttaaaattttcaggctggaataaagcagtgatgtgcccgccctggtgatcaagtctcaggtttctctcatgtcggaggatatggatgcctgactgaaaatgtgctctgaggggttctaactgctgctcccatttccataaaatctctgtctgttgctggaattggaagcaatcttcctgagaagaacagaacagaacatttccaatcccaaaaaaaaaaaaaaaaaaaaaaaaaaaaaattttccaacccaaaaaaaaaaaaaaaaaaaaaaaaaactttctaaagaaatgtttttgctggagacaaggatgaacctgggctgtttctggaatgaggccattcccactcgggtagcacgattcatgcctgaggaggaagagggctttgtgtgtgaactgaaagagtttaggacacagtgtgtgacatttaaggctccagaaagctcgtgttgttggccctccaagtgagtgcaaccagggagggttctttcacaagggagactgtttctccctgttgtggagtttcagagccagatcccaagatggcggatgtgagaggaactccatgagcatcccaggtggagctgtggctctgaggaggcagagaagcgctgcgcactgacaggttcctttaagacagggcttagctggcgtctttactaggacactagtaaagggagggaagggagggaaataaaaaatactttaaaatgttatgctggtttgaataggcctagcccccttaaacttgtagatttaaatgcttggccaccagggactgttactatcaggaagcatggccttgttagagtaggtgtggacttgttggaggaagtgtgtcactgggggtgggctttgaggtttcagaagctcaagccacgcctagtgtcactctcttcctgctgcctctcagctccctctccagcaccaagtctgcctgcatgcaggtatggttcccaccatgatgataatggactaaaccactgaactataagccagttccaatgaaatgttttcctttttgaagagttgctgtggtcatggtgtctcttcatagcaatagaaacactaagtcaaatgcattttaatatagaaaaccaccacacagtattaaatctatactcaccatttttccttctgtaaagccatgcttcttttttaatatttaaaaaatttatttcctaagaatttcctgcaaacatataatgcccttccaaccctctcatacccccatatcttgcccccacatctcactccttttcttctttaaaaacaaatagttttctaaatccaatcagtgctgcatatatgtgcacctgggcgaggttcacccctggagcatacaaggccaaattacttgaggccactcccccaaagaaggggatgatttacagataaggtcccgttctatagctctggatgacttggaaccttccatgtagcccaagcaagccttggagtggcacaccatgtccccaatgaccctgggaggagaattttgatgtcaagatgatggagactgtgaattatgcagatttggctttaaaaactttgttgttgctgtttatattaagcttacttatttatgtgtgtttgtgtgagggggacacaggcttgccatggcacccatggtggttttcaccttccagcatgtgggacctgggggtttggaactcaggtcgtcaggcttggtggcagtacctttatcctctgagacatcttgccagccctggattcagattttaatactgatgaaatgcatttatggtcacaggctagagaagcctgagatttctgactatagagacacagaaacagtctcggaaaaatgtattctttagaacatctcactcaattctctaatttagcgtccattatcattggcttttaatccatagaaactactgaagatttttctggaagcctagtgagcaggaaatccaatcaatcaccaccttacactgctcttcaccacgaggtaactgaaagacttaaaaattagcaaagaaatatagcccagataaggaaactctccaaacagaatgtagggcggcctaacccagaaactaaggccactactatgacttagtgcctggaatttaccagctgccagcaattactcccttacaaggccataagataactgggtaccaagaattcccagatggccaccctccctgaggggctcatgaaggaaacagattgtcccacctgccaatgtgtcaataattaacagttaagggtccctatgaaacaaagagatagctaccatttgctcaggcaagattagttagcacatcctgaggtctgcaggttttacaactggtgggtcaggaggccatctgattcccagccctcccctcaagacaaagggcctcctaggaacctaagactctgttcatgtactcaagggacagagagtcgaggcccctccctaagcttgtggtttttgcctgggggatggggctgctctgtagcctgcatgctgagagggccgtttgtacaaacgtccacctttcattaaagcctcttgctgtttgcgtcaagtttctgcctccgcatggtgactggggtggccacggtcctgggaaaagatcctggaggcctgagcttccaagggtcttacagtaacaagcagctaagtctgtgtgctgagccacaatctactgattgtctggcattgtgcaatggactgtcaaccaagatggcagaatttaggcagaatttttcacttgtcaaaactattgtcttggttcctgaggagactatcctccagcaatagtttacagtcttttaaaacagtttacctgagtggttttcctcactcagccactggtgtccatgtccttcaggacgataaaacattgacctcatagttggccatggtggttcccacctgcaatctgagcatttgggaaggaaagtttgaggtcagcctgagctctacagtgagatatctctcaaaacaaaaacaggtaaacaaatgagagtttacctcaggaatttaaaataagggaaatgctaggattccagacctgagggaggatagcccagggcttagtctcaagggtttctctgaatgagtcttggaagctataggacccttgggctgagctgagtggggaagcatgtgaggctgatcataaggggcaactctcagagcccagagtctgaggagcagcagccaggagaggggaatcaggaactcagaggtcctggatgccaagggaagacactgcattacaaagggaaggatagctcctgtttgcaggctctctagcttttccgggagacattgaaaataactctgcagctgcctaaaataagagtccctcctatttatatgtctcctctttcatgacatggaagaatgggtgatatctgctggaaatcactgtaatatccctcggttacaataaactatttgaagatccctgggggaggaagagccttgtctgctggaagacagggcactcaataactggggataaaaggacataaaaagagcattttattaaaaacacctttcttctctccttccgttctcaacttcgatttccttttccttctttcttttcctccttccttcccctccctctccctcccttcctccctctcttctttatattttgagatgggggctttgctaaattgtccagatcagccttaaactaactatacccaagcagtccctgaaatgataatgctcctccctccattcccagggagctggggttatagatctgtgtcactggctgctgtaacaggtttgtttttggttttgtttttacgtgccaggcactgttctgaggactctataacaacgagtcttttaattctcacagaaacttaaaaacattttttgtttgtttttacattttaaagtatttagttactttgtgggtggggtgggctgctccatcatgtgtggggggtcagaagaaagaattgaagatgcttcactctttctaccatgtgggctctggggatcgaactcaggacgctgggtgttaagtgtcttgacctgatgagtcatcctggggcttatctcacttgaacttttgagcataggtattgtgtttacaatttccaaattaaggaataccaggcacaaagcaagtgactttctcaaggacacagaagaacaaatggcagttttactctggctcaggtactcggcctttacctcagtccttgccccattccaacgtcatctccccaccccccaacccatttctctctaggaaaaaaaataaataaaaaaacaaaaaatggagcaaactaaacaacagggctggggctgtagttcagtgcagagcatgtacctagtattcctgaggccccggatgagttcccagaacaaattcgatgccaaatactggagaattatttcacaaattgtttcatcttccagaaagccaggctattgtaaaaacctgactgggaccattggtgatgtggaaatttgtagacattcggtgaaacctagtgaacctgacaaactcagaagatggctgtttgcattataaaaggattctttggcttcagggatggctcagctgttaagagcacatactgctctcccacagaacctgagttctgttcccagcacccactttgggcagctcacaactgcctgtaactccagctccaggggacctggtgccctttcctggctaacatggacactgaactcacatgcacatagctacacacacacacacacacacacacacacacagacaaacacacacacataactaaaaattaaaaatgagctctgttaaaaaaaaagaggcggggactctttgagactggtgatggtgtttacttctcttgcatgaggccctgggtttgatccccactaatgcatacactgggcatggtgatatgtacctataactccagcactcattggagattggaggactaaaagctcaaggtcatccttgactacataacaaaattggggccagcctgtgctatatgagatcctgtctcaaaaaaaaaaaaaaaaaaaaaaaaaaaaaaaaaaagaagaagaagaagatattttgatttggaaaataatcaaattcctgtaaatagtagcttgtttatttgacaaaatgcttggggtgggtgagaaaactctccaactaaaatgttcacagatcagtttgtcactttgaagaccaaccagaggctctctggcaaattattcctaaaatgcatgtaagcagtgagaaaagacatttgtattcacgacaccctttcaaatcattttacagtgacattcggaaaaatgtgtctctggcatgaagcctagcctgctcgtacacacggctgccacgtgaacagtctggcatggcgactcacaaggcattagaattggaagacagcatggcggggcatgggtggtttcactggctcgggagatgaagcacgtctttttactgacaggcagctagaccacagttctcattacaaacagcaagcggctgtcttctttatgcatgtgtttttttaaagtaaccacttgcttttctttcaaaaaatttatttatttaaagaaacccatttttaaacatttattcattttttttttttttttttttttttcaccatgctgtgcctatagataccaggggatgatttgaaggagtaggttctttccttctgcaatgtggggctcggggattgaactcaggttgccgggtttggcagtaggtgtccctgtctgctgagccatcttgcaggctcacaatttacttttcgatcatgattaaggtttactgtctttagaaagctctacaggtctccagggatggtcagcagtcacttgcaatgttagtttccccaaactaaaaaccatagctgtttacagagaaaagttgtagaaaccagtacaagcccatattcagcatttcataagaacaatttttaaattgaaaatagattcttctctcatataatacaccctgactgcattttcctctccctccacttgtaacagtcctccctccctttttcttcagaaaagagcaggcctccaagagacagcaaccaagcaatataaaacaaaataggagataaggcaaaagcgctcttatcaaaaatggacaaggcaacggaacaggaggaaaaagagtcctagaatcaggcaaaagagtcagaggcatactggctcccactgttagagttcccacagaaataccaagctaacagccataacatatacacagaggacttgatgtagacccatgcaggcaccatgcctgctgcttcagtctctcagcccatgtgagccctgcttagttgattcagtgggctatgtcctcctggtgtcctctatgcccctgactcccacaatctttcagcctccctcttcctcaggatttcctgaggtctctgaggggtgggacctgaaggagccctcctatttagactctctgcagagtgtcatgctgtgggtctctgtgtctgctctcatctactgcctatcgcaggaagctctctgatgaccacaaggcaccaatcatattcgtctttctaggtctgagttacctcactcaggatgagatttttttttctagttgcatccatttgcctgcaaatttcatgatgtcatttttttttaacagctgagtaatactccattgtgtaaatggaccacattttctttatccattcttcgattgcaggacatctaagttgtttctagtttctggttattataaataaagctgcaataaacatagctgagcaagtgtctttgtggcatgatagagtgtcctttgggcatatgccagagagtggtatagctgggtctcgaggtagatggattcccaattttctgaggaaccacccttttgatttccatggtggctgtagaagtctgcactctggccagcaatggaagactgttgcccttgctccacatgtttgccatcatgagctgtcatttgtggctttgatcttagtcattctgacaagtgtaagatgaaatctcaaagtagttttgatttgtatttccctgatagctaagaatgttggttcaacatttctttaagggtttcttagccatttgagattcctctgttgagagttctctggttagatccttaccccattttaaaattggattgtttggtttgttgatatctggtttcttgagttctttatatattttggaaattagctctctatcagatgtgtagctggtaaaacatctttcccattctgtaggctgctgatttgtccaattgatggtgtcctttgccttacagaaaatttcaatttcatgaggtcccatttattagttgttgatcttagtgcctccactatctgtgttctgttctggaagttgtcttgtgtgccaatgtgttcaaggctatttcccactttctcttcaaaaggttaagtgatttatgtttattaatttgatccacttggacttgagttttgtgcaggttgataaatatggatctatttttattctacttgcagacatccagttcagccagcactatttgttgaagatgctgtttttatccattgtataattttggcttccttgtcagaaatcgggtgtccacaggtgtgaggattttcaatgattccattgatcaacatgtctgttttgtgctaacaccattcagtttttattgctgaaggtctgtagtacaatttgaaatacaacagttcttgtagattgttcaggattgttttagctatacagggttttttgtttttgcatatgaagttgagaactgtcctttcaagaaaagaactgtgttggaattttgatggagattgcattgaatctatagactgtttatagtaggatggccatttttattatgttaatcccactgatctatgagcacgggaaatctttccatcttctaatatcttcttcacttcctttcttcaaagacttgatccttttatcatacaagtctttcacttgctagaatattttatattgtttgaggctgttgtgaaaggtattgtttccctgatttctttctcagtctgtcatttgtacttaggagggctactggatattttttagttaattttatatccagctactttgctgaaagtgtttaccatctgtagaagttctctggtagaacttttaaagtcacttatgtgtactatagtgtcatcttcaaatagtaatactttgacttttttctttccaattatatcccttttatctccttcaattgtcttattgctctagttatgacttcaagtagtatattgaagagaaatggagagagagagtggataaccttgttttgtttctgatgttagtggaatagatttgagtttctgtccatttaacttgatgttggctataggcttgttgtggattgactttattatgttttagtatgtcccctgtattcccaatctctctaggatttttatcatgaagaggcattggattttgtcaaggtcttttctgcatctaataaaatgatgattttttttcagttgttgatatggtggattacattgacagattttcatatgttgaatcatccctgcatctctgagatggagcctaattgatcatggtggatcatctttttaaggtatttttgattcagtttgcaaatattttattgagtacttttgcatctatgttcataagggaattttctctgtaattcttttcgttgaatctttatttggtttgggcatcaggataactgtggccttataagttgggcaatgctccttctgtttatattttgtagaataatttgaggagcattgatattaagttttctttgaaagtctcgaggaattctgggctaaaatggtctggccctggcccccgtcttgtgaaactttaaatgatgctttgattgcactaagggttacaggtatatttaaattgcttatcagatcttgatttaattttggtaagtggtttctatcaagaaaattattcgcttcttttagattttccaattttgtggagtatgggttttcaaagtatgtccttatgattctctagatttccttggtgtctgttgttatgcttcattgtttctgattttgttaatttgggtattttctgttcatcttttagtttggataagggtttgtctatcctgttgattttttcaaagaaacaactctccttgtttcattgattctttgtattgttctctttgtttctattttattaatttcagttctcagtttgattatttcttgccttctactcctcttgagtgtgtttacttcttttttgttctagaactttctttcaggtgtgttgttaagttgctagtatgagatatctccatttttttttttatttaggcagttagtcttaagaactttccccttaacaccaattttacaaatttgagtatatggtgtattcatcttcattgagttctagaaagtctttaatttctttctgtcttgacccattttcattcattaaagagttgttcagtttccatgagtttgtaagctttttgtggtttccattgctgttgatatctggccttaatccatggtggtctgatagcatgcagagggttatttaaattatcttgtatctgttaagacttgctttacatctgaatatgtggtcaattttggagaaacttccatgtggtgttgaaaagaagttaattttttgtgtgtttgggtgaaatgttctgtaagtatttgttaggtccatttggtttataatgtcttttagctccagtatttctgtttagcttttgtctggataacctgtccattggtgatagtggggtattgaagtcttctgctatcagtgtgtgacagtcaatatgtgatttaagctgtagtagtgtttcctttacaacaatgtgcacccttttgtttggggtataatgttaagaactgaaatgtcatttttgttgttgttgttgttgttttgagacagggtttctctgtttagctgtgggtgtcctggaactctctgtagagcacactagcctcaaactcacagagatctgcctgactcagcttccagaacactgggattaaaggtgtgtgccaccaccacctggcttaaaatggcatcttgaatttttcctttcatgagtatgtagtgttttctccatctcttttgattagtttggtttgaagtcttttgttaatattaaaatagctacaccagtttgcttcctaggtccatttatttggaatatcttttccaaccctttacactaaggtgatatatatctatccttgatgttgaggtgtgtttctcatatgcagcagaaggatggatcttgttcttgaatccattctattagtttgtatctttttattgggaaattgtgtccactgatattgagagatgtcaatgacaaatgatagttgattcctgttgttggtgttggttgtgatgtgtgtgtgtgtgtgtgtgtgtgtgtgtgtgtgtgtgtgtgtttcccttcttttggttttgctgatgtgagattatttcctgtggtttaatgggtgcacttagcttccaggggttggaattttccttctagtatgttttgtagggctggacttatgattagatattgtttaaatttgactttgtcatggaatatcttgtttttcatgaaatatcttgtttttttttcatctatcaggattgaaagtttttctgggtactctagtctgggctggcatctgtggtctgttagagtctgcaagacatctgtccaggaccttctggcttttagagtcttcattgagaagttgggtgtaattctaatagatctgccctcatatgttacttggcatttttcccttgtagctttaacattctttctttgatctgtatgtttagtgttttgattagtatgtggtggggactttcttttctggtgttctatattctttttgtattctgtatgcttcttttttgtttacttgttttttgtttgtttgtttgagacacggtttctctgtgtagccctggttctcctggaactcactctgtagatcaagatgtcctagaactcacaaagatccacctgcctctgcctcccaagtgctggaactaaaggtgtgcactaccactacccagcctgttctgtaagcgtcttgtaattttgtaagcatctccttctttaggttaggaaaaatttctcctatgattttgttgaaatattttctggacctttaggctgggattcttcttattcctctgtttccattattcttaggtttggtcttttcgtaaggtcccagatttcctggatgttttgtgtcaggagttttttgaccaatatatccatttattctattgactcttcaatgcctgagactctctcttccgtctcttgtattctgttgataaagcttgtctctgtagttcctgttcaaattcctatttccattttcaggtcttgagcagttttattggcttcctttctttaagggatttattcatttcctccaattttttgtatgtattttctggatttctttatgggatttattcatttcctctttaaggacctctatcattttcatatagttggttttaaggtttttttttcttgtgcctcagctatgttggaatatccagggcctgctatggtaggatagctgggctctggtggagacatgttgtcctggatgttattgattgtgcttttatgctggcatctggatttggagtgattataggtctaggtgctgatttctggacaaaactcatttcttccataatttaaaatactatacagcaatcaagcacttggtccattttaaggaacatttagatttagaacaagagtcaatcaactactgtcaccagagggcaccaatgttcaagttgctaggacaactgcaaactatagggtcacagcatcagggaccagaagggtgtcatctggggtctgtgcactggtctcatttaattctgtcagaagactgagttccttcttcagggaaggtctttcctgcatgctttcacggctctgtctagaatttaacaactctgctgccacacattatcaaagtagaccataggttcttccacctcccatgcatgcattgagccctttctgtgtaactagtaaaacagcagtaggcaacacaggcagagtccctgtcctcaggagcttgtacttcaagggatagaatgatttttaacaacccacccagccaaatacaagacagattccagaaagggcagagtaaacgtggtgggaatatctgattggaatgaggtcatggaaatataggatttcctggggacatctgtaacaaattgtgtagctaaagacaaccaaaagtgactgttctctctcacaggttctcatgtagcccaggctggcttctcttctgttacatagcccaggatggcttgtcttctgtgttaactgagaatgaccttgcactctgatcccacagagtgctagggttcacaaatgtgcaggttatgcagtttatgcatttctggggatcaagcccagggctgtgttcatgctaggcaagtactctaccaacagagctatgtcctcagctctgtattccatgtttatttaatgtatgtgtgtggtgggggaggtgacactttgtcacagtgcccatgttaaggtaggagagcagcttaaaggaaaaagttctctccttttatactatgggttctgggtcgttaggtttgatggcaggtaccttacccactgagtcatccttccagcaacccccacccccttctttttggttttggttttctgaaacagggttttttttgtgtgtagccctggctgttctggaactcactctgtagaccagactggcctcaaactcacagagatccacctgcctctgcctctggagttctgggattaaaggtgtgtgccactaccacccagggtcatcttcttatttttaactaaaataaataaagaaataaatatattttttgagagtgagtctcactatatagctcaggctggtctagaactcacactcccactgcttccactcaggaatactggggtcccaggcatgtaccatcatgcccagatcttttaaaggtctgtgaaggacagtgtctgcaatgaaacatccttagacccctcccagagagcttttccacttgtggtgggcccacccactccctctctgtgctgcctttttttgtcttctggtgcccatggtaccctgatactgcctgatggcacttagaactcatcagctgagctgtgtccctcctccaaatctgtctgctgaagccacaattctcagtatagctggatttcaatggggtaggggaatctgtggacacaacaaagcttaaatgaggtcccaagggtcaggtcctaatgctgtaagattgtgtcctcaggaagaaagaccaactccactcccgcccctccctgcacagagggtcatatgaggacacggaggaaaaacaactgtctctaagccaggaaaagttctcacctgaactcaaccttgatgctggatttcagatttcagaaatgtgaggaaaaaaatagtctgctctttaagacacacagttattttgcacaacagccttgtagaatctacagtgtagatggagattgcccacctgcctttctgtataagctgctcctcttcaagtagccacagtaggatattcatgggttcagagttaggacacagaacagcacctgaggtggggagaagcaacactggtgaattcactacagaaaggtgtggaggacgtgacaaaaaaagctgagcccaagtaagggctagaggcaaagagagcagggtatagtgtgtgtttgtggggacctttccaagagttgaaggaaggcccagcgtaagtggaggggtaagtgcaaaggctaagggagtaagtacactacaggaagagtaagactgggctggtgcagaggggtgaagggacaggtcagtggagtcctgtgagccctgtgggccatgagctgtgagccctgtgggcatgggcagggtctgcatcttctcttcaggcagtgtcaagtcttaggatgagttggagtgaagcccaagaactatacagagctcaggggaccagggctacatcttggatccagaatatccttccaaggttcctgttctacaggtttgctctctagacttcggtgagaaatggtgaagcctttaagaggcggggcctaatggacaggtcattgcgggagggcggtgcctttgaagggagctagttggactctacccctatcacctcatgcttccaccagaacgtgctgctgcagtcccaaatgtagagggctgagccagaataagtctttcttccttagatgttgttatcttgtcccaaatgaggtgtctatatcaactgacacacccccatagggactcagggaacatctcagaagaggaagtgtaaagaatgtaggagaatggggagaagagctgggaaatgcctgtttctggacatggcgtggctgttgtactcatggacttgcggaagctgggggtacctgcacagaactgtacaaaatcagccaaaattctggcatagatggggtagatgatctttgggacatgccacttactgaggagctcctggcaactggctgtttccaagggaaggacagtcgtcatttttcactcgtgaccacttgtaggatcccatgtcccaggggatggttctattcccatgcacatacgggctgcactaactggactggcttaatggtaattaaaaaaaaaagatgaagttgggagggggacatgttgaggggatataggagcaattgcagagggaaacgaagcacagttatggccatatttcattgtgtacttgtatgcagttatgaagaacaaagaatttttttaaaaaagtgggttatcttgggtattttgccacaacaatgatgagcttactaagaacaagttagggatattttagaattgactcaggaaaggttggtggcccggaattttcagaggtgcaggaaagaggacaggcacccagagggaaagggtctccttggaaatgtgtgtctaaagtggagttaagagaattggccatttatcagatctgagagggacgagaaaggaaggcctcagcctagtttaaggtttgtgctgaacggggtggtgaaagcacagctggcacaaggaggcagccctgaagctgagatgggagccttaggaagggttagccgaggactctgaggatgctggctggagggctgaactgggagggactaatgatgagtcagtctggggcaggatgactgggtctgagcatgatgactttgcaggagcagctccaggggaggtgtctgggtgcaggcagctgtctgaagccagcaggaagcagcagttaggaaaaagagtgatggggtggccagatttggagttggaagtgaagaagttcaggtcgaaagagagcgggctgaaggaagagaccaggacagagctccagaaaaatgcaagatgaagaaggagaaagagaaggtaggtgcagacacacacacacacacacacacacacacacacacacacacacacacacacagagagagagagagagagagagagagagacagacagacagacagacagacagacagatagagggacaaactattaacaccaagatggagcatgcattatagaaaaaggatggggaattgtttgtagcaggaaatgttgcctgtaggtaagacacactgtcctacagaactccacccagtggctctagtgacagccattttgtcatcctggcttgcaatgagggatccgggagctggggagacaagataactctccaggagaggaaggaaggtgttgggaatagaggagactggggagtgagtgagtgagtgagtgagtattgagtgtgcgtgtgtgtgtgtgtgtgtgtgtgtgtgtgtgtgtgtgtgtgcatgcacactcgcacacataggccaaaagttgatgtcatgtgccatactctattgttcctcaccttagttcttgagatagcgtcgctcacctcttgcttatccagagttcactactttggctaggcaggctggccagcaacccccagatctttgcctccagctccccagtgctggggttatagaagtgcctggctctgcttagctttcacgtgggggctgggatcgaactcaaatccttatgtttgtgtggcaggcactttcctgactgagccatctcccctgcctctggtttgacttacaaggcagtctgttatcgactcctctcattactgtggcaaaatatgtgacagaagacatgatttaagggaagaacttggattatggtttcctagacttcagtccactgcttttactttcgttcgttatggtaatgggagcatatggaggagtgtgttcacttaacgatggacaggaagtagacatgaaagaagggaccagggaccaattccaaccttcacaggcacaccccagtgatctgtttactccagctaagccctgtctcctgaaaggtcctccacctccccaaatggcatcactagtcatggcatcacctgaccctatgggggacttttcctatccaagctgtaacgaaggaaaccaaggagtgaaaatgcgacgtgcttaatgctgatggggagagtctttaggaaagagacgaaagggaagcgggtgggcatgcagctttggtgaaggatctgactggcatcctcttctaggtgcttctcttttcttctgggtgaagtggattggggtgatctgctggaggagagacctgcagtgtaggtagaggcacaggtcaggagagaaccaactccagagaccagggaaggctgagcagtcaaagatgacgtctgagaagttaccggatgtgagctgatcagaaggtaggaagctccaggcctgtggtttcagagaggtgaccatctggtatgacagggtcaagggtgtgtccctgagttcaggcttccgaaagagagagaaaaacagagaagtgaggtgacactggggtggataccaaggtcattgaagattcagataggacttggaaactagcattcaaatggagaactaaaacctttgaggaatcagtaactcacacagactggggttttgacgtaagtagcaagagtcctgtgatgggagatgtccttctgtgttctgtgaatatatgtttctcttattggttgatgaataaaaatgtttcggccaatggataggcaggatttagcctggcaggaagtataggtggggctaccagactaagagaatgccgggaagaggaagggagcaagtgagttgcctgagagatgccatgtagctactgggaaggtaggacgcctgggcattctctggtaagataaggccatgtggaaatacatagattaatagttatgggttaataattaagagagagctatccagtaagaatcctaagccatcagccaaacagtttgtaattaatataagcctcagtgtatttatttaggactaaacggctgagggactggttgggacagaaacttccatctatagacctggaaccaaggcatcagactgaatatgagaacgattttcctctggttgatgaagatttgcacagcctttgcaagggtctgttttcttcagactatgacgaaatgtacttagtcagatgtgctagagtaaggcattacccaaatactaccacatgatccaaccaattgtgtagtcaatgaatgcaacttgcccaaggaaagtcagccccacaagcaaactaagtcaagaatgtcactccaaagtggcacggtttccttttaaaataattaatgtttagttttgattttatatacttctacctagctaaactcaaacccacatgttagctctggtataatttaaacattttttcaggtattttatttctttgtgcatatttatatgggcaggtgctcatgtgtgtggatatatatggaggccagaaatcaaccttgggtgctgttcttctggtgccatctacatgtttatttttctctataaaaagtgatttatttatcacacacacacacacacacacacacacacacacacacacacacacttctactgcaacttttgggagtcaatcctttaactatatggatccctgggatggaactagggttgtcaggcttgatagcaagtgtcttcacctgctgagccatctcactggtccacatcttgtttatttttgagatagggtctctcactggcctggagttgaccaagtggtctagtctggtggtcagtgagccccagggacacacctgtgttcacatcattagtgctgggattacaagtacatgccacactccccggcttctttacttgtgttctggcagtcatacttagaagcccacgttggtaatgcaagcactttaccgactgagcacccggatgggttttaacattataaattggtctgtaggacccattacaagacttcctttcctgggtgtgtaatctagagttggtggaatctctgcctcaaatggtacaccttaaaatccatttctgtcttagtagaatttaaccataatagattttaatatctttattgaagactgatactaatctcacatactctgatttcaaattcaaagtaggcttcctcttgttatctctttcagagggactatttctctattccttacccacttggaaatgtaaacccaaagatcttcttattaaaaagcaacagacttagctggatggaggtggcacatacctttaattctagcactcaggaagcagaggtaggcagatctctgtgagtttgaggccagcctgggctgcagagcaagttccagatcagccagggctacacagagaaatcctgtcaaaaaacaaaacaaacaaacaaaaaaaaccaaaataaaaacacagacttaatagaaccgtgtatttattatgagtgtctacagatgggtcggtatttgaatactggagatgctattctagaaaaactgtcactgggacaagcaattattattagttctaacagataaaacccttcttgggatctcctctgatctcctaaatgaatttctgtttacaagtgcttcgttggtagcaagatatagacttcagagtcattccagaccattagatgagaattcattattccaggctctggggtaacatttgatacatatcaaatttaaaatcatgaagtccccataaggtatttaaaaaaattaatactgttctatgggctgggaagtagcccagagagtctgtgtacttgcatcacgaacataaccaagtgagcaaaacttaaattctaggtagaccagtctaaatccagaatcctttcatcagttgtgataagaatgcatgttgcacacacacatacacaccacacatatgtgtgatgtgtgtgtatgttaataaaaaattttgggacaaaagaagccaaaatggtgagacatcattgtaaagagatctgttttctcaattttattatcagatccccagaaacccacgtaaatgctgggtggcctgtctgtacttctggccctggaaagcaggaacaggggacctccaggacaaactgctactgggattattgctattattattattttgttttttcaagacagggtttctctgtgcatgcttggctatcctggaacttgctctgtagaccaggctgacctggaactcacaaagatctgcctgtctctgcctcataaatgcagggattaaaagtgtgtgccaacaccacttggcttactgagactgcagaataaggaggaagaatgatcaagaatgattccaaacactaatatcgggtctccatgcattagtacaatcacacctgtatgcaccctgtgcctacacacatggaaaagcatgcaaacacaatacttgtacaacacacacacaggcatagaccaaaagaaaatgatgggaaaagaagaaaaaaaagtctagcttgactgagacatcgtgttcaccaactgctacttttttcccccaagacagggtttctctgtgtagtcctggctgtcctggaactcactcagtagaccaggctggccttgaactcacagagatctgcctgcctctgcctcctaaatgctgggattaaacacatgtgctaccattgtctagccaattgctagatgccgcgaccgcctggaccagcaaggatgacgcaacaccggagctcttcttgcaagcagtttattcaggaccttgaacagcgatctctctcctcgggcaagcctctccaagcccttaaataggtatggaccaccaaccctggattgctacgtaggcaccgtccataggtccaacacatacgcaagcgcttacgatcatctggccttagccatatgtggagttgtttttcgaagagagcgctggctttcaggatcgcggagggcgggaggcagcgccatctttaaagcgcggctccacgcagctctctacagctagatattattcagtgtttccattttttttgaaaattaacatggtgacacctttaatctcaccatttggaaggcagaggcaggtggacctctctgagtttgaggccaacctggtgagaccttatccttaaacaaaaataaggtaaaaatagaataggcacaggatttgcactcatcaaccctttattttcctcatttttccacttagccatttatcttgtctgtcttctagaagccacagagattttaaattcttgctagagactgccagcacctgtagcacccttatttctgcatctagttacccttgaactttcatttcttaaatgaaataaacttatttactacataagtaagcttccagcttcccttcctgtccagtggcacctgatttacaaaaagggggactatggttgtttcacttagaagttcctgatccactgacctcaaggtggaggtggaggccactctgagaaggaatggagaactgtaagcacttcttttttttgcaggcacaaaactacacatgtgcattttggaacaatgtcaggcctatttctgagtcctgaagctcctaagatgccagtaagggatgtggaaatgccccatattttttgttgcctggagttaaagtatacataaactggtatatatgattcttaccttattgaagaagggtctgaaatggcacctttctcccaaacatgaacaatacttattatatttatgttgctgtaacaaaacaagttagtgaagaccatagatttatttcttatagttcggagagctgttgaggtcaaggttaaggccaacatactagctgattcagtgtgtggtgaaggcttgtttgctgtttacacagtagcaccagaaggactctgtgctcacatggtagatgacagaaggacaaaagctcatctaattcccctgagtcttttcacacaggtgttgatttccttgatgagagccgggcccttcatgacttaatcagttattaaagggcccctgcatcttaatcctgagtttaaactttggcctacatccaaacaatagggattttctatatacaagatatttcttcatgtgagtttgcgtatttgtgtgtgtatatgtgtacacaggtatgtgtgcatccatgtggaggtcagaggttgatgtcagggaatattctttgatcactgtctaccttatgttttgagacagggtctctcactggacttgaagtgaactgattgtctagactggctagttgtcaaaccccaggggtcttcctttcttcacctcctcgacaatgggattgcaaatgtgataccatgcctggaattttaattgggtgctggggatccaaactctaagtgaaccatttcctcagagccaactacattagatagtcatgttaatatcatgagatgttaaaaaaaaacctaagattgtgtagatataaaagcaatgtccattctaggagcaagagacctgccttttctggctaacctgatggatctaggtgacccacagctatacaatttggccatgctattggtaacatttgccatttttcttggggttgtataaagtctcccagtgactacagttcccttggtggccatttgagtcacagggaagaaaaataatctccagaaagcacagaatgaataatggcagcatggggaagagatgctcatggttatgacccactcacagatttttgaaatataggtcagatggagaggaagtgaaacttcctgttgaagtttcatttatagcatgtgtctggaaattgctaaatgtaatttcttggtgtaaaataaactgcagaaatctgggttgtgtccgtctgctgtatgtttatggaagccattctgtctgaagctgagatgctgtgaaattatatagtggcatgaacagccacaattagtgtaacagatgtgaccctcttctccaactcagaagctgtcaggatctcagcaaccggatccagaaactatctgggaattcctaaaatccatacaatgctacccatgtgaaggacaacatcaacgttttatttgctacacattcgtttgtgtgtcttagtactttctactttccttttttagtgacttaaaaacaataagcatggggctagaatgatagttcacttggtaatgtgttagcattgaggttgagataagaggatttgaggtcctgtcaaatggatgaattccaagtcccagtgagagacccaatctcaaaagtaaggtggtaaaaaaaaaaaaaaaaaaaaaaaaaaaaaagggcgccagaaagatggctcagtggataggatgtctgttgtgggagtgtgaagactagagtttggacatctccaaaccacataaaagacaggcagacaggcgtggtggtcacttgccagcccagtactggggtgggtagggacaggggattctcagggcaagctgaacagccagactagctggaatgacaagttctgggttctgtgagagaccctgcctggataaatccagtgaagaacaactaaataagacacctgatatcaatttagggcttcaatatacatgtgcttacatgtgcatgtgcatgtgcattcccacacacacgttccccccttgtcaatgtacacacacacacacacacacacacacacacacacacacacacacacacacacacccatacatgcacatacacacatacacacacatgcatgcacacacacacacacacacacatgcatacacacacacatacccacacacacacacacacacctggactttcacactcctcctgtgtatatatgtacgttctctcctacaaagcactacccaaagagaaataacatctagaagatttgaattggctgggaccccttgacatctagaggtccccaatggtggtttcacaataaagatgggtttgaggaaaaccatataaatttcttcaatttgatgtgataagcatcacccttgactttgcctacagtacattgcagtgcctggtttaagggagggctctgcaggaactagtgttagcatctggtggcttcctggtgccaggatctctcacctggaaagtgaatttacatcaaaatccatcctagtggccacatatctggttccccaacccttttcttgcctcctgctggagcctgctggcaggcttgtgctgtgggaccttctctatcctcagaaagatacaataggggccgcctctgtcactgctgcctcctgggctctggttcttgggtttagagacaccaccacattgtctgtgtctagagctggggtctgaactgtcctcagagtccccctgccatgatgctgtctgtctctctctttgcccgcctgtccactgcactgaataagtcctgtgaccttagggagcaatctctgtctcagtgttctctatcacatctgagacgctggtctaacaacgcagaagtgctccagaggctcctggccaaaatgtcctctcattggaggctgctgtatttgcagtgaataccctgaagaatgggcaccatatgtgactctggcacaaaacgcacagaatggaattaaaatgggtccttcatacttaaaccatcaaactgtggagcaacttgtgtggaaatctttgggaagaatgtgggagaatgaatgaatttctcttagcatgagagtcagagtcaatgagcactgtctgttgtttgctcccctggacactccagctaatgcagcatcaggaaaagtatctttattgttataattattattgttatcattattattttggtttttcaagacagggtttctctgtgtagccttggctgtcctggaactcactctgtagaccaggctgaccttgaactcagagatccacctgcctctgtctctcaaaggctgggattaaaggtatgcaacaccaccacccagccagccagccatacatacatacatacatacatgtatatatatttttaagatttatttatttattttagggccaagtggtggtgatatgtaggaagccggttcctgcattataatgctgcctgaagacaccaaggtgtgaattacttcacaggcgccgggttatctccattcctttgatctctgcctatcccgtggctcattttagcctgaggagctgaagccattcatagggtaatacgtcccaggcggctggtcagccttttatatagggatggttttcttggttcaatgtctctgctcagtctctgttcagtctaatgcattaaagcttgtctgcagaaggatccgagtgtcctgcgtgtatttcttgctggcgaggaatacagagcgggcgcgggacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatatgtaggaagccggttcctgcattataatgctgcctgaagacaccaaggtgtgaattacttcacaggcgccgggttatctccattcctttgatctctgcctatcccgtggctcattttagcctgaggagctgaagccattcatagggtaatacgtcccaggcggctggtcagccttttatatagggatggttttcttggttcaatgtctctgctcagtctctgttcagtctaatgcattaaagcttgtctgcagaaggatccgagtgtcctgcgtgtatttcttgctggcgaggaatacagagcgggcgcgggacagtgatacacacccttaatcctagcctttgggaggcagaggcaggtggatctctgtgagttcaaggccagcctggtctacagagcaagttctgggatagcaagggctacacagagaaaccttgtcataaaaaacaataaaaatcaccaaacaaccaaacaaaaaagatttaattttttgtgtatgggtgttttgtatgcatgtatgactgtgaaccatgtgtgtgtctagtacccaaggaggtcagaagagggtgtcagattccctggaactagacagacagttgtgagttaccgtgtagtgctaggaatcgaacacagatctgcaggaagagtaacctgtactcttaaccactgacccatctccagcccctatattctaagtactaagtctttgagatccagttttccactcctagtgcatctcagttcacactagttatgccagaagtgcaaagcagccactggttaaatgtttattgtagtggacatcaagctctgtatggttcatcatcacacaaattctgattcagtgtgccccaattctttagagctgtggtgagagtcagaattgccatggaaacagacctctgggcatgtctgctggggagtttctggatggtgttaactaaggtaggaaggcccaccctaagtgtggcgacaccatttcttgggctggaatccctttctgagttaaacaggaaacaagctgaagagcagcttctctcaccctgcttcctgactgcacacacagtgtgaccagtcgcctctcctggaccatgtattctttgttatgatggactataccctcaaactgtgaagcaaaataaaccctttcttccttaagttcccattgtcaggtttttttttttttcttgtagtgagaagaataactcattcaagtgtttttcaaactcttggattttcccatgagacattgtgttagtttcttttctgtggttgtagtgaagcaccatgaccaaaagcaacttacaaaagagagtttattgggttacagttccaccagagtaagaatctgtcatggcagggagacatggcagtgagtgacaggcagtgagtgacaggcatggaagtgagtgacaagcatggaagtgagtgacaggcatggcagtgagtgacaggcagtgagtgacaggcatggaagtgagtgacaagcatggaagtgagtgacaggcatggcagtgagtgacaggcagtgagtgacaggcatggcagtgagtgacaggcagtgagtgacaggcatggcagagagtgacaggcatggcagtgaatgacaggcagtgacagtgagtgacagacatggcagtgagtgacaggcagtaagtgacaggcatggcagtgagtgacaggcagtgagtgacaggcatggcagtgagtgacaggcatggcagtgagtgacaggcatgacagtgagtgacaggcatggcagtgagtgacaggcagtgagtgacaggcaagtgagtgacaggcatgacagtgagtgacaggcatggcagtgagtgacaggcagtgacagtgagtgacaggcagtgacagtgagtgaccagcatggcagcaggagcagggaactgagaaaccacatcttttcatgcaaatatgaagcagagagagaaaacaaactggatgtggggaaagactatgagatgcttaaatccagctttgagtgatgcattttgtccagcaagatcacacctcctaagcctccccccaaagagccaccaattgggatcaagtgttcaaatactaagcctatgcagagcatttttattcaaaccactacagccatctgtacctatgccagatatattgtaagttacatgcattatgcatagttaacatatatttatccctctaattggtgtggtccattgatgtaattcttttgtcgtattactatgacaattatgtgcattagcatactgctgtgactgtctttttcttcagagcagcgttgattctttctctttgtgtgtctctccttcatctcctattttgtttcaggattatagaaagtgaggtggggcaatcttccttccttagttggttcaggaagggagttcacatctctttgccgctttccagtatgcacatctcacctgggggcacctctgttctctgtgatgaagtccaagttaccactcctgggttcaaagcacaggctctgagaatatgcacagaaggagccaaagatgtcagagggaagcttgaaactgctgagaaagcacctttcagaaaggctttggcaggagaaaagaaaaggaaaacaacccaccccattattttggagactaaagaaaaggatgtaatagcacaatacaaagcacatgcaagaatatggatgtagttttgcacacagccccagtggctctgagatgataatggaagtttactatgggtctgattacaaaggtgatgggctggatagaattagggattaaacctgaagttcccagcccatatccagcaataggaaacttgacaagtcacgtcaccccaagatccttgaaggagcacagcagcaagcttattagggaaagggtgttgggggagttgcccatagccagctagtcaccatggcaccaaggatcagggagccttctaagaggtaatgtccttttctttgttatatcagctggcatcttgctaggggtggtgacttgtcaggaagcagacctgttgctaggcaaccaaggaggctgaggaaattcccctccccagggagacagaatgccaggggcctcaagaaggatttgaatattaacaaacaaacaaaaatgtgctgccttagggaggaaaaaaattcttttaagaagattgattcatagaaaattatgacctgggcatggaagggaaggaaaagaagaataaggacaaagatgaagaaggagcaggtgtcatgttagacacacacacacacacacacacagacacacacacagacacacacacacacacacctcatctatgtatatggaggtgcgtggattgcagcaaacattagattattacttttcttggtgctatgacaaaatacctggtaaggagcttcaggaaatacacactggcttgctgtttaagtagacacagtccactgtggtggtgaagacacaagggtggctttgtggtggcagtgggggtatgcaactgggacttctcgtctccttggatcttggggaaataggaagtggagagagatggatttgggtgttcttaggcttcctcccttttattgttatcagcctccagtttatgagatggtgctgcccacattcagggtgggtcctccctcagctaagcctctttggaaacatcctcacagacacgttgaattgacaatgaaactcaccacacagtctgaggggactctgcaggtgtcaaatcaagcaatgaaccatgaagagagggcagcacaaacctcctgcagagaccaaacttaggtgcttaggcttggtagaaaatgtttttacccaccgagccatctcaatggccatggaatttcttaaaggcttccttttataccatagagctgtgtcgatccagccaatcatgtatctgggtatcagaattcttccagaagaatgggctttctgcccatccccattgtcagctcagttgagagtttcacacatagctggtgactgggcatgcagcaccaactggagttgatctattccgagggacaaaccttaacctagtgagtctttgtaaattagaaagaaattcattttggaatggttcttcagtatacgtgtagttttagcaatgatgaagataaaagcaaatttgcgtactgagaaggatgtctgtcacaattctaacacaatgcctccctgctggggaatgacagttggtaaacactaactagtattaaaagtcagccttctgcaattgaaccatcacatttttataaaagtgaggtttgttttcacagtaaaaacactgtgattcatagcataaatggtcttgagtctgaatgttttaggcagtgctccttggtgtgtggtgtgacagcatgcacagtgtgcacagttcatgctgtgtgtttagatcaagtctgctcccaagtcatgtgatgcaacaccttcaagttctcccagaaatgcctcaaattcattacattgttttctttttttttttttccatctctgtgttcaattatcacctatggtttaagaagcacctagatctgatcttctcaaaggagagctgattctgcccaggaaatggctcatccttagttgaaggagagaatgaatgaaaaaccccagggttcatgtttttaaaggggcattcctaaatggtgactttgtgacagaaagctctgctttcttttccatgtttcagaatttgaggagggacgattctttatttatttaggtttgttttttttccaagacagggtttctctgtgtagccctgggtgtcctgggactcactctggagaccaggctggcctcaaactcacagagatctgccgcctttgcctccccagtactgggattaaagatgtgtctctaatgataagcagaggtttaaggactcagggacagtgctgtacaaattgaatgtaaagaaaaaaaataaaaaggaaaggagggacatgactgcccctaggtacagtggaggagaaagttgtagacatgtggaaaagactagtcagaggcagggacctctgggagagtccagagtgggcatgagtgggctgagctgggccatgtgggagacagggaagggaagggagaaagaagaaagggagagaggaggaaggggagaggtgcagcagccaggaggccaaaggtcccaaaagggaagggtaactaaaatatccggattacatagggaagagcctctgggggaagggaggagagcccaggctagagggtgttataccagtcatactctacaaacagggtgggggctgagggattctgggagagcctggcagcaaggtccagctttgatgtgttaaataggcatcttagccagttgtcccaggcttaaaacttaacacaagccaggcagtggtggcgcatagctttaatcccagcacttgggaggcagaggcaggcagatctctgtgagttcgagaccagcctggtttccaagagctagttccaggacagcctccaaagccacagagaaaccctgtctcgaaaaaccaaaccaaaccaaccaaccaaccaaacaaacaaaaaacccaaaaacttaacacaaataataatttcaggaaatacagttttcaaatgacaatgttttagtgttttagataaaattgtaaaccaaagttcccaggagagaagctttccctaggctaaggattctacaaggctgattgattagaatcctaagattatggagagctgcagtgttgcaggtccaggaccaggttatcctgctctgcctaagagcctgtatccagtccacatccttccaactatcaggtaaaacctctgggatgtactgaaataaccaccagcagcgtttatcagccccatagctatggatgtcagcatctaggacttctaacagtggctccccactttactgtcaccccacctgctatttctaccattgcatttgataaatgctttggcttatgacttactttgttttataattataacagcaatatataactgcttccattttgaacatgttatttggataacctggatccctgctcctaggtcacttagaataaagtctcttcctacctttgaagtaagaagagccaggttttgcattaatgaaaatcaaaggccaaacaaaacaacactggaaagttcatccttggctaagatctagtggagccggaacccacttgaaagtgaccatcctgtaaaataaggtaatttttatgtttgctataatttctgaacacaacaaaaccaaagggtgatctggaaatccttagccagatcagaagaaaagactggaaacaaaccaagatactgttcttctgaacatgctgacaccacccagttttaaagagtgggcatttatattccagttgcaagccaggatagtaattgccttgtttaaacagatactcctagtaagaccacttttctctcttagcagaccaacctgctgcccctaagagagacagcctctgaaggaagatgctcaactgtttatcaaggcaggtcttcccccaaggttaccccactaggaatttgtgagcactcaggcattttaggccatcatgtgctcagagagtggcagaggaagctcgggggaaattctttaactcccgtggaatcttccttaagccccagcattgcagaggccatggtgggctctttggtggctgagcaagcttgcaacagagatcaggggagcccaaaaagattcttttgatcctgactagaatcaagaggaatgaaattctcagtgcttaccatggaattctaagaatctaaactggggtgttaaaagctgatggggtcagggctggagagatggctcactggttaacagcatttactagtcttgcagaagccctgatttgttttttaagtgcctttgaataactccaggcatatgaatgcatgtggtgcatacaaactcattcagacacttacacacatacacaaaagtttaaataaaacaaaactgaagaatagttttgaaaagtatagtatagaaaagtacagtatagaaaagacttgcctttgtgccctgtcctgacacatagatatccaggtccccactgggccaccattctgcctttccccttctgtctctcactgctctagagcttactttatgaaggaaagtgtagccccagtatccagaaacacccttggttttcttgtaatcacctacgatccaatggactcattggctcaggctgtgtagcaaaatgctcagaatgggtgctgtaatcagtaagcttcattttccgttctgaaggctggaagtcaagacggaagggtacaaggataggtggatggtgaggaccttcctggcttgcaaagcactgcctttggctgtgtactcatggaacctcttttctgactttccccccctctcttgtaaatgtctatcaaaggcagcagctttgggctaactgggcaggagagagatggtgaaagaggaaggggccccaaagcaagagtctggccgaagcccctcagcattgcacttgggagtcaagaattccagcataattaacaaagcttgctggtttgcctaatgagggataattttccttttatatgtagagttcaaccaagaatgttaaaatagtaacaaataacatttaaggtctaagtgtgtatgaccaattatggcctatgtcttttatcagctgtaaacctaccgtttttggttttttgttttgttttgttttctggggctcttacaaacaagtctatgaataccatttacagtaaagggtaggtcttaatctccttgtgtagtctttgtgacccacagttataccatatcagattgaaactatcctattatctcatttatgaagaatagagaaaaagtgtagggagttctttagaaacactttgaagaaggctgtgatgtcggctcagtaaacgtgcttgcctgggaacctgagtttgattcctagaacttatgttcaaaataagccccagacttggtgattcaaacttataaacctggggatgtagagacaagtaaatccctggtactctctgcccaaagagcctagactaatgggtatattctaagaaagtggacactgtctcaaaaaagacaagtggacaatgccaaaagaacaacacaaatggtggtcctctcatcttcatttgcacaggcatacatacacacctgctcacactattaatcccactgacagaggagaaagaccactgactcaaattatagccaaagcaaagcaagctttcttcatatacatgggagccagcagggggctgtctcccctaagggcagggttcaagagatcaggtgtgagccagtttctcaagccccttttaaaggacccccctcccccacagcgtatggttacagaagcaaggccaggcagttagaaaagtctcttttggaacaatggatacacaggaacacatgtacaaaaggtgggaaaaaggaagtcttttgaacaatacaatttcaggaacctcaaaaactgatatgactgatgcaaaaacatgtcagtgtgactcttttgaaaaggccatgccccatccttgggttagtacagtcctttacctgagcatgtcttttggtttgccttggcagccagagtcactcccttagccattgcagaatctcttgtgtgttgacccaatgtcacaagaaactgaatgctgccaattggataaatctatcactgtgtttacaaacagatgccccttccctgggaatgaaaatggccaggctaatagaacatagagctgcaggagtgggaagctaaactttccatggagggccactcagcctaatgggaagaggatccacttctgtgaaacccacttgtaggagaaaaaggtccatacattagtggatataaaacaccaagcagccagacctggtggtacctgcctgttaacccaactacttgggatgctaagggaggagagtcacaagatcaagaccttctcaggtttcagggtgagttcaaggtcagcatggacaacttaatgagccactgtctcaaaacaaaaaataaaaaggttgggatattgctcaatggtcagtgcacgctagcatttgtgaaacactaagttcaatgccttatacttcaaattaatacagcaaatgaataaataaacagctaagcatagtggcacctgtcttttatctcagcactcaggaggcagaagcagatggatctggtttacatagtggttccaagccagccaggatacttggtgagagcctgtctcacaaagcaaacaaacgaaacaaaacagaataacaacaacaacaataaacaaataatcttgcaatttagaggtatttccttatcccctcaagctagttattgcaacccacgtgacaccatcaatcaacaagacaccaaaagacttctagaataagggcatggctcaattggccaattggttgcctcagataaaaatggtccatgagatccaggtgcagggtgagggttggacacaatgctcctaattcttagaggaatgtaagaacctgagttctatcacctaactacctgtggctgggtgttgggactctggctgaatatgcctacaggcagatggtaatggtgagagtttggggtctggtttctgagcatacaattgcctttccttcagatgaattttctttctgtattactgttttagagagggatgccacactgtactgaagccagtctcttttctctgttagcctctgtttactctgatggcacacttccccaatgcgctgcactgcaggctttccttcctctcttctcattgcttgagttcgttcacccccactgtcctcctttctctgtggatcacagtggcagctttcttggtggcttccctgcctcaagtcccagcacctccttcaaattcatcataatacaagaccctgtgatcttactcttcctgaatcaattgcattttttttttttttacttgagaggcgttctctccaccaagaacccatactcactattttttcaatcacagtgagtcagttctcagcccccaaatgtaccacacctcacacacacttatgcttttgtgtgttctttctttaaaaacaaacaacaatgaaaccccctccaaactctctctctctctctctctctctctctctgtgtgtgtgtgtgtgtgtgtgtgtttcagaggacaacttagggggtcagtccctgccttccaccttgactgagacagggtctcttgctgctgtctctgctgggctggctgggctgtgatcttccaggaactctcctggcttagtctctcatcttgccatgggattgtcaagattgcagatgtgtgtgttactgactcttgagttctggagataggaacttggcaagagctttgcccactgggccatctccccagccctgccagtgctctttccccctcctcctccccattcatcttcacacagactttaaaaccaagctcatgccacctctctgctcctatccagccctctcatatagacagctaccccccaagtcttcctcaacactcagtgcaaacagttcccatgttaatttcacagaaggcctctaataatgggtttccttgtccatctttgtcaccagaatgtgagttctgtgtctcaactgtcttgagtcctcaggtctcagggcaacacttgacctgttctaggtacacaataaaaagttgtcatggataatgggggctatttcctttgaagaaaaatctgtctaaaccatcttcccattttaaaattaggttacttataggtatttgagttgcaggagtttgttggatactctgggtagcatcctctcagcagacacatgatttgtgaacacattttcccactctgtaggctcagtggccatgtttttgttacattttgtagctctgacctctctctattctttcttactcaagcctcctggcatggtgatttcttgcttatatcttgatggtttctacatatcttctgctagtactagtattgaatctgtgacttttctccttcctgtgacaaaaagcctgacaaaagcaacttaaggtaggaagggtttgtcaccactggaagtcatggcagcagagggtcaggttgctggtcataatgcatccacagccaggaagccaggagagctggatgctggtgcttagcttgctttctctcttttcctgagtctgggaatccatgagcagtatactagccatcacactatcttggatttttccacctcagttaaccagatctggagactgatgcataggcatgcctggttcccacctcagttaacccaattcagagactgatgcataggcatgcctggttgtttgtctccactgtcattctagatcttttaagaaaattgttagcaaatattttaggattgatttacatgtagctgtaggtgtctgtgtgtggctatgtgtcctcctatgtgactgtggaggtcagaagagggtatgagatcctccagagctgggattataggcacttgtgagcctccctatgcaggtgctgagaattgaacctgggttctctgcaggagtagtacttgctcttagtcactgagctgtcttcccagccctgacagtaaacattaaccacctgtgttggctaacctcagttttcaacttgacatctagaaccacatttgagccaggcaggcctgggtgtctgcctgtgcacattagattcattaattttgattagattgactgaagtggaaagccatgccactgtgagaggcaccatgataggctgtacttccccctgtgacccacttttcttcttcttcttcttcttcttcttcttcttcttcttcttctcctcctttttgagatagggtttctctgtataaccctggctgtgctggaacttgctttgtaggccaggctggcctcgaactcacagagatccatttgcctctgcctccagagttctgggattaaaggtgtgcaccaccactgcccggcttccttttcttctttaagttgcttttgtcagggtgtttttattacagcaacaggaaaagacatgaagactgcactgcaagtgtctttatggcttgttgatatttcttctaggttgttgtgatgtgttgtacttttatgtgctgtactgtgatatgggtgttctataacttgccatgtgtatgttgtaatgtgcattatatatatgtgtcttgtaatgtgtgtgttatatgtgttatgtgtatgttgtgatttgctgcattgtggtgtgatttctatgttgtgtgttgcatgtgttgtgttgtgatataatgtggtatatgtcttgtgatgtgatatatgtattgttatgtgtgagttgtatatgttcagatttgctgtcctgtgatgtatgttgtaatgtgtgtgttgtatgtgttgcactgcgaggtgatgtaaatgtggtgcatatcttgtgatgtgtgtgttgcatgtgttgtcatgtgtgtgtgttgtgatgtgctgtactgcaatgtgatgttttgtgacatgttgtgtgttgcaggtgttgagatgtgatgtggtgtgtctcttgatgtgatatgttcagtgtgtgttgtatgtgttgtgatgtgtgtgtattgggtaggtgtgcaggcaggggtgtgccagggaaaagaccttccagtagctacaggggagtagtgaagcgttgagcctctccaccacccagtttgctgctgccctctctctttagaacattctattcagtgacgtgggtgggattaacgctctgccctgtgtcagggatggagagaaaatagaatcaaatgtgggttagcagtaggatgcggaaggaagaaaagctaattcacttatagcctgtcgagagccaaccaagtatcccggtgggagacaggggcagacagaagacttcactttcttaaatagaactctgttttgacattctctttgctgcagctcccccacgcatgtctgtctcaagagcaccagtgagaggcaggagtttgcctctcgttgccccatctggtggcgaacctggagggctgcaggctgttggagccctgagccaggtcaaccccaacctgggtcttctcccaggaccaggagcaagcagaggaagccaatatacctggaggacagcaatgacaaagttcactgggctggagtgagagacgaccggacttaacgtcttatcaatttggtcagcttaggaaattctttgtctttttgtacttcattttcttcttggaaaaaaagtgggttactgtgagattttgtgaagttgtgtcaaggtaaaagcacccagaagagcaggcagtggatcctgtggtctcagtaaaggagtcacccctcttccttgtttccctccccacctccaccctgtatttcccccctaacacgactgtgtatctggccagaagttacttctgctataggcactatagctgggaacaagagtaagaacctgtgtgggaatagtaggatcaaggcatggagccctcagtggatctgggacaccaccaaggtcctgcctttctgcaatgtgaagccttcctggaactttctgtttcacaagaggggggacattctccatcaccttagacatccaggcataggaaattatatgtttctaatttgggagttgatggtgggatttgaacctggggctgtgtgcttgttaggttgttctatattattattattattattattattattattattattattattattattattaccattatttaggtccagggtcactttatgtagctgtagctggtattaagctcatacagatcctctcttcctcttgaatgctggcattaagtgtgtgtgccaccatacctggctgtatcactaatttataaggtcctgtccaggtctgggctattactaattttatgagctaaagcaacatttacaagaacaaaagtcaaaagcacaagtgactgaatatcttgaggaagacaagcattacacacatatagaccttatcatgtgggttaaaggtgagagggagggcaaatgattcctacatattggaaacaacaaaatattaatattttcctctcatggatttttcttaaacaaaacaatagaatggtctcttgacagaaaactttgggatctaggcatgtgtctgcctgcagaaggtggcttttgcaggaatcttgctcttcctgtagctgttgcctctgttccttctagagactattttggaaatatatgactcagctggtgaacattcccaacctggtatgtggaaaatacctcccaggcgaggagactcacacaaaccccgagtcttctccaggggctgcagtgttaaaatctgtgactttgccatggttttggtggactggatttttgttgtttctgttttgagacagggtttctctgtgtaacagctctggctgtcctggaacttactctgtagaccaggctgggctcgaactcacatagatccccctgcctctgcctctccagtgctgggattaaaggtgtgtgccaccactgcccatctattctatttgtcttaactgagttacctgtcatggtccagctttcatcttatcaagttgcattgtcaccagaccacctagtggctcaattgagaaaccagaaatgacacatcctgcctacttccctcttcctccatcgttcacaccaaggtatcctttctgagattattgacctcacctctgctcagagctcactgcccaatgtttctcctttgttccactgtagctgagcagcttgtttgaggtgtggggtatggggtgtggggtgtgtgaagtccctaagttgttaacttgcaatgggacctttacagtgactattctagtgtgacaaatcacacctaaatttagggctggaaacaacacttaactctgctcatgggttatgtgggtcagtgggactggcttgtctctcagctggggtcacccaatggctaggagtgactgcatggtggtcagctagaatcatgggaaaatatcttcagtaggatcgagcagatcctgttagctgttggctggcctttaccactgaccatatacaggggctcttcatgcggcccacacttcatctccagcatggtgctttgagggaggaagctgacttcctacagccaaaggttccatgtttgtgtacgccactgagcaaagcagacgctgtgccagttggtcctggaagtcacacagtgtcacctctgtctagtacagtggttacaagtgagttaaggccactctagactctcaaagctgatgtattcataacatcaaactcacaaggagagacatgttcaagggtgtggagataggttttaaagctgctacagggagattgtccagtaggaggcagggcataggattcgaatcccttctctcctgtcctcccagggtggatgctgtggctgcactgttctgcagaaccattttcccacacagtctatccaaagacctactgagaggctagctggggatgcctgttcagtgaccggttctcacagctcatccgaacagtggcttggcatggacacactgtttttctgcctgggtttctggtccctcattcttcctgctctgttgatagaccacccacattgaagtgttgcctgactgctgcccccagtcccactgatgtgaccctccacatcctccatgccctctaatcccactgatggggtcttccaaacctctttctcatccattgactttttgtgtccattctgacagtccaatggccagggtaccctaatacactttcctaaacagaccccttctgatgtacagtggcaatactgtctcattacccataatgatgtcacggtgactctttttttttttttttcttttttagtttatcgagacagggtttctctgtgtagccctggctgtcctggaactcactctgtattcaaaacgatccacttgccttgcctcctgagtgctgggattaaaggcatgtgccatcactgcccggcatcacagtgagtcttagggcaaacctcctcaccaaattttccagctaaatgtccgtggatggctttgcaagcctcggcaccatggacattgtgagcaggatctttctttgttgtgggccgtactgagcattacaggatattcagtagcatcccggcctctacccactaggtgccagtagcatcccactcctcagctgtgagaaaagaaaagtctctgacattgtccagtgtctagggaggggaactgaccccagactgagtgcctctggtatgaggtaagcatgcttagagtggccctgtgtgggcccatcctggctcctctgccctcccacatctccaggattctttgaccatgacatatcctttccctccttaagcatttttactgctgttcctttttgcctgcactccaacacacacacattctgtctctcacacactcatatacacattcacacactcatactcttttataccctcactcacattcactcttacatacacatgcttgtgtgcatgaattcatgcacgggcacttacacacagcacgtgcacacacacacacacacacacacacacacacacacacacacacacacccctctttgcaagccactcacctagctgacatcttgttgctagtcctcaactgaaatgccacgatgcatcttcctcggcttaggttttcccttgcctgctaagtctactcttgtgtgacaaccactgtctgcctggaccctggaatctctccagactctgcccgactctctgccttgctcctctccattgggtttatgcaaagtcctagcagagctctttatttttattttttaaatcaaggtagtctagaaaccagaggtcaaagtccacagtgaagtattggcttcctcaaaacgttttcaagaaatatagtatctagcacatgtactgctttttatttttttgtcttctcttgttccacacagaccccaacagtagctttcagatatgaagagtttcctggatggcttgttcttggggatgtctctgtggttagtctggtctggtcttgttagttctgggatggtcagggccaaggattcagtcctaacgcttttgtattttcctatttgtggtattaagcaattgtgaatgctgttgcttgtcaaggactcttgtttgttgatctctgaaaacctgcatttttatagattatttagaaatgattccggcagactttgtttctttttcttttctaacggacttgctccaattttgctgacatacatcctcgggaaccctcgagagtgggaacacggtagtaatacctgagagactatagagtggcttggctttaagtggcagctacagagacctggtactccgggcactctcgccctcttgtggtttgacaaaataggttattatgacccacaggacagaattgaaggtactgctcccagtctgaacagaggactccttagtttcctcctcctcctgcaaactaggggtgtaccaagtgtgacgagaagaaagtaagaagcagactcagggagctttgttgggaattccagtcccagatatttttgaggtgagaactgtcagagacagaaattccgagaaggctttgccaaagcctcagaaacaaaggccagaatcatgcacagcctgagggaatcaagaagagtgaacaaaaaggaattaaaaaaaaaccaaaaaaccaaaaagcggtgcctgaccttcgagatccattggacagccccagctgggcctccggtgttaggggaggcccctcccctcccggggctggtgtgtttgtttttcagggttgctttccttccagctggcatctactgggcctggatccggtcggatgggtattttcctgagtcatgtggtaacaggcttgtgttgcaattaactgttgacaggcccatcagcccagatgccggcttagcaccgcatttcaaagtgagggagagctggctgattttgttcattcttaattggccaactttttctgagggctggggatagcacatgacttttttcttttgccttaaacccccaccctctgcagagtcatggagaaaacaacagtgccccacgtttttcttagcgcaattgctatgtgccattcacatgcagatgtcttcataggctacgtagggtgcctagtgaagggattgggcaatgacttcacaggagacaaaataatatcttagtttgcacacaggtgcaaaggaccctttaaaagaaagatccccgccccctttcctgctgttcccctgggtgcagagaggactccccccccatcttctgtcctctctgtgtctctttccttcttttctcttttcttcccctttcctgccctttctaataaaacttatcgcttccgctctgtctgcctagcatgtttgtccccccacctaggtcactctcacctgccaaggaatccgccaacgttccctgaacactttatcataacaaagacaaaataacatgtaagtctgaaagacacactgagcaagaggcactgttttaggctcagagtaatggagcataggcgcttcaggaagttctctagccattcctgtgtcgaaaaatccaagagattcctgagttccatggatgtttatttaactcctttcccccattgaacatgagaccctccacactagattcgaattccagcctactggtgggaggataccggtgggttgagctaagactggctacagccacacttgcctgtggggcagcctcaggtctctttcccatgcctgtctgctcctcatgtctccaccagatacctggatgttcctccaaagaaaacctggactttgctctagcatttttcctgggttacattagtaaggtttctcttctcctcttctcttccttcctgacactgtggagcctgttaaggtggaagcttcaccccagcccctggcatccatataaccagagtctgaatgtcaaggtggaaattccaccgaagctctctcccccatctctctccaaaccctgcagtatctcagcccaccaaatgatgacccctcccctagagatgctcaagactgttagatccctgaaactgaaagtatccagggtcccaggccacgttcgcggtcacccaaatcaccaggcggattcaagagcttgctgcaaactgcacgaggctttattgtaatttaacaagctaaccccatgttagctcgggtctttcacccacccaccatggcggatggctagaaaagacagtttgaagccactgcgcacagatctttatagggtagcgtaaggggagtgtctagggatatgcacaggctcacgattggtgtgcctacaggcttggagggcttgccctgtgttgattggtcaactggttgttatggcccataggccctccaagggtggttgctatgctctctatgtcattgctgtgcgcttgtccgtaaagcacacccagagccataaagcatagagccaccagataacttccgattggttccttgtcatgagacaggaatctgactttctagtgtctagggcaaggtcatagaagcacgagttctgccgttatggctgccaaaagggaagctggttccttcaaagaccactcccacgggtatttaaactgccccccagaaaccagactggtgattttcctggtctccctttcccatctcctctctggggggctgggaggtcatccagaagaggtgtatctattaaacgtgggttttttctaatttggtttgatttggtctgatttgaattgttgcatcagcagagaggcttatctgggtgtagaaacttttcagaatgttccatggacttctttattcctttctgaacaccagtgatgccctgttggtttctatcaacttgttcatcctctgcaaccctactacccagatcttccatctctggattgtagtaaactcagcatagtctagaaatggtacagactaggagtctcgattgtgtttctctgtcagttaaagaattaaaaagccccaaaggatacacactcacatgtagggagacaccctagccccgcccaatagtcttgggacaggtaccaggtggacccgggactcacccataagggcatggtgaaggaaagccggggtgacgtaagggagcttcttaaggtgctgcacgtggggacccggccccttttgttttggccgtgcttgctggggtctataacctagctctcgcctgtgttttgccttggtgtctttttgaataaagagactttaatccgacacgtggcgcccaagaactttacgaccctgaagagccaacgggcacccagggtttaaatagtgatgaagaatcacatgtaaatggtaaaaatgacaaatgcatattttggcaagcttctattaatgataaaaggcctcaattgaaaattacaattaacaataaagttatttcaggcttagtggacactggagctgatgtgactattatcactcagaaatgttggcctaaaaaatggccacttaaagaggccaatgtacaatttttaggaattggaactctatctagagttcgacagagtgttaactcaatggtttgtattggaccggaaggacaaaaaggaatactaaaaccttacgtagcagatattgctataaatttatggggtcatgatttattacagcaatggaatactcaaattaacatccctccaatgtcagatatgaattctagacaatcactagatagtagaaaagatcgggtaagatgccatggaaaatggttaccaactgtccaggctgtacagacactaaatacaaatgacaggccgtcagaggaaccaaaggccctgtcattaaaatggcttacagataaaccagtctggatagggcaatggcctttgacctccgaaaagcttgaggctctagaaaagttagttcaggaacagctagaggctggtcacatagagcaatctaccagcccttaaaattctcctgtatttgtcatcaagaagaagtcaggtaactggagaatgctgacagacctgagagccataaataaggtaattcagcctatgggcgctctacagcctggaatgccattgccttccttaatacccaaaggatagccgatcatagtaattgaccttaaagactgctttttcactataccattacaagaaagcgatagagagaagtttgcatttacagtgccaactcttaataactcacagccagttcggagaaaccagtggaaggttttgcctcagggaatactaaatagccctactttgtgtcaacaatttgtacaacaacctttggaaataattcgtaaacaatttccacaatctcttgtttatcattatatggatgatattcttttagcagattctaatgaggaaactttagaacgtatgtttactatggtgaaggaggttctgcctagatggggtttacaaattgccccagaaaagatacaaagaggagattctattaactatttaggatataagatagacttacaaagaatcagacctcaaaaggtacaaattagaagggaccgttatcaaactcttaacagtcttcagaagctactgggagaaatctctcaattacagacgattattggtgtggaaggacatgacttaaagcattgaaaaatgacactaaaaggtgataaggacttaaacagtccacgaatattatcggctaaagcagaaaaagagctacaatgggtagaaaacagaatattggatgcgcatgtagatcggataaaccttgatctagattgcattctggtcatcttgccatccagagaatacccttctgggattctgagtcaaagggaagacactatattggaatggatattcttgccacataagcagaacaaaaagttaaagacgtatatagaaaagatttctgatttgattttaaagggcaaattaagacttcgtcagttgactgggaaagacccagcagagattatagtacccttaactaatgatgagatttcctccctatggaaggataatgaatattggcaaatagctctcactgactttttgggaacaattagtaacaactatcccaaaaccgacagaattaaattcataaaaaagacagtttggattcttccacgcattgtaagacaaactcccatttctggagttcttaccttctacactgatgctaacaaaacaggtaaggctggttataaagcaggtgaggtaagtaaagtagttcaaagtccatatacatctgtacagaaagcagaattatatacaattcttatggtgcttatggatttaacggaatctcttaatatagttactgattcccaatatgcagagagagtcgtcttgcacatagagactgcagaattcgtccctgataatactgaactaacctcgttgttcttgcagttacaggaaacaatcagaaacagaagtaacccactgtacattatgcatatcagatcccataagggtctgccaggcccactggcacatggcaatgacgagatcgatcgtttattgattggcactgtgctagaagcctcagaatttcataaaaagcatcatgtaaatagcaaggagatgctccataggcaagctggtaagtcgaaaacccccaaacatagattgcataatgctttattaacgctaaactttcttaatgccagtgacagtggacagacagctgtggaaagacactggactacggaaaaaactgctgaactgaaccaaccagtgtattacaaagatgtgctgacttcggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggagagcctgggacccaaaatattccataacagatagtcggtcccccatacaccctctcataattgttgtttttcaaggattaccttttccagtacacatacatgtacaagtgaacatttctctgatgacacttatgtttgagtcccatacagccaacaagaaccagcctgacagcaatccctacaagctccggaaaaaaaaattggactacacctccccgactatactggattcaactcactccgtttcgattgacactccaaccagaacctcgagtaatgacttcaatcaagttgaggatttcaacatagatcttcaatcaaacaaatctcatctaacatggactagacataactcattagaggctttccctatactggcattttttttccacagggcccccacatgactatcattgtcccatttcagcaggaagtaacctagaagatgctacacccccgttccccattattgtgtattagggtagtgtaagtctagttaagaatgaccttcttattgtttagagttgggattggaagaaggtgttcaagttagacccaggaagtaacctagaagatactacgcccctgttccccatcattgtgtattaggatagtgtaagtctagttaagtataaccttcttattgtttagagttgggattggaagaaggtgttcaagttagacactttttccacatgactttaagacctagctagaatagacataggatgtaccatagcagattattgtatcttcttgtatttcacccttatgattgttagttttggatattttacactattaagttttaatcctcttttagactagaaggggaattgtagggagacaccctagccccgcccaatagtcttgggacaggtaccaggtggacccgggactggcccataagggtgtggtgaaggaaagccggggtgacataagggagcttcttaaggggctgcacgtggggacccggccccttttgttctggccgtgcttgctgggttctataacctagctctggcctgtgttttgccttggtgtcttcttgaataaagagactttaatccgacactcacacaaggacatttgctcaactatgttcatagcagcattatttgtaatagtcagaccctaaaaataacctagatgtccctcagctgaagaatggataaagaaaatgtggtacatttatacaatggagtactactcagggagggaaaaaaaaaaaacaaaaaacaatgatatcttgaaatttgcaggcaaatggatggaactagagaatgccatcctgagtgagataacccagacccagaaagacaaatgtaatatatactcactcataaatgggtattagacataaagtaaaggacaaccagcctacatacaggccacaaccccagagaacttaggtaacaaagcgagacatacatgaatccaccaagaaggggaaaaagacaagtaaattgggagtaattgggagttttggggggcatggaagaggatgaaaggggagaggggaggcgggaagcagagtggggaaaatgcatagctcagtttaaaaactttttaaaaaagcaacaacaacaaaaattgaaaagcaatgcagggcatggtggtacactcctttaatccccagcttcaggaaggccgaggccagtggatctctgagttcaaggccaacctggtctacagagtgagttccaggatagccagggcttttacacagagaaatcttgaaaaacaaaacaaaacaaaaagcaggaaaaatctggtagcagcagcagcagggaaatctcactcactttagacagaattagcaactacggcaggcatttattgtagcctggggaaacacacaaatgcagctcacacacagagaaaaagaccacttgtgaagcaaacccaggaagctgaaaacaaacaaacaaacaaacaaacaaaaacaaaatccagtctcttgttgaggtgtgtgtgtggggttaagtcctctgtagagtcttccttccctactttagggttgctgaattagaagacaggtaggatggctgactggtccacaactgttgtatgacttgtcctgaccaggccttgaacttgttgagcagcaagtccaacaacaggcttttgtctcaagtcaggagggtgaagaagaagccggtcaccctgggaatttgcactctttattacctaaccatggtccttctccctatctgtctaactcctagtctctggaactcaaataataaagcaagccctggaagctcagtgggtctcagtttctttatctgtaagatggggagtgtgagtaacgtatggctgtgtgtgatgagtgaagcccagtaagggagcctggaaggaggctggaaatctgcccatttgtaccacttcaagtgatgcagatgtctgagaagtcttggtagacagtggctctccaccaggctgtgcatgaggagctgtagagatggctcaggggttaaaaatgtgtcctgctcttgcagaggacctgaattcagttctctgcacccatgtcagctgactcacaactgcctgtaactccagctccagggagtcaaacactttcttctggcctctatgggcacctgcacacatgtgactcacacacaaaaacaaactaaaaatgagtcttctaaaaattcctttgaaaaaaaatcagttgctcagctggaatggatgccaattaaatcagaagttccatgtgtgtggaagtgatcccataatgtgaccaaagttaaacataaaggctttacaggtagcaggtttggtccagtagctaacctctgagccttggtgtagccatctgaaaacagggaataaaatatgcatttagctttttacaaagattcattgagatgattttgtgcctggtcagtgcatgtcagtgggtgaatgttaataccttgtcttcattgttttgttatctttttaagaaatatgtttcttaaagatatattttcttttaggcgcgtgatgcatgtgtgtgtgtgtgtgtgtgtgtgtgtgtgtgtgtgtgtgtgtgtgtgtgtgttcaagtgcaggtgatttcagagggaagacagagatgtcaaatcccctagagttggcattacaagtaattgtgagctatgtggtattatgcccagatcttggagtccctcaaagaccacccaggagtccatatacaaaagcaaagaacctttattcaagctggagcttggaccctccacgtgtccatgagattggagagccttgagctcagttggggtgggatttttatcatagcagaggctggggggaggggatttctaaggttcaggacctctgactgacatttgtctaggggtgtcttggtgagaggggatgggtatattcgggactaaggtacatctggtgatcatatctacaatggctggaacattaggtattttctttggaatattaggcattttctccctttggatgctgattggtccattcctgagtggtgtctgagtggtttcagtttgtggtctttcttggagttaggtgttgccttagggtaaactgaaactcagacccactttctgactggcctctattgagcctatcatggcagctgtgtggccaaggagccttgggccccaagctgccatggaccccacagtggcactggtgctgggaactgaacttggagtctctacaagagcagtacatgctcttagctcctatgccatctctccatgcccctttcctttcttttaagacagggtattctatgtaactcaagacaggcctcaaactcgagtatatggattataagcctgacacccagcaatttactgggagctagtagcatggacattgggaactctgggcccatcctagcacctcagcctgtgggtcccagattttccagtctcttgttgctttgagcctagttgagtttatatatttgactctgtcgacaaccttcagggaacagagtagaatgctcatgacaattctattttaacccatgtaatccagaacattgtccagtttcaacagtcatatttgagactaagtataacattagttagagacaaattataacattagttccatttgctattgttgttgccaaatcaccagaatgcagcatgtcacccactttgtgagccaaacttttgtttaatgtgtggtaatatggaaactggccaccctttgtatgcaggagttctgtgcctgagagggtatgggtattgagtgaggacatgcgtatgggtgtgaatgtgtgctttatgtgtgtctaagagcaggaaagggcatatgtcgccttaggtgtgtgagtgggagtgtgtggagggctgtagtgctgtggggcagtcttcaggaagacttctactacttctcttcatggcttctgggttcctttgtctcatcccctcctaatctttaagtaaacttaagatgactcagtttgagaccttctactactgtcaaaagccatttgaaggaattcaaatgctatttccagtcttctggggggaactcatgtatgtctgcattctgggcctctctgttatgatataacatccttgtcaacacacagggctagtctctctgtcgctattggaggcaggcggccatggggttatggtagcatgagtgggtggtgacgcctatggacaatatattgtttacttacctcatgttatttcatttgcatgtttgaggggccctgtaaggtcacaattgcctttaaagcaaacatgtccatggaaatgtagccactagctctgacccaggggtgtgagtttaggtcacttctcatatctggtacttttccttactgcggtggaatggcctttcttttcctacgttttgctcttttatcctttggctttgacatgacactctggtgcctagtgacaggctaaagcttgctctaaggtgactatctgccccttgcccagggcagatgactcctcaaaaccggtaaaatgccctggtcttctttagttcagttttccccacttaggatgatagagcaaaatgcctccatttctgagaagcaagaaagatatttttgtgttatttagcttagtgttactctaataagattccaaagaaaatcagttaaaagggagagaggacattttggctcatggtctgagaagttttagccgtgactgttgcttgggcctgttttaacacagtacctcagggcaagaggatgccacaaagaaagcctgttggctgggaagtaagggtggggggtgagcaaggtctcactatctcctttaagggttgctctcacagagacctggcctaacttcttcccaataagccccacctctttttggggggggtgagacaggatttctctgtgtagccctggctgtcctgaaactctctctgtagatgaggctgaccttgaactcagagatacacctgcctcttcctcccaagggctgggactaaaggcatgcaccactacctcctggctaggcctcataaagatttgcccaccacctcccagtagcactaggggatggaggtcaggccttcaacacatgggcccttggagaacgcttaaataaatgatggcatattctatcacattgttcctgttcctcaaatttttacagaatgagaaaaaatgggcacaattcctatttcatttacccgagtttttctttaaaacttgagagttggtatgggctttttttgactggccagaacttcctcaggatcatgcagtaaacttgaggcaagtggagagtagccactgtccacttttcaatcaaaaccattgaggtcaccgacagaacctcctctttgattatttctgggcagctccaggaaggagatgattttctgtctctttctctgccacacaacatgttggcagctgggagagctctgccaccatgccctacacactccaggatgatggacaagctgtcatcatcgggaagctgtttttatttttgaaggatagggaggaaagggagaggatgggccagagaacagccaggggttgtgcaatgaaggatgttttcttgagaaaacatttacttcattctaggtatcatttcttttcaccagttattagaattatgcagaaatagccatatgtttgctttgagacttgttttactgcattgcccagacagaatcccatttttttttgctgtgggagtcaattccagggccctgcctttgctaggcaagtgcagtattatggagcaatattcccagagctgtgtctttaggtctgtgtgaccaggtccagcttcccaaatgcttatatttaatgtttccatcttgtaaaatgactttggtgagaaggtgagaagctagtgagtgaaatactctgagttcttacagagccctttgcacactctaagagtgcttagccactactgccagtgtgttgtttgttcttagttacctcatctcagacaactgctaggaatgttaaggttgctgctcagtggtgcatggctagcatccacaaggccctggatttaatatctagcactgaggaaagcaaagagaagaaagggaccacattctaaacaattgatgtgtccttcagaaaaatgtttttcttcttcatccagggaatgttacaacaaactctgtgactcagtaggtaaaagtgcttgctatgcgtacctgaagacccgagttcactccctgtacttcatagtcagaggagaaaagccaactctgacctctacatgggttttgtagctctctctctctctctctttctctctctctctctctctctctctctctctctctctctctctctctctctctctctctctctctctctctctctctctctctctctctctctctcacacacacacacacacacagagacacagatacatgcatacagagagatacagacagacacacccacacactcagatacacacacacacacacacacacacacacacacacacacgcacacacagacacacacagagacacagatacatgcatacagagcaaaacagacagacacacccacgcactcacatacacacacacacacacacacacacacacacgcacacacagacacacacagagacacagatacatgcatacagagagatacagacacacccacacactcagatacacacacacacacacacacacgcacacacagacaaacacagagacacagatacacacatgcatagagacacagacagacagacacacagacagacagacagacacacaacacacacacacacacacacacagaagccagactaatccaagactttctccaggccctaatgaaaaggacaaagggaactttagttaagtgtttttgttcagcagtggacttgccaatgcctggctgacccctgagccagtgccctaaaggagtcaaggttgtggcttctgggacctgactctcccctgggctgtagtcatcagtcctaaagcaagctgtgtctgtgttatctttgccaacattgtctgacttagtttcctgctgaccttggccattattccccctgaaagtactttatatgatgctacgcttcttaataagctttcttggcacaagctgtcagctttatgcacgacctcccagtgctagccattgcttttgtcatttttgtttctcatgcctggtcctcccactcaaaacctcattgtttggcacccttctttctgcgggttcaggtcatatacatacaataaaacatattagaaattaaaataaaattcttaagttttttggagggttttattgactgtacagcaatgttttcgtggaaggatcatgtagaaatttgtctctgcagaagggctataaatgttccatcatgtaactctgcattgttgtataccttcctagaggtggaagctacatgaactcaggattaagccgcctcagagcagatcaaagcggtttctggtgggtggggacagggtcatgacaagactgccatctccatagacaccagggaacctgaggaccctgttggtacaaggtcaaggacatcttcaagccttcttcttcaagcctgagaagtatgagagttagaggcatgacctcctaggcaaacatgagcttcccatccagacagttatacgcagcaccagccacagtagcctgcttggcttttcctacacctacatgtgcttaaaacctcaggaccagcagtaccaacaagtgagtgaggaccaaaggcctgatgtccccaatgaaaaaagagctgagtttcaaaaaaaaaaaaaaaaaaaaaaaaaaaaaaaaaaaaaagcaagcaaatgcatagggctttaaggcatgttaagcttttatttatttttaattttaatttgtcttttaggagctagagttgaggaattgggagacatcagtgggggtgaggggatgtcccaggatttgttcaacaggaagacaataacttagtaggcagcccaagagggccaatctggaatcagtgtgtgtgtgtctgtgtgtgtgtgtctgtgtgaatgtctatgtgtctgtgtttgtgtatgtgtgtgtgtgtgtgtgtatgtctgtatatatgtgtgtgtgtctgtatctgtgtctctctgtgtgtgtctctgtgtgtgtctgtgtgtgtatgtatgtgtgtgtgtgtgtgtgtatgtatgtgtgtgtgtctgtgtgtgtgtctctgtgtatgtgtgtcagtgtgtgcatgtgtcttgtgtgtatatttgtgtctttgtgtgtgcttgtgtctctgtgtgtgtctgtttgtctgtgtgtctgtgtatgtgtgtgtctgtgtatgtatgtgtatgtatgtgtgtgtgtgtgtgtctgtatctgtgtctctgtgtgtgtgtatgtgtgtctctctgtgtgtgtctgtatctgtgtctctgtgtgtgtgtatgtgtgtctctgtgtgtgtgtctgtatctgtgtctctgtatgtgtatgtgtgtctctctgtgtgtgcttgtgtctatgtgtatgtgtgtgtgtgtgtgtgtgtgtgtgtatgtgtctgtgtgtgtctgtatgtgtgtgttgtagggcaggtttggaaaggaacagagctggctctgtgccagcagcccagcaggccttgcctagcttcctggttttctgttccggtgcaaaggttgttactcagccttgaatcctgccttctttttttttctttctcaactctgttgattcaattctgttgactctgtaagggagctagatcagctccacagggtcctaaaagcctatgctcttcagctggcttcctacaaacagttctgtgaaatagaccagggatggcaggcgattcagtcctgctggccgcagtctcccttctctctgcctgtcagcaaagtaagaacatgggaatggtgtgtatgtgtgtgtgtgtgtgtgtgtgtgtgtgtgtgtgtgtataagtgtgatgtatgtgtgtgaatgtgtggtatgtgtgaggatgttgtgtatggggtgtgcgtgtggtatatgtgtgtgtgtgtgtgtgtgtgtgtgtgtgtgagagagagagagagagagagagagagagagagagagagagagagattgctctagtggctctagtgtttgggtttcaggcctgaatttggttagtagtcctgggtgcccagcagggtgtggattgcttagggtggttgtgctctccttccgtgggatgggcatgttccagagattagctctcacagggatgtggtgggcctcagagctctgcatcatttatgatgacagtccacatgcccgtgtggaggagcgttaggaatttcaggcggagatgtgagcacttgagagtggcaatgacaaacatccattaggaatttgcagcaggaaaccattcctgtttctaaacttggttgtaaacttttagtgtgttttcttagagaaactgcctgtggcagatatcatcaaggtaaagctttgcagaatatgcagtttggatcaagtaatgaattctaaacattacaacatctcccttccagggtgactccacaccgcctgtctggttaaatggaggctctgactcccccacagccacagttactcaatttgtggtatctgccctacatgcctagtgaacagagtttcttactaagaatgcctgtttattcttcctgggatgcacgtatccggaaccaggtctgagcgctggggacagtgcaggccacacactgcaggaagcaaaagactgcttatgctcagggacaaagtccagtcttcacatccactcagtggctagcctagcgggtccgctttgtggatgagggaaaaccttagaccttcagacatgttttgtgtatcagcttttgtagaacagagcaggtgtttgcttccaaccaaagaagaagctgggtctaagtgatcactgggctgtgatcctgtaagtgcagagcatccagggacagggctacatgcccctactacagaggctgtctccccacagagagccttttgtgtgctggctgatgctgaggacactgtgaactgggaccagaagctaagcagttcaatggtgagggaggaaggggacaggaagagaagagagtggggaaatgatgtttgccgtaggaaaatgttcacttgtggggagtggagcacagagagacacagacagagagatactgtttaactggctgcttcagacatttgttgtttacagaattaggacaccttgtgccaaggtacaaacaactcagccttgtaagacagacccacccgtatctgtctggtccagccccggagcaggatattctgctcttccatgtgctcagcacagacaggatcctgggtaggaaatgcctccagggtcactggtccttaacactgttcctatcctgaacctctcacctgcagagagaagtgacatccccagggaagggtccatctgtgacagagtcacaatggtggtggtggtggggttcctttcaccatttctagaatacaagcattcccctaccctgggaaagaggaaatatgggcaaaacaaaggtgatcataagaagagaaattcagtctttccacagaacggataaaatgttttattcacacttattgtggtcattgacagccacaatcttcctgaggccctgagccctgagagtataggttggggcttttaccccagaggttggcaccaaacccaaatattccttcccattgtgggtattcacacacctctcccatttaccgatcaatgtcctcacattggctggtgtggcagacaggtgcctactggatgtagttcacagtgttgagagaaactgaacttggttagggttagtgtaacagttaggagttaggggttagggttaggggttaagggttaggggttagtcttaggagttaggggtaagtggttagggttagcagtaaggtttaggggctaggggttagggttagggttaggagtaagggtcaggggttaggggttagggttagggttggggttagtggttagtggttaggggttagggttggagttagtgttagggttatcgactgtttgcttattcacaagcccttttgaagccctatgttcttgtgccactgctcattggtcaatctaggagcacacagccttcattgtttccagtccctaggtgtttccttcagggccatgaaacaaattagaagccacagtaacagcacaggggtgggagggggaacagtggtggccagaaagaccaagttccaagttttttcctaatggacagaatccctcccctcttttggtctcttgtctgaaattacagtgctcagaaaggttgaaaagaatcaatgtccaccttccggattgtttcagtcctaagacagcacatacttaggtgtcccttttcacagtttaactcctatgctacagctaactgggagccaaagcgaagaaaaggagcccataaagggagcccttcctaagccaggctcagtcctgacttcctgtccaagggcaggtgtgctctgaatcaggatgaaaagcccctctacaagtactcaccccacagagactgaaaccacagacttggtatgggattttaaaacagtgagtgagtcagaagtggttgttgagatattaaaatgagaccaagttgtgtttcaggcaacagttaaggacacgaaactgggagcgataatgggaagggaaatgatagactgtgggaggtaattatgaagaaaggaggagatgaaggagctgggagataattcaggtggtaaagaacttgctttgcaaacacaaggacttgagttagatccccagaactcatgtaaaaacaaaacaaaacaaactggacatggtggtgctggcttgcaatcccagtgccagggaggcagagatggttaggtacctggggctcactggccagtctggtttaatttgatggtttctggtaagtagccatggtacccaactatactcacactttgctgatgaccagtgatgtgccatactttaacaccacattcctttcccttgcagtttattttgctttgcatgttggacgaacaagattaaaatacaagattgcagccccggcagtctccggggctccagagtttgagagaatatttcgtgcacagtaagtaatgcttctcacacaggcaggtattgttttttaaccaagttgttctatttaccaataaagactcaggagtcagatgctaaggtgaaaacctgctaggtcagagaggcccaaaagcaaccagctgaccttcctttttggccagagacccagcaagagactgtttctccacatgtctcaaaccaaaaaatgcccatgaatctttaatcctctctactccttcccgtgtgtctctctatcaatcttcctgactactccttattctctatggctaattcctgtgaactagtcgctggctctgccccctgatccaaggttgattttgtttaacatagtcttggggtttcacagtgcaatcacacatcccaaaataggcaggccagccacaaacagacagattctgattatgggaaagagaaatagagaaggccctaagttcatttcagttagtaaccacgacaagtcactctgcacccatctcaggttccgccatcatgaatcgtccagtgtatgttatctacccaactttggtacagatctagtgatctagttggattggcctattcacccaaaaggctgcaacttgggaagagcggtagtgtctctcaagcactgtggattggccaaagggacctctccagcccctgagggttcagtagattcaagtggaactattttataatttcttttcatcttctgccaagttcttcaagaaccatttcctaagatccgaagcatgtaagaacaagctgtcccaagtcacatgagtcctcagtgttttttagcattctgtgctgcctgccttttcagacacacagtaccttctgccataaacacggtgcactttcctgtagaagttagggtaacctttacacatcaccccaaagcctagtgcttgggagagcattgtctttatcaatatttactcattgctgggttctttctttatgtccatgagtaaggttcatctgtattttttcttgcatagttcttgtctcattttggctatttaaaaaattacacttcactttgaattttggttggtaaggcaagcccttgagctgacaacatggcctcttggtcagtctcttgctctcagaagggttttatagactgatcttccccttggcttcaaagtgtacagggaatgcccacaagacaattttaagtaacatcaaaccatacaaggagaagccattcccaccctagttgtctttaaatacctttggtaggtcaagtagcaagcattggtttggtgccagtgtgttttatacctaagagtaaatgtttactttatgccagtgcacagcctggaaacagagtggaatgacaagtcttattacaagtcactgtcccttgtgcctgtcaacactgtgatctcactgatgtttatttgtccacagttttaggccttgctagtcacattattctctctttttaatcccgtagttggtctatagtcactttgctgtgttaaacctggagccagtgtttgtaccattgtaactaagtaaacaatgttggaagtagagctgcatagtactctgtggttatatttccttcttgtgcaggttttatttttcttagggctaataactgcttctttgctgccttaatttcactctcaggcctctatagaattgaggctccctgtgagtattttcagatgaactggaagtctgctggcatcctcttcctgctttgagcccatctgcctgaatcctcctccctttcactacagtagaggatgctcttagagctactgcaaggctgttattctggtcttcctgttgccttcctagaatttgcttatactctctggatttggatctcctgctacctggactacaattctttttgcattgtttttgtctcttaattttagtggagcacatttgttatctttctgttacagtgatcaatacatgagatcagcaacttagagagaaggaagatttattttggctcagttttagatagcatgctttggacattggtggcacatacatcatgcatggggcagcatgtggtggggcaaaccctgttcgcctcatgggcagatgcaaaaaagaaagagtctaggccccatcatccctttcaagggtatatcaccaatgaactttaccctctgactacctccagtctctgaagactacaccaccaactctgtaacacatgggcctgtgggggaactttcagattcattctaggacatgtctaaacacttcctgagaggatctcaggactgtagaattttgaggcttgttctatttggatacagcctacccccagcctcacatcactgatggctgggtaggtctatatatttccatattaaatcattacaccttcagaattgtgagacaattgctccatcactttctagtgactttgggtattgttgacatttgccatgtggtgtgggaacagttgagaggttctggggtgctctgtgccccacagacctcttctgtattacagcatgctgaattctagagcaggcctccttgtggtccagaaactcatgttcttctgtcccagagattaaaaaagtattctcccccaatttcttctttgtgttttcattcttttttgaaacatgctagttgctcttgagctgactctttagttttcttttatcttaagttctcatatttggtgactcttgttctttctggagaatttcccaaatttctactttttaccagctgaaccattttgggaggtcatcattccaaccccaggagttgattttcactctgcttttcccctgccattgttgatgatgttaaatcatatgtccttgggtctcatgggcacagttttccatttggggattacattaatcacttaaaaattgtctgtcattatttctgtttaaataacatttaacaaattttaataatatcaaaccacacaaggtaaatcctacctatttcaatttcccaagtccttatggtcttcatgttcaagttagtatctgttttgaactttggctttcatgtcacacattaaacaaaaatacacattaaatatttatgagtgtctccatgtatagcttagcttgtatcagtgaacaaaccaaaagggtgaacaaaccttacccttttggagtatatagccaaggaggaccaaagatcaccattggttggctttccttgaccaaggtttgtgctttgaaaacctcacatgagagcctgggatgggatgtagccacatgaattggagtggattgaaatttgaactagggtggctgctgtaagcaaggccagcctgaaccacacagtgagtccctgtaaccaagagctggggacagagctcagtggtgaagggattgctttgtgtacagattgccttgggttgcaccacaaaactatactccctaccccaaacaaaaggaaaccacaaaagggactaaacaaccccccaaaccaaccaaccctaacaactgatttatagaaaactagtaagtggtatgtgcacaggctgaaggtggtgcctgtgataggctcatgctctcagactcaaaccatttataacatcaccttgggggagacctcagcttccctcactctacctctgttgaactgagagctgactctgtctgtgtgaggcttccagcaggttagatctgagggccactccttggttctatttcattctcactgtttccacacatttgattctctttcaagttagtgttttctccctccctttttttataactgggctcctttcgtcctagaaacaaagttggacaccatttccaaatatttctctgaagttatttataaaataagtacacaagctcaattcattcatcagaacttaattttttgtttgtttaaccttagtggaagagtcataggattaaaataatatgctcattgccgggggtggtggcacacacctttaatttcagcacttgggaagcagaggcaggcagatctacatgagtctaaggacagcttggtccacagagtgagttccaagacaaccagggctacacagagaaatcttgtcttgaaataccaaaaacaaacaaacaacccccccaaaaaaacccaaaaccaaaaatccaaagcaaaccaaaaaacaacactccccaccaaccaaatcaaacccttataatatcaaggggaatttagagtcaagagatagcttgatggatggtgctggcataactggatgcagacatgtagaagactacagatagacccaagcctattaccatgcacaaaactttagtcaaaatggatcaaagacctcaacataaatccagccacactgaacctattagaagacaaagtgggaaataaccttgaatcaattggtacaggagacagcttcctgaacattacaccagtagcacagacactgagatcaacaattgatgaatgggacctcctgaaactgagaagcttctataaggcaaaggacacagtcagaaagacaaaacagcagcccatagactgggaaaagatattcaccagccccacatctcacagagggctcatctccaaaatatacaaagaactcaagaagttattctccaaaacaccaaacaatccaattaaaaagtggggtatagaactaaatagacaattctcaatagaggattcgaaaatggctgaaagacacatgagaaagtgttcagcactttcccttagccatcagggaaatgcaaatcaaaacaactctgagataccatcttactcctatcagaatggccaaaatcaaaaacaccaatgacagtttatgctggagaggatgtggagaaaggggaacacttctccactgctggtgggagtgccaacttgtacagccactttggaaatcagtatggcgacacctcaagaaaatgggaatcagtctaccacaagatccagcaatttcactcttaggcatatacccaaaagaagcacattcatacaacaaagacatctgttcaaccatgttcatagcagcactatttgtaatagccagaaactggaagcagcctagatgcccctcaaccgaagaatggatagagaaaatgtggtacatttacacagtggagtactactcaggagaaaaaaaaatagaatcttgaaatttgcaggaaaatgcatggaactaaaagaaaccattctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataacaagaatggagataccataatagagggagacattttaagtttacagagaaattaggcactagggaaacgtctggagatctacaaagatgacaccactaacaatctaagaatcagaggagaggctaccttaaatgccctcccctgataatgagattgatgactgacttatatgccacccgatagccctcatccagcagctggtggaagtagaagcagacacccacaacttatcactgaactgaactggaatccagatgcagagaaggacaagtgaagagcaaaggggtccagaccaggctggtgaaacccacagaaacagctgacctgaacatgggggaactcttgctcctgagactgatagctgggataccagcatgggattgatccagaccccaggaacatgggtttcagtgaggaaaccttggaaacctacgggacttcctgtagtagttcagtacttattcctagcataggtgtggactttgggagcccattccacataaaggaatactccctgagccaagacacacgggggtgggcctaggctctatccccaaggatatgatagacactgatgacaccctatggaaggcctcaccatccagggggagcagaaaggatatgtgataggtagggttttagttgggggggtggtaggggaggatgggagggagaagggaactgggattgtcatgtaaaacaatcttgtttctaattcaaataaaaaaaaaaaagagagatagcttgatggaagggcaaagtggggcagtcctatcccattccctccctgtatttcttctggtattttctattgcactagtcaacttcttgccttgaattctaaggttcatgacaaatctggctaattcagatttcatttgtcatgagtatggcatatagactttttatgaggtacctggcagaactccttgggctttccaagtctttgcaaagccggcttggctatttatttgtctcttccacattggcttccttgcattctgaggaaggaatgcactctgtttcctcctgtcctgggctgaggcatggattccctttagctgtccgtgactttcacagaaatctgccttttcctacacttctgtttacagcatagccttcagcatggccaaaatgcgcaaaggcactgctcagtccttctctgagtagaaactgcatctcagcagcatcacttcaagatctttattgtggcttctgtgtgtctcctgcagcagacctcttcaggctgggagtcatctgttcagccgagatggctgagatggtgtcctggcatcctagggtgcaggccagacctccttccctgagtccttttccctcacccagggagaagctgtggagatgagtacagtttttcctgtgtcacaatacagttttttttttaaatcatgagaacagcaaccacaattatatccagacccattttttatgctattgctaaaacttaaaaaaattctatactcattcaaatgctgtgatgactttttctatcctagttcaaatgtcttgatgactttagagtaaaggcttttgtaaaatctacgcagtaggtccaaatagtaaattgataatgttgcagtgtaaacacatttcctgggccagagaggtggctcatcaggtaaaggcacaggccatgaaacttgatatcctatgtttgagtcccaggatccacaagatggaagcagagaatggataccattaaatgtcctctgaccgccacatgcacactttgtcatgcaagtgcatatgcacacaggcctgtggacttacacacacagacacacacatacacatatacacacagagacacacacagacacacaaacacacagacacacagacacacacatacacatatacatacacagacacacacacagacagacagacaggcacacacacacatatacacacagagacacagacagacacatacacagacacatagacacagacacacacacagagacatacagacacacagacacagacagacacagacacagacagacacagacacagacacagacacaggcagacacacacacagacacagacagacacacacacacagacacacacagagacaggcagacacacacagagacaaagacagacagacagacagacacacagacacagacacacacacagagacacacacagacacacactcacactaaataaatgtaaaagggtcagtgtttttcctctgagtctgtttctacaaggaagggagatgaacaactgaccagttgttcttatttttcttggggtgagggaaggaagctccaatcttgcagtttcttttctcaaaaacttaaaaaaagatactttggttgtttctgttacacaaaaaattttattgtaatgtataagcctggatcccaaagtacaaacactgcagtataatgtacaaccgtggttttgttggtactgggtaggactgaaggacagcttcgctctctgtttaatgctgaacacttagatttcagactcaaattaaccttcgcacatgcaaattggctcatcctgaatccagctactccaggaatattagtctgtgcttcctctgctgtagtttgtgtctgttgttttattctaccagtgtgtgtgtgtgcatgtgccacagcacccgtgcataggtcagaagacaaagctcaggatttagttctttcccaccctggggattgaactcaggctttcacagcaagcactttaactcacagagccttctatgtttttgttttaaatcaggattcactatgtagtcctggctggccctgaactcaatgacatcttcctgcctaagccgagtggtggtcattaactttttagactcatttaatatttgaagcatggaattttataaatgaaattatcctaatgggtgtttaacccagaaaaactaaagggaaatccacaaagataagagttttccttttttctataaccattgggtgacgcaggccactgatttttgtagtaagtgaggcaggaataaagggagggaagaaaggaaaagagggggggccgagagcatctttctctctctctgtgtgtgtgtgtgtgtgtgtgtgcgtgcgtgtgtgtttgcattgtataatgtgtgtatgcacacacatgaccgcacagggatagaggaaaacattggggtatcctgttctatgtgtgtgtatgcaagcacggggcagaggaagacatcaggtatcttgctctgtgtgtatatgtgtgagagcatgcttgtgtgtacacatatacacacacatgcaaacaggggcaggggaggcattatctgttctgctctctctctctctctctctctctctctctctctgtgtgtgtgtgtgtgtgtgtgtgctagagcacgctgtgtacacagacatgtgcacatacaaaggcagagaaggatatcaggtgtcctgcttgctgtgtatgtgtgtgtctgtgtgagagcacgctgtgtgcacagacatgcagggaaggacatcaggtgtctccatcactctccattttattcctttaagacagagcatttcactgacacccagacctaggctggtagccagcaagccccagtagacaatatctctggccttcatcatgctggacatgatggcgtgcatacaatcacaactgtgtcatttctctgaacattcctgaggaagcttacagttctgggtagtagctggaagccctaaaatgcccttcatccactgagttatataaagaggatgaccaagacactgaatggctctggtgagttcagtgaccggcagggtgatctggagagctgtaagtcttggaccctcatgtgttcatcctgcttctaccagttgttcagttgctgggtgacaggtagacttaagcccggctgccaccagggtccacctcctgctgtattgccataggggactgcctccaaaaggaacaatttaactaattaattaataaataattcttattttttgaggctctcactgtgtaactcagggctatggctgctgctctccaatgggggccatgacaggaagctggcatggacttttaaaacctcaaaacccaccctcagtgacactcctcctccaataaggccacacctcctaatatttcctaaacagttccactaagcagggaccaagcatttggacagatgagccaatgggggctcatcaaaccaccacagtgggtggtggaaggtcaatgttcactaaaagtcaacccgagacagtggttcttgagttccttgtttcatacagatgaagattataaagcggacatgggtggggttagcaaatggaggtgagctaaggaaaagtgagagaaatccccgagagtgggaggggttcccagagaggaaaacagaaattatctaattgtttcatgtaggagtttttaataggacttatggtaagacaatgaccaatgtaatttctgttgcaattggttagttttctgggctatcatgggcagagccaatggttctctctccccacacatgtccccccaacccaaccagggagatgacaactctgtttgttcactgcctgcccagttaaggatggcgaagtcctccctttgtccatctctgacttatcctttattagccactgagcttgactgatcaccctcagcctgctggccatgggccttgcaggtgtcctggtggctgttaattaaactgtgctgttttcgttctcatatatacatgagcagcttgattcacaactgcgaagatggagctatagtctttttttcttcttgctcatgggtggggctgtagtcttgtgtgtggggttgtctgtgtggcctggggtggtctgggtggtatcctttctagactaggtagacatttctcgttagaaacaattcttctccacaatttcctttgttatatgaaagggcaattgtgccttgcatatgttctccaaggaatagggtgaggttggggctttaggggagccagatggcttgctgacactggctcagagccctgtccttcctctcatctggtctgcttggctgtctcttagttgctagccctcttccttatcttccccagtgttcctgacttcactgttttaagcctaactttcctattactcttgtgtctgttctctgttttcactgtaatattcattatcaaaataagctttttcactacaggttcttttctcttactacttacagcaagctagctcttgcctctaagtaacccacagagaagggacagtattgctgcttctatttatatttatttattttattttattttattttttttttggtttttcaagacagggtttccctgtggctttggaagctgtcctgaaactagctcttgtaggccaggctggtctcgaactcacagagatctgcctgcctctgcctcccgagtgggattaaaggcatgcgccaccactgcccggccttatatttattcttagaatcccatctttttttttggtctgtgtgctctataacacatacaaatattgttttccagttgagtggttaacacaatgaagtctatgccttagtccctgctctctctgggtgtccttgtggggggtgactttggcatagtcacagatgtccaggctcctccacccaggtcctcagtcttctttcttcctatggctctaaaaggggaatatgctacaacaattacttaaccaggtgtcccagaagtgacatatttaacttctctcaccttccattggtaataagaaggctggggatatatgggtgctaatggaaccccagcagcattctgatggaggacacacatgtacatactgtcatggagcttacactgtgatcagacaggtgtggagactcctgttttagaaataggaccaggtttggaactgcaggaccacaatttgatacctcctcccccactccaaaacatgatcaaaactttgtagtctacctactgaagcaaggtcccagtggtacttggatcagagggtctcctagcttccagctctttgatccaggtgtgagttttcaggggccatatatccacatgtcaggggacctaggctccctggcaatggggcattggagaaatggggcaatggggcaatggggcaatggggacttttagcactgcccagggttagtctccaccagaatatccctgaggatgatgtgagtgtatcatgccagaaacataggcatgtttgggtgtttgcacaatgtcagaaggcattgagcaatgaattctcaagctacatcattttgttggctgctatttgccaaacagtccttatattacctttctagctggccattggcaaccacaaagttcttttacttcaatgttaattactaatattaacttggaaattatatattataacacacacacacacaaacacacacacacacacacacacacacacacacacacacacaagaatgattacaaaaagattagaagaccacaaagttcatggaggctttgccagaggcagagagctgagacagatgcaaagagggttgctgtatgagatcagatgtggcatcaaagaacgcacttggacagctgctgaaggcaagcagagtcctaccacacagggttacatggctgagccccagaggtgtagggcagtgtaggtgacctacaggattgactacaacaattgagtgggtatggactgcctgatacaatgggggtcatgttcagctgtactccaggggacagccagagctatctgcttgtgggcccctagatgcccagagtgggtagttggatgactaatgggtgggttatagtcagagaagttctaggtgtacttcttttatggggtataggtgagggaatttcagctttcattggtctagtgtgattggtaggtcctgggcctgatggtttgactcttcccaggcacacatacgcccctgctttactttgataaacataaaagtgctacctttgaactcgtaggttaaatttgctcttagtctgtgcccatggatggagctggacagctggtggagtctgtgggtggacccagagctattttctgctatatatgcacttgacatggagtcaaaatccctgcttgctagttggaattaccctgggcaaggcacagcctgcggccactgctccacctcatcgaggaacacagggcacataggaacatcacagtgcccagtggtttcagctttttttagaccttttctattttttcccttaaacctcacatatcctaaaacattttagcaccagaaaaacaaggacaatgtatgggggtcggtactggtttcaaaacttaagtccccattctgaaaagtatctcaagtgcaggccaagcaggacacttgctccccctactggccctctagtgaagaccttttcagtttctctccctggtgtggaatttggcacccttggtgacatctgcttaaaacaatgaacatcctcctcccccatatttccataggggcatcagtgtgcaaagaactcagggttgttacacaatgaaggctgtgatcagaaaatgactcaacacagcccattttttcctatgtgggcatgcaggggaggggacagtccacagataactatcaccaactgtattcatgaaggacaattgacacaggaattttcctcaggattcctctaagaagagaccagggtgtagctgttcaggtagttagaaggaggctaaaatcatttatgtattggattgtcctacatgtgaaaataattagctgctgtttgcacagtcaagcagttttctgtatttggtccccttaagttgactgtatctgttcacagtttacagtggtggttatcatgggggcacaccaagctttaccatcatgctttcaggggcttgatgtaggagctttcaggggctcagaggtactgctggtgggggaagggtggtcacagggtgataatgagcagatagactgtgactccaggtgtttcaaggtgaagcaatatttccaggcagacagaagcaaatagtgtagattccaaccagcagtcagaattattcccagggtctgaaagatgataatggaaaacggacgaagatgcaaatgatggccaatccttgtaaatggcctggatttgaaatcacttaggagacactcctctcagcttgtctttgaagatgtttggagaggtctaactgagagggaatacccaccctggatgtgtgtggcaccatgggttgtggccccagactaaattaaaggtaatgaaggaagaatccagctaaacaagcagcattcatccctctctgcttgttggttggggaggcaatgtgaccagttgttccatacctgtcaccaggccttcccttctgtggtggactgtaccctcaaactgtgagacaaaacacatccttccttcaattacttttgtcaggtactttgtcatggctatgaggaaagtaaatgatacactgcatctcagaggaagcaaggctcaaggcatgtctgccaataaggacatagggttgggtgagtccaggagtgactcctgcttgtaaggggacaagggagccattttgtgggggattaagatgcagaatgtagagtaacttgccctagtacgctaggcttttcttttccgtaagcacacatgaagctgcatctattcttgcctgatctcaatggtctctatcccaccccacccccaattcctgctcaccttgcatcttattgccagcatttccattttctggaaattagggtgctaccatcgacccagtcccagcttcaatcagctaaatggtgggcctcagtgcatatggtattctccttgggttctgtagcattgtccatacctgggtgtcctgctagttttatgtcagtttgacacaagctagagttatctgaagggtgggaacctcaactgagaatatgccttcctaagatcaggttgtaggcaagcctctaaggcattttcttaattagtgattgatagggggaggacccagcctattgtgagtgctgccatccctgaagtcctgtgttctatgggaatgtaggctgagcaagccatgggagcaagcaagtaagcagcacctctctatggcctcttcatcagctcctacctccaggatcctgcctgtttgaatttctgtactgacttccttcagtgatgaacagtaatgctgaagtgtaagccaaataaacctgttcctccccaatttgtcttttagtcttggtgttttgttgcagcaatagaaaccctatctgagacactgggccacgtccttgggctgctctgggtgctgcaatgggaggaggtgagattcagtgccctctctccaactatgtcttgtcacctgaggcctgatacttcttatatctggagtctcactaagcccttcacaaaggcgacccatccacacctaggctgttctccagcttgagcagcagggaaagacccgcaacagcccctccatgctcgtttctcttttcttccaagagactttcttcctctttcaggcagtagcacaaaaacacattttcgtgtcagcttctgtggagagacccaaagagaccacaggctccccgactgtcctccctatagtggaaccggggtgtggccagaagactctgtgcagtatctctgcccctcaaatgcagcaccaaggtcattagttcactgcacagaaagtcctgcaaatagacttttatgaattgtggtgatatattgtttatgatttattaaagtcactggcgatcaaaatagcaatagaagctaggcacatgtctttaatccctggactcaggattaagacatagatagatctctgttagttcaagtccacactgaccacataaaattgatccagtcctaaaagaaacatctcacataaaggtgatctcagcaccatggaggtggagacaggagtggtgtggttgggtggagaaaggaataaaaggaggaggagacaggatctgaaagccttttgcccctgaagatttgtggagacaggattacattttcatctgggtagaggtaagatttaccggcttggctgctttgcttctctgatcttcaacttgaagcttgaaccctagtatctgtctctgggtcttttatttatcatgcaacagtggatgatgcttctgaggtgtttaaaatgtcacagctgattttgaataagaagatgtggagtaattcagggtgtatcatgaaacctaataaaggatggagcaattatgtcctgtttccagaaagggccaggaaattgcactggctggaaagggttagaaccctcctgtgctgttctctcttgttccctggaaaagattctctggatctagccaaggaaaggaaaatgctgagaaataggtctttatttttagctgtcattgtttttcctatagaaacttagaaagcatcttttcacttaacctatcgtagctaattacaaacttaccaaaccatcagaagcaaaaccatgccaaggacgcagagaaagacacatcttagtcccttctctgagtactagtgggctgtgcctctggctcgtgttaagctccagagcagtgcttccttgggccactcacagccttttaggccttaaagaaatgattagatgatagagaagaaagcgtttctactttagtaccactcatttcccattttcaggcccctagagagcaaaagggggtccttgctgtttccacttgtacttcaggattctgcatcagccatggtctgtatgtgtgggtgggatttgtcaactgttcacttttctcatttctaataagggggtagggattgaatttagagccctgcgaatgccaggaaaacaccccaaacactaagaaacatcccagctctttaaaaaaattataattatttttatttatgtgtgtggctatgtatgtatgtatgtatgtatgtatgtatgtatgtatgtatgtctatgcacatgtgtatgggtgcctacagaggccagaagagggcactgagtgtcctggatctggagttacaggtaggtggttatgaaccacttggcatggctgttgggaactgaacccaggtcttctacgagtactaaaccatcttctccagcccttccaccccatttttgtggttttcattttgagacaaggtctccctaagttgcttgggttggccttgaattcactctgtagcccaggctgaacttgaatgtgcaaatctgcctcaagcttcccaaatagctaagatgacaagcctgtgttaccagactcagaaatcacacattattcttggatggtttcaagtgatgctaaaatgactattgagaactctgtcttctttggttttgctatttgttaataacactgaccactaacctgatgactattccatctcatctttctccttctctggtaggtacagatgaattaattgtagctcctggagaactattcccttgtgcttaaaaaatagtaccaaattttccacctgagtttcccatggagtagaggcaatttgatgctactgtctactaattttaatttttgctttgcctatgattgttttgcccacatggatatctgtgcaacacttgtgtgcctgggccccaaagaggccagaaggtccagactttgtgagctgccatgtgggtgtgggaaatgaactcgggtcctctgcaagagctatcagtgatcttaaatgcacacaggtcaattggctctcgggtcaactggttctcaggtcagctggctctctcagtcccactatacagaatgagaattaaatgtactcatttctttacctcagaatgttttaggggagttatttaaaggtcacctgaatgacccaagtgactcaagtggaaaactacaggtgtcagggacattttaaggagaattctgtttagtagttgagtagcctcttgagttacttggataagccacagaccgatatgtaggctctggagggctgtcttccagaaaaaaaggccacaacttgctccactagtgacaacttgtgtgcatgagaatgttttcggctgggctctgcagttgagcaatgttggagtctcaccttgaagactccttttaaatggaaggctctttagatttcctatgtaagttcttgcattatttttttgtttgaatagattgaatgctcacctgtggatggaaaatcaatacattagtgtatgtttgttcatgaattcaacttcatcttaatttttctccctgcagtcaaaactctttggaatcttattccgtattcatcataacactgtggatggctggatggtatttcaatcaaggtaattataagaacatgtcaactcatcccaaagatgaccgtggtgtttaaaaacaattaaagggtgaatagatgaccatacagctactgatgctgataatgactttaaatataagaaccaatacctgtgtacatccaagttataggtgatttagttcaataattaaaaaaaaataaatccaaacactagcatctggatatagaggtaagtactggagattccagtgctcctgatctcgaggcagagctgtctagtgagactctgtctcaaaaagcagggattaaaactaacctgggctcataggggctcagggattcatagaaatgacaaccaggagcctgcatgggactgacctaggccttgtataacttggtcttcatgtgagagatgcttaacagtgagagcaggggctgtctctgactctgctgcctgctctttggacccattcttcctactgtgttgcctcctctagccttaatagaagaggagatgcctagttccattgtaacttgatgtgccagggccagctgatgtccatgagagaccctcctgtaactgaagagaaacagtggaggaggagtcgatggagcggggaagaggagagagatataaaaacaacaacaaagcaagagttaataatgcagctcagcggaagaatacttttctggcatgtacaaggccaagagtttgggtcagaacatcctcctactccccatcactcaaggtcatgtggctataggctatacataacttgaaacaaactatatgctagataatcaaggataaaaatgatatgaaccttgtcttcaaatctaataatctaatttaaccaaaggagcagaacacaaaaagcaattcacttttacaacaacgtttatgggacacttattgcatgcccggttatttcttgaacctcatagacttgtaggatttaaactttcatatgaaacagagtcaataattgattcctactttacatatgagaaaactgagatgcacaaatgttaagttgtccaacctgatgatattcaccaatgtggagaaaatcttccactcaagggcatagcaggtctattgctatttgcccaaagtgttctgaaggacatggtgctgctctttgaatgcagcaggtctgcaagcatgtactttctgtttggctgaagtttccttgctgagctgagggcttagtgtacccatgtatttgtggggtggacctatatggacactctagctggtgaaatagaatcccctttgattcctggtaacagtaatggcctcatttgggtatgcatttgattgctaagatttaaataaactaaaatccagctgcttccaaagaaccttcatcaatctctttcttgcaatttttactgtcaaccgaggaatttcagaaacaatgacctttagagaatgacttttaaactttactcaactcatacttttgttccttaatggcatgagtgaaagtagctgttccttttcatctaagggcatattaacaactaataagagaagtgcctttggataatgggattgcatctctgtcacttgacccctcggattttcccatgatgggctgaatgaggtggactgccgagcaggaaaggggggcatggatatcatcattcttttctctcccaaagtaagctggttcctgagctacatctggttcttgggtatcatcattcttttctctcccaaagtaagctggttcctgagctacatctggctgttcattggctttgggagaataattcagcaggtcggggtagtaattctcaacagagagcatgcccagaatgttaacatcctcagaagccaggcagctctgtcactactctgggtccctttgttctcatcctctggtgcctcctccttcaacagtgtcctccagacgcctttctaagaagacagcactcctccagttccttctgtcccacattgtcccacactttcaagcctgcaatcttcctgtctttgtctcttgtctttattaacggaataaaactccattggggctggtgagatggctcagtccttagaaagccagctataaaggcttgagttctgaccccagcatccacacagaaagcctggcccagaggcacatgcatctgtaacgcagtggcaagaagggaagaaggggacaggctctagcaagtgagctccaagctcgacgagagaccctggatcacaataaacaaaaactaaaactaaaaaagatggggagagtggggtgagggtagtgacagaggatgatagtggacatcagtctctagcttccatatgtacatgcatgcaagcctgtccacatgcacacatttacacgaacatgcacatcatgcaacacatacacacacacacacacacacacacacacacacacacatctataagataaaggatctgctatgggtagacaagaaggtttttttttttccctcttcattttatcttcttagggtgctgaggatttaacccaaggaactgagtgtgctggctaagctctgtctctctctattgagctccagccccagctctagaatagtaacttcatagaagcaggcaactgctgaccaaatccttagaaaactcctggcatatacaggaaattaaaaaaaaaagtcttggtgaccaagtaaaatagtgactttaacagtatgtcacagtctcagacagaggctctagaccttcagtttgcatctgtgtggcgctgaggaaggggcctcatttagagaagatatcaatattttgactggtcaggatgccagcaacatcaatattgtgctttgcatattctggggataaaacttaagcgtgataaaatgtacagatctcaggtgttcaacggagtttaacacgagtgactcaattccctatcaaggtgtgtaatgcggccaccactcaagaagcctactcttgcccctgcacccatccattcttgctccttccatggctctgatttttgcacagtttggtttttcccattctagaacttcatgtgaatggaataatacagtacaccccgaggtgtaacgcaacagtccacagcaaagtgctactgagatccaccatgttgctgcaaatacatttctctcattcactgtggagtgtcagtacactgagttactatactgtttggttatcaagtcctcccaatgacaaacttccagactattccatctcttggttgttatgaacacataattcataattatgatgaccaatcacagttttcatgaatgttcctgaatgggtctttttatgcatatgtgtctctctgtttcttgagtaaatacataggaatagaattgttggattaagtgatattttactttcacatgaaaattccagaactttccccaaagtggctgtgtgattttacatcctactaaggatgggtgtggattctagttgttctatatccctactcaccattttatattgttgatcttaaaattctagccatgtctatcatggtggcacacgcctttgatcccagcattcaaggaggcagagacaggtggatctttaagttcaaggccagccttgtctacaaagtgagttccaggacaggcaaggctgttacatagagaaaccatgcttgaaaaaacccaaacaggggctggagagatggctcagaagttaagagcaccaactgctcttccagaggtcctgagttcaattcccagcaaccacatggcggctcacaaccatcccttatgagatctagtgccctcttctggtgtgcagatatacatggaagcagaatgttgtatacataataaataaataaaatctttaaaaaattatttaaaaaagaaaagaaaaaacccaaacaaccaagcaaccaacaaaccaaataaacaaacaaccaaacaaaaacaataaaatatttttaaaaaattctagccattctgctgggtacatgaaggtaacatctcactgtagcctaaaaacatttaaaatgaattatttttgcttattattattattagtgtgtgtgtgtgtgtgtgtgtgtgtgtgtgtgtatgctcagtgcatgttgaagcatgtgccacatttccacatggaactcaaaggccaatggtgtggaatctgctctcatcttcctcctcctggagcttgacctcaatagccagacttgagctgcaagcttgcctctacccactgagccatttcactggctctcactgcagtttttaattagcagtttgctgaccttgaattgtgtcgaaacattttccatgtgattactggcacacttatttatcttcttgtgtaaattgtgtattcaaatatttcacttgcttagcaaagttgtttttcttttattatcataaggattatttattctgggcacaaaattttttgtcaggaaaatatttttaaaatactttctcagtcaccacactttattctgtgaaacattctttaagttctgtgcattttctttattttatcccttgtgtagtttttgcaacttgtctgggtctcgtgtacatatacgcccgtcacaagtacttctggggctatgcagaaactactgacggaaggtaaggagaacccgataatggtatgtttgtgcaaggtacagcagggtgtgttttccgttcctgagaggattaagaaccaatggagtattggtgaccaaagtgacccgcgttgcctgaggccagtcttgccaaaccacacaattaggcatgagatgagaaaatggaggtgggaatctgctcaatgcacaagctgcaaaccccagcaagaattctgcatcgtttctagaatgtttaggtgaggggctggttgacctcagtggcgtggcatcccctctaattttcacgatgagctaagtattttaaatggcctctttctgaggttctgagcagttccaacaaggagcaagcagcctttgccaggaccccaaagtcctgttcgcagcccaactagccacctcaccccttcatgcttaccctgcaggatcactggtttcaagctgagcctgggggttttggccttgttgattgtcctagctgtcctgggattagcaagcagattcctggatgaatacctggacctccatgttgccaagaaactgaggcatcccttctaaggttgtctcttccctcccatgctggccgaggctttgccactctaaagacaatgtggtgtcctgtgttaaataaaacttttaaaacttttcatttgtttgtctccctgtggctttgtgaaaacaccccatttgccaaccctgcttaagaagtgtgcttcctggtgtgggcccacctgcaacattgttgcatcagtgctgggctctggctttggcatgtctgttgaacgtgtgactgtttctgtgagaatgaagcttgacccacatgctggcattcatgtgaatcatcactacagtctctgacacagcttctgtccccatgaggagttccagagagaagcagctcaggcagatgggccctcagcactggctacggcacagcaacaaatgccaggagtaagagatgtcaaacacatgagatagccagagaggagagccattgacgaaccacacaagaggtgtacttcataaagaacaaaggaaaaagaaaagaaaaaaaaccaaccttattttaaggatccacccagggacatggatattcacgccccttggcaaagggaggtggatcctgctgacagtggtaaaatctaatccggcttccactgcgtatctgtgtcttgtgggacttgtggcataattgaggacacagtggaagctgagtggctgttctatcttgatgtgcagtcactacctggcaccactcatttgatatttcagtttttcatctgagaaccaggagcgattccagcctacagcctcagagaccttaggaaaagaggacctgggctccaccaccaggcagagtcctctgtcagctggtggccccatctccagacacccgttactatactagaatatgaataacaggcaaggaaataagaagcaacagagcttccagaatagcaggagctggcaacccctggacagcagtggtaaggcactggtttggaaaggggatatttgcactgaagtcccatttccccattgctaggtgaccgactgtggacaaggtaccctcaatgggaagttgcaaggcaaacactgagttctcttcctgtcacctgatgggcacagcattggaccccagcactctgtagctctgaccttcattttttttccttaggcaaaatagggttaatccttaaaaattccaagctaagtgcaacttttttttttttagcactacatcatatttatcgaattcacatgtcatttggaagaagaaaaaaaagctttccaagtttttactatctcaaagtaagttctattttgtatttagtttgagcatgctcatgcatacacatgtacactcatgcacacgcacacagatggttaaacacatgtggaaacaggcaaagggcgtgccaggttttcaacacttcccatcttcagatattaccatgggatttgtttttgttctaatccattgccaccaggaaatgtctttattattttaattactattaaattgggctataagactctgggtagagccagcctcctccatagtagattgcatttgcttctggccaaaaagctgtttttgtgttgttgagacagaggctcagtctgtccttgatttcatgatgcatctgtcctaaccttccagtgccgggcaggtagtgtctgttcagtagtctgacagttgttcacacatgctttgattagtaaatctgaccaatttacactcagaaaccagcttcatcctgacaacagtgtcatgagaagaggggcagaggaggcaggcctttcgtctgctggagaagtcttagaaggagagaagagcaaagggcagagagatccttgaggaatcccatacagagaaaaaaaggacagctgtgggaaacctttgcgagatgactgtcactacctggatgtaacatggaataagaatagaaatgatgagggaacaccgataactgttgtaggtgttttaatgacaccgtggttaaggcggagaacgtcccctgccattgcatgctcaggtgctgaggggggagtggttgaaggcacgtgatttgctctgaaatgcttcccaaattctgcataagaagtaattattgcaaagtattaaccacggttaaattgagctgatgactgtgagacagtctttctgtttccccaacagtttggagatgttcaaagttttaaactcttaaagaaaagttgaaataaacaaacaaatcaggttttccatagctgggaagtttcttttgttctgtgttagagatgtgatgggggacacagtggcaatgcaggatccactagtgttggtctgtccctgatggcccatgtatgggcagggtggagggggggtgagtacatggaagcagcggtaattcctcctcctgcttgttatttgaagtgagatggacacctgtgtcagctgggctatagaatattagagtaagaatctcatgtcctttgaacagagagagagagagagagagagagagagagagagagagagagagagagaatgaaaagaagacaataaaaagaaactgtgaagataagatatgggtcacatattatagtcttgtttcttcctgctttgtttccatggttgggcctcaaaaaatatgttcaaaatatcactaataagaaaaatatcacactgtttgtcccctcaccccagctccccctttctcagacacagtcctcgaaacaactcccctgagtctgggaacattccttaatccacagagaagttgaatatgtctcacatgcccagtgactttccaaaagcctagacatgttgcctcttcatctcctcactacagactgccacgggacttcttaacacccagatcacacacgggaagcatgttttttgagatagggttttactggtcaaccaggtagccttacactcagtgatccacttgtttctgctgggattaaaggtaggtgtgtgtgtgtgtgtgtgtgtgtgtgtgtgtgtgtgtgatatccaacaagagagcaaaaagatggactaacaagacaccatgacttggatatgaaccatacatcggaaggagaaaggtagactctaagtctcgtggtgcagtgacagttgccttgcctgtggtataggtgacagatgggagggcgtttattgtgctcagggtggttgctgctacagcaaggggtggatgataaccatggcttgtgactgtccttggaacaaatgatttcaaaaccctggtctcaggagactaactttcacattgggccttgacacacaaaaatcttatgccctagccacactccaatactgtcttgtggcagaagatccatcatccagttctgggcattgtctagactggcatctacaatcatcttgtagaatcctctgaggcacctggcaggtaggtgcctgtgaaaatgtctgagcatgaacttcataccacacattcagttttatcttaataaaattatagatttatttatttttttaagaagaaaggtattccactcatccagcgcccaacagattttagtataaatttgaaagtgaggagccatcgttcttctcgagcttcatgtttttaccctgttgtcaactctctctctcattctccttccaaccaaaacaattcccctttaccatcccgttatctgctaaagtctgcgctcatacaacaggggccagcccagtggaggctactttctccatagcactgtcagccaatctggaagcacagcccactgtgggtagggctagcctcttcttccacagtgaaattcattctttctcttggcttatgtatttaaaactcgcctgttttggaactgtttctactgatgatgtttctttgtggtctattttctgataaactcaagagttttgaaacattttactgtgttttaagattaatggggttatcttaagggcaggtcttctcaaagaggagaaatggattctcatgtatgtgatatattaatgaggggattgaagaaggtggaggaaaaaaaaaaggagtggagcaacaggcggaggacaggaagaaatcaagcaagggggcaagtggaagccaggccccagtctctgcctgatcctgcagcaagctggggcaccattcatcctcagagtttgtccagacaagttactggccttttattatcctgcagcagcgagttattggctagagttagaggagtataaacttgaagcattttcagctcagggcagttacaggaaaagctgggagagaccctgttttgacagatgtatcgtgggctagcagaaacaaggggcacagggaagagaaggtgtcaaaactgcccattacagtgggcaagactactgaattgtgtctccccaatacattccaaattttttccatccaagttttactatccattttctcttcattatatttttatacattaatttgtatgtgtgtatgtgcacatgaaccatggagctcatatacaggtcaaaggacaacttgtgggagttgctcctctcctacgactctgtgggttccagggattgaacccaagtcatcaggcttggtggcaagtgcctttatctgatgagccatcttgctggccccattattttctgaatgctctgactgagctagttttgaattgttctggtcctggatctatgaatagacttcttcgtgttagatctcccgtccctttcactcccgtccctttactaggatgctctagtaaactcagaaagtctctgctgtgtggttgaattaagaaggcttgagagtgattgatttctactgttaaataattccgagaaaggaatctgcagttagtccatgagaacccgggaatgatacatctgcttaactaatgctggagcagaaagggcaccctaaagtgaactatgccatggattgattcagagagtgacatgttatttccattgtttgttttttctttaaaagtggtgtgtcaacattgcttcgctcttacatttcagagttctgtacattacttaatggaaatgagcaatgcttgctgcacaaagtaaaaacagaaagctagaaacctctgaattaaatggaggaagttgccacaggtcatacagtataaaccagtacttagatgtcatctgaagtgtatgtcacctcttcaacgatgagttggggaggaaataaaaatactctattttaaacaaacattatatatatataatatatttatatgtatactttttacatatagtagacccagtgatatctgtagcattgtaaaaacttatgtacaaataacttttttttagacattacatatacatcagcaccgtagtaaaaacaaaacaaaatgacctcattaaaatctaccatctattagttggtccttagactgagcactttcaggaggcttttaaaggacaatggagcccactctctccacctccagttcctcctcattgcttatatacttttttttttcctgtaacctggcaggaaaaggtgataaatttgtattctgttttctcactttactattttttttattttttggttttcacgtgtttccactcagttttcctagtggcagtaactccccattctgggagttcatagtcaccctgccaccacctctttggagaggcgcacagctcctcaccctggtgcctccagctttacttcctgtcagagcaggtctggaactctggaaagatggagaacagctagctccagagtgccctgcttcgggactttcccttctgtggactttcttgggtatggccggtgcagttcccacaggcttgggtttctggagtaagaagtatgtgaagacatagaatgaaccagtttgtagggtgtgttcgtgtgtgttcgtgtgtgcttgtgcatttgggtggttaggaggacaataaacaccatggataaaagtcacctgacctccaagatgggattgtgggaggtgaggtaaagagcaagagacaaggcttgtggccatggagactgttaattccttcttcgtttacacttcaggcaactttgtgtgagttaccaagagaactgcggtgtagcttttgaagtagactgctttcaggacaaggaacatatctccctctctttaacatccaaattggtaagatcgagtcatgaattttcagcatttccatctccagcatttgatatttgcctttctgatgatgggattgataaataagcaagactgattctggagtgtcattgttggccccatctgaagagctgggatcttcagaccattcttccctggggatagcagaagtatgggtgtaactcttataaagcctgcagcttttatcagtgtagcccacttggctccagtggagacctttgtatgccagacagtgtctaaattcctcttgcactgactttgactttgccccagtgcttcacctcctgggtagtgtgtagggagaagcaaaggcaaggctggcatacaggccaggaggactagaggcagtggtgagggaggaaggggctgggctggcagacactgaattcagcaggggtctttccatgctatggccataaacagacgaaaaccagctatatgtgtcaaatggatgaggactctgggaagctcagtgcaacctagagtaatggccaccatggccactggcagaagctgaccttcagggctattggatgggcccttctcaagcattgttagctatcctggtaagggggctggcagcaacaccttaccattcctgaggaccatcgctgggcaggagacaggtgaacctgcaggatccttgcttgtctccctagggccagctcaggcaagctcactgttcttcgtgcctacctccaaatccaggaacatgtctggaagtatacatctccttccatccagcatccagagcatttgtgacctatgcacatggcctgtgtgtctcccagcatcctctgctgggctttctctggctgaggttccatctctgaggtctcgggacctgaggcaggacggtctaaggggacctcatcttgggccatagtccctctgggctggaacaactccttctgggccagtagatcccaggggtgcttagcagaggaactcttgctgcctcgacttacccacctgctctccatatcgcttctctccaagcaggtgtctgtgtggcctctgtacttgattgctctgtggaaggcaggtggaatgaagccccacggagctgggggttgacacctgtaccttctactgtcagccagctgtcgttttctcagtttacgtgggtcaaaaaaacaaaaaacaaggatggggagccatcctgtttctttctttcctgtgaggctgccaccactacagatcttggccccctcctgactaggggttaccaaatagttcatcaagctcttgcatccactcatcccccgggccacttttgatgatggagtccacgaggtctgtactgtctgggaggccagggaatgaagccccagtactctcaccgctataattgtatgacatgtcctgagcagggttccgctcataggcctggccctggttgcttgcagcaaagctgccacctgctatttgctgctgtgctgggggctggctgaatgctgccatgccagggacaccctggctcagaccagacatgaccaaaggcctgacctggctggtaccttgctgccctgcgagtggtggcatcatctgacggcccatagctgctggattgagggttctcactgtgccagtgttagcatccatgactgactggctcagtccctgtgggaagtgttgttttgtcagtcttggctgaccagcttgaagtggatagctggcaccattgttgaatggtcccagctctccactagtcctccctggaactccttgcaagcctctctgttgccagctttgtgctccttgctggacggttcccatgacgctctgaagccttggtgggccttggggcctcggcaaggcctggcccacgggtcctttcaactgctggtgctgctgggaaagagccgagttcaccagcatgctctgtccaaagccactcaccatgcccaccccttggccagaggcaggctgcctgggtccctgggcttggttgtgtgggatgctcatgccactttggttcgggtgctgcagcatttgggtcattcctgtgctcatgttgtacattccaggttggctggttggaggggcactgtaaggcgacagtcctatctctgactgggcggctgctgtggccattgtccccgggttctgagagggtcccattcccatcatgcctgcattctgtgccatcaaccttgacgttcgcatgctctggagggctgcctggtttctcacagctgctatgtcctggggtgaacctacaggggagaaaaggacagccatcacccattattctctgtatcagtatgttgtaagatgttgctggaatcttctcttgggaatgacagtcctgtatatgaaagatctactgcagaacatcgccacaaaaggtcattacttagatgattataacaggtgagttgtgaaaactttgcaaagtatttgaagatacaaagtcagaaattaaagtcacctgaatcccagcatccagagaagatccctgccaactcttatttatatttaaatagacacagaaaattgaggtcataccccagcgttctgtttgttcacgttcagatgcaagtcatttcctattctgggtatcatgccatcaagtccgtggggcaccatctttttgagtgttaggaaaatgtaccatgggctaagttgagtgtggtgatacatgcctgcaagcctatcaacttggaagacagggaggaatgaggattgggggctcaagcttgggctatacagtgaactccagtgggattctgcctaggaaaggaggcgaagaatgaagaaaaggaggagggcaaagaagaataaataatgtctgttcaatgcatattctctgtgagaagtggaattcagttcagtagggaatccattcaatgaagtccccatttgactttttttctttaagacttgaataggatttgaggcacaaggtcattactgctgcctacaagctatgtgaccaatgagatggattttagatccaccttgtagctctccatgagcactagagtctgactcattggcctgtgtctgcagctagaaaaagaagacatcctgtctcttgttacttagcaaagaatctcatgtcttgctgtagcaaagcccacccttttggattggcaactgctttgcatgcgtccctccctccccccaccctcccttccctctcaccctcactcccaaacccctctcctctgtcactaagatgactatctagccaagcaaacaagactgatattgggcctgacagcactagcttgtccttacaggttgctcagctatcaaaatactctgtagccttgacaatgaagaatgatgagtcttgctgctacatttcaccctgggctggctagaacttctctatgaccaccaaggatcagcagacctcacaggggtcctccaggaattctttgtggttactctttttagtttgccaattattaggtttgctggttactaaccagatataaacagagcatggaaagcaacacactggccccagactctcgggaagtcaggaccagcaggtacacgatggcctcaccttggaactgattgacctgctgtactgggtatggagtccgctgttgctggaggtgctggcggggcagatgagactgctgtaactgctagaatgacacaagacaagagaagccagaggtgagatggggacagcacacagttgagtatctgccagttttgatgaaggcagtgtatcatttccccccaaatctagattttgcatggaaaaacaacatgcatataggcaagggctgcgtaaagtaaatgagtgagtggatttttactaagtgggaacaccttgaaaactactcccaccctcaaatccagaaacagatgctgtcagaagccttagtcattcccctctcttgacctagagcatcattagcttaactttgaaccacatggactacgaatcaccgaaagggagcctgacggtttccatctcttataagatggattccttcatgctgagttgtgtgcttcgtcttcactaccgactataattctatcatacagacataccacaatttactcattctaggagagacagtcacttagggtgtttctagtctgcggctgttgcagttattactgttgtgacatatcttctacagacactttcttcatttctaatgtttgacttgctggctcatgcaccaagtgaaacaattttaactttgattttccagtatcagcctgactgctttccttagcactatggggacctggctcaaagggacaagcaatgacttttaatgacctaagtagatgctgtgggtacaggaagataggctcctcgggatatatacatatatatcatatatatacacacatatagactaatcatatatatatgtatatatatacatatatatatgctaatcttaataccattatgtcacacgacctgtacaatacatgtctacaagtaaaatactccaaatttggatgggcagtggtggcacatgccttcaatcccagcccttgggagacagaggcaggaggatctctgtgagtttgaggccagcctggtctacaaagtgaattctatgatggccaagactacatagagaaaccctgtctcaaaaaacaaaacaaaacaacacacacacacacacacacacacacacggagggagggaaggagggagggagggagggagagagagagagagacagagagacagagagagagagagaggagagagagagagagagagagagagagagaaacaaaacaaaaaacccccaaaccctctgaatttgctgccctgaagcagacatgtgggattccagctattccaggagtcggaggcacacctctagtctttcttctttggtcgtggggattttgttccacaagcatcattaccggcatgctgggcaggctgttgggatcattatcatgtaaaggaaagagacacagggcaaggggaaggagctttgagttctcagttggccatcaagcatccacgtgaccttggatgcccataacctctttccagcagccgattaatatttattaagaacttctcttccatgagggccaaagaacatgcaaccagatccccactcttcagagtgcctgctataaaaaaaaaacacccaccggccacttcttaccacatgtgtacttctattttctctctcatgtttgctcctgggcaggcctgcaattttctgtttttctttcttttcctctaaaaggccagccagcattctggcatccaaaggaaaaaaaccagaaacagcctctgccctgttgaccccagcctgtgtgtctaccgtgggactatacacaaaaagagattaatcaatgcatagcgcattatgagcacaggccagaaaccatgcaaacctttcaggcaataatgcgaggacattattgagagcaagctgagctttcaaaagtttatcttggcctggggagagagctgagtcagcaaagtaattaactgcctcagaagctgaggccctgagtttgagtcctaaagcccaggtttaaagaaaaaggtgtaatcccagggctgggaagacagaagcagatggttctctggccaaacagtctagcctgctctggaagttccaggtctggagagattctgtcttagtaaaggaggtggacagtgccagaagaatgccacctgtgggttcctcgcctacacacacacacacacacacacacacacacacacacacacactttctccttgtcaaacttcctatacaatatacaagttccctcatttatagggagcactaagtgtgtagcaggttagggtgtggtttggagtcaggattcactacttcccttttctaagggtgtggtctccgaaccacaggagctcctccccagctccagtcttcccacccgtaaatgaagggtctttataatcattactgtttatctgaaactcaaatgggaagttctgttcaacctgtgtgaatggatgagagggacatgctacatgcttgtgagaggaaggcattagcctcagtctccacctgcttttaaccttcttggctctgatggccaggtcaactgagttcctgaagacaggcaggacctcaaatctttctgttgtccttcacatgggctttcaggaaaaacaaatgtttccaatatgttgtattccagaattgaaagtgctggggcttgttcaatgctgcaagactgagaaaatcagaatcagcgtggtgctgatgtgacaatcaatatttactctcagggctggggttcagcgcagtacagagcacttgcctaacaggtgtgaggtcctgggttccatccccagcattgccaacaacaatagcaaagaaatctcaaggcagaaagccgagaccatcccacagaggagcccaagtctactgcactcataaacaacacacagggcaggtactggcaagcagaatgttacattgacatggacagcacgcggggctgtagcttttctacaacaatccctgatgctctcacgtgttctgtgagccattcccatattcatttgtgtatatggtttcctaaggagtttgcataccattatctcaagtaatctttaagacaggaaaatcaggcaaacctaacctgctacacgaagacagtttttttcttttttaattgtgcagttcgtatcttctcacttacacacacacacacacacacacacacacacacacacacacacacgttcttatgtatgtgtgtggtgtgtgccaacgcacttatgtggagggtacaggacaacctttgatattcgtccccaccttctatcttgtttgagacaggtctcctgcttgcctctgtttatcctgagtgtccccacattctcccatctcactgtaggaatgttgtgattatagacaggcatgactgcacctgggattgaatgcaggcctttgtgcaaacattttacccatctcttcagccttacatgatttattcctctgttcaaaatcacaataacttcaaaaggatggacaagcccccaccctgagccaagtaatttcaacttagtccctcagtttcctgtttcctccatgttttctaggtagtcccatctcgccatagttctgaggggtttgttccgtctccttgtccacaggcatgggtttgacataactcttcctgcaatcttccacttcccttttcatcccttccccagggcttggctgagtgggctgtggtgtggcttgcaagcacacccctgggtgggcaccagacgagttctgtctgcttaccccgactgcttctgtgccttgtttgcagcacatgtatcagaaatcatttctcagggcaccaggcacacctgaaaatgtcctgggtttggtggaggagagatttacaaagcccagagtcccttagcagctccatttatcactgccggagagatattagcacagctccttgtcacacaccttatgcagggtgagagggatagagggttgtttgtacaatagctgccaggtggccgactgaccttggtaaaaagggagataattacatagctgctcaggaacaaaagcaaaaaaataggaacataagcaagctatgctcaacagtacaccttcttctctttggagggtgactggtgttttttgtaactgctgttcttggtgggtagggaccttgatgtgcctgtatcctactcagtgccctgaagagagaattccaaaattctaattctattaggaacaagaatgagcaagagtcaaagcattgctgggcctccgaggacagtctgacacctgtgatacagagcctgtctgcaggtccccacaggggccatcagggatctctcctggacagtcttaggcagttccttgggataacactaaatcaggcaccagcatctctaaaaacaaaacaaatcaaagattacaggggctgtctgcagggaaggctctcttccagagctggaggagttatatggctggggtgggcaaggaggcctaaggtaaagacacatttgtactaggccttcctttaacccagattgcctgagctctaggtaaaggtgtcggggctttctccagctgcaccctctcctccaccctttcccagttccctgatagttctgtgcccactgtaacattgccagtctactatttataactaattcagtacaattctccactctttcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttttcccccccccccgcggtgtgtgtgtgtgtgtgtgtgtgtgtgtgtgtcgtggggagggggaaagacagggaggagggggagggggagggagatggggagagatcaaccctgaactttattactcagggtccatctaccttgtttaatgagacaggacctggcttgcaaaccccacgaatccacctccccactgctggaatgatggttacacagcttctgcaggtgaactgaggtccttatgcttgcatggcaaaccctttaccaactgaacttcatcttgctagctcacaaattgtttgtatcactactattttgcttaatgctagcaatatcagggcctatggtaaatgtgagctagcccccaccacatgctggtaataaagacccctgtaccagcaaccaggagaagaggagtcaggcatgaatggaagaactgtcttcaggaaacaggccttcaaattgatgactggaagcttgtctttaaagaaccaactaattcactgagggataaaagcctagctaattgaaagggcataaattctacaggttcttctatgttactatgaagagttggtctatgagcatcttgacagggacagctgaaaaacctgttcctcacaaacagcagatgccaaataagtgccagctgaattgatggctcacaccttggaggggggtgttacctacctgctcagccaggatctgctgctgttgctgctgctgctgcctctgctcccgaaggaactgttgcttctgatgctccattagctgggctcgttgatccattagcatctgcttcatgatggctgcctgtggctgcccaccgaggaagccaagacccccaggactggctcctgagaccatgctgcttgaccctgggggcacagagttctgcatggggccggtggtcctgggaagaccgactgcatgctgctcctacagggaccagaagaaagcaatttagaaattctgcttggacacctcctgccatttcataggaaacttctgaggggaatggcgtagaagtcctagtttgggattccaccattccacctccagaaaaccatcttgtaattttccataaaaaccattgtgttggcctcaccatagtagaactggagaggccacagagggggggaacagtaacagtaacagagaatgggtctgggaaatgggaagccaactcatctgtttctgatgggatggcatagtggctgtgcactgggatttcaatactctatttctccaaagaaaggaaatatcccctcaggctgggctcgccataagtctcaagggtccttacctttcctgatatccaattccttactgtctactttgccaaaacagacatcttagtaaacaggagagacatacacagaacacatatgctgctagaatatgatcaccaacaaacctgatgttggacgttagtttagccaaccaagacaccagcttttttttttttttttttttttttttttttttttttttttttgtgtgtgtgtgtgtgtgtgtgtgtgtatgcgcacactagtgcactttaaattctgctagagttttggtagtaggaactgaaatgttttgttttgatcaaagctatataatcctcttttgtttgtttgtttttgagaaaaggtttctctgtaaccctgtcctagaactcactttgtagaccaggctgacctcaaacttaagagatccacctgcctctgccctctgagtgctagaattaaaggtgtgtgccaccatgcctggtcaaagttgtaaaatcttaagagagggttttcttgggaagagaaaggggttcagttggagggggaaggacatgagaagataatggtgaagcaatgtgatcaaagcatgttttatatatatgagaaggaatatatttttaaaagcaatgtaatctcctaatctctttaaaaatagaattgtgtctcatgtgtctgggataattctagcaccggggactggattgggactcttgattctgtaattatttgccagagaactgacaacaacttttagggactgacccatagggaagagagataatggggtaaatagctaatcccacagaggccaggggatatctgaagaacgccctcagaagggaaggctatgcagctggacagtggaggctaccagggggaaaaagctaacaggcacagtgaaaagtttctacataccgataagcctctccactgatgcagcaacccaaatcagaccaaatcaaaccaaattagaaaaagcccacgtttaatggatacaatgctcccagatggccttccagtcccccagtcccccagagaggagacaggccagtttaaataccctgtgggagtggtcttgagcatctctgggggagggggtcatcatttggtgggctgaaatactgcagagtttgaagggagatgggggagggggcttgggtggaatttccaccataacatcccagactctttgggtaaatggatgccaggggctggggtgaagcttccactttaacacacagaatgtgtgtagacacaaaactcaatttctatcatttctatcaacacactggcaatggtgaacactgtctgaatgctctgtggaatcagtccttccagttcactggtgtcaagcaaccaatctgagcacagagacactccacttaaacggcatatgagggcagtaacagcagtagcacgagacattctcatggagcctaatacaaagagtcaatgtgaggatctactcttattttaaggtataattcaaattggactttaatatattgtcccttttaaaagttgctgctgctttaatataaatgtggttgaccacaatggcaactttctcttaaaatgcagaaataagcttatgtttgcttctccagggtcattttggggtcgaatccccacaattctggctttgcagggcctcctgcttcctctttgctggtgctgttgcaggcaggtggtccgtcctggccaagttccatctacactgcgtcgccagactccccacctccctgcatccaaacaaaatggcataagcaaaacaaagtgtatcacttttattgccccagaaacagtagcagagggagatatgattagtttgtgtagtttgggctacacaagtaactggatggtctgaaaagataaccagggttctgactttgagtctacctcagtattctttccactctggccttccctcaactatgagtccacagtgcccggcacacatatcagaatagcttgtatactaaatattaaatatgttgcttgtaagcatactgttttgtatttttgtgtgtgtgtgtgtgtgtgtgtgtgtgtgtgtgtgtgtaaatgctgggtatatacatattcctatgtaccagcacccacagaggttcgaagagggcattggatcctctggagctggagttacaggcagctgtgagcctcctggtgtgggtgctaggaacaaaactctggcctgagaagagcagtttaagtcttggctgctgagccatctctatagttcatgacaaatgcttttatttatccatgtgctctgcagtcaggtagagagctatgaaatatttttaatgttaataaaaagccttatgctaaaagatggtctgcatggcttcagagatctaggtacaggacagagttcccttatcttccagttctgtgggctacctgtctctgtgttcatcttcctccagggtcaagttgtttcttgccaccttgagagacaaatggctgaccaacttaacactctcacaaatgaggtaactcttgaatggagctggccaacactcaaaaggacagataatagatttgttttttttttcatgtatttcaagtctatttgatatttcctggttttgatgaggagagatttgaagggaaaatgagacccaaggaaatttccttagcttgtttgtgaaagggctgttcttgctggccttgtttctcttgctgcacttttgagattttattgcccacgtgaccccctgtatagttgaggaatgtacccaggaggtggaggacctgcttttccagccttctctcccctgggaaaataagtatggcaaataaggtgatgatgctcatacaaccagccacattttgtccctgcagacacagtcaagggattacctctggcgttactttcattccccaaatggtcctgtccccaaagttcttagtgaagatgacaagacccagtggctagaatgttcccttccaaacacaacatctttaggggcttcccagcaagcacacaggtgtgtgtctcaaagcgtgaaagtgcaccgtgactggttttccaaatgaagctggtacaggcggctgtttatgtcacacagcttcttttaacctagaatctaagagggcttaatgagaaagagcctgtcaaattctaggactctaagccccagctcttgtttctaaggaggggacacactgggttgtgcaattagagaaaaccagagtgagctttcgtcatgcgacatgtaatgcctcagagccaaatgatgcagtatttttagttttaattactggtttgttctccactctcagccagcccagcgacctcccttgctttccacccagaatcttaatacagtctcttcccatagcttccaatttgctatgcagatcttcgtggctctccaaacactctcacttttttgcctctccagtaaaacaaggagaggcaaaaaagagatcaaaaccaaatacacatgcaccttccgctccagggacaagagcttaacaattttctaagggctagagtgaggtaggagggtgtaaaaaacactgtatcctcccccaaagaggcagtttccgacttcaaaaatcagaggcgataaaaatatcttccgagaacagccagctgtttatttataaacctacttgtggggaaacttgctttctctgaagggattttttttttttcacgaacatgaggcgtttggatgctaggggccagagatgcagcggataaggaggatgatggattcctgggagggacagtataagacatcctgggtatttggatccaggaggccctgggcttcagccttttctacgtggccccaagaggaccctcttgaacagctgctgttctgccggtagcccagcagatggtggtgtgagcccaggaccgcactccaggcctcgcgctgagcccgcgccccccgcccatcgcagatggcttaatcagggctcggtcccccgccccatcagggccggcgctgcggacgtggagccaggcagtcaagtgttactgcgtacagcaggtagcctggcaactgcgagcataatacggagcagatggtgttcgcacggcgtgatggacatcacacacgacagcctgagacaatccaggaattccctggtggctcagggccctctttgcacaaaatgagttctctctccatggacctgcctcttggtggtggtggcgcgcggggggggggggggggcggggggggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctgttgtaggggacagggttcctctagccagagcagcacaaagcctgtgcagggagggaggaaggaacctcagctcactttatgcaccgcgtggcctaccagtcgcccaaatgaaatttagggttttcgttaaaaagtcccctggggcgtaatttagcctcttcaactccagcctatctgcttacaagtcctcagggggctcgggctaagcaggagtggggccgggagctccaggcttggccgagagaggctcactgcttggtaatcctaacaaagaccaggagctctagggcagggcgggtgccctggggctccctggagaaactcagccttgagctctggggcgggcacactgcccagtgtcacaactccgagattacctgtagcctggagaacaccggataaaaggacacataaacagaggtagggctgttgtgggtataaagagttggaataaaacaataagcaaacagaaaggatgcctagaaaacaaatctctcccccctcctcccacacaaaccgaactagggcaagtaataaaagaaaaaaaatcaaccaatcttggggccaaataaatttttgactaaattctatatatcaaaagatttaatatccagtacttagaggctgtctgcaaaggcaagttttaagtttcagaaggctagggtctacagaaggtgagagctaggtcacacctgcccagcaaggttttagcacttccacgtcagctagcagcaggcaggatgaattcatcacccaaaggacccaggttgtgacttccagaggcacaggcaggctatcttgtctctatccagagtcccttgaaatgaaaatcacgtttaaaagtggtcattgacaatgaaaactttggagatgaaaaaagctaagcagatgtgaaaacctccacgttctgcaggagcaatttgtgtactgcaatgggcaagagcacagcttctcaaagtgtggcccaggctcaccaacattagcattccccaggactatggcagaaatgcagattctctggctccagcaggccactgaatcagaccaagttctccaggtgctaccctgtagtagttcgggaattactggagcgagtaatcctggctgattgccgcctggtcctgatttgattgcaaacttgcattttcaaaatcaagcctgagtgtgggtttgctctggttttagtgcaaaatcttctgcatttagacttaaaactccccctccctgcacagggttggtcgggtcagcgatgtttgtcatggagacctaagaattctcaagggaaccagggatcataactcttcctagaaggatggtattccagttcagctgtgctctgcaagccaaagggtactcaagactaaggaatgggtggtcccttgctgagggacagcaccaagaatgccctgaattcccctaggctagaaagctactactgtttgacaaatgtcccctttggtttgaaagggttcttcaaataaagagaggacagggccacaatagaagatgataaagaacttgtatgaggcacccaatataggtataccactctgctaggtgcatttacctatgtaatcaaatgcattccgttgattagaaagcacacgtccccgagaggttaaggaacttgtctgattatcctgcagctggtggcagcatctttgggatttgaacttttctaccaccaaaacatacatctggtcgtaattgagcagaccacccaggaggactctggagtaaagagcaaggggaaggcaagggaaaaggatggacacagactaaaaagggaggaactattagaatcaaaggtcaaagaatgaaactaaatgtgaacaaaaaagacatttttttattgttgcctgagattacaaattgggatgtctctgtgttatcaacttcgacatttaaaaaaataaaagggcagaagattaggccattcaaccgtaagtgggaagatgaaacaaaataaattaaaatccgagttccctctgaagtccatcaagtgtcagggcagaagcatggcctcaggatggtggcaatcttgtacaaattctctttttcaagaacattttttccactgtgggtttggaaagcaacttattacaaactcccatgagagccccaacagccacccccaaacacccctgtttcataagattactcaagaaggttactttgaaaggtttgttttgatctgggtgtgctggtatgtgcttgtagcagtagaacttaagaggcagaggcaggaggattacaggttgaaggctatcctggactacacagtaagacccctgttgtttgtgtgatgggtggtggttgtatccctccaaacagttgagttttaagactctgattatcaatttaggaagtatttcactcaagcagtagtaactaaggcctggttctactaccaagaagctgttttcctagtaattcaggtcctctttgggtccatgatcaaacatgttgatgacagaacaaccttcttctggttattactcttattgttggagcatgatctctctcagagagagatagagagagacatacagagagatgcacagagagatacacacacagagagacagaaagagagatggggagacaaaggttgatgcaggctcactactctattgttctctgtattattctggacacatgggttgggctagactggctgaccagcaaggtcttcctgtctccatctctccatacctgagattataacctttttagaacctgggaagtggggatggagctcaggttgtcaggcttgcttggcaagcattttatccactgagcttcctgaggtgttttcgtcctccaggatggggtgagtgttgtgcttccagctctgttctaccgaagaggaccaggactttcaaattggttttctttctagatttcaatgagcagacgttgtctactcacacaccaaagagaaaaaagttgtagtcacaaaattttcatctacatattggaactacctgaaacaaactacatgcatatgtacacagacttttctcttactactattccctaaacaataatccattaacaactatttatataacatttacacttttaaggtattacaagtgacctaaagatgattcaaagtatatgggaggtttagtaaggtatatgtataaatctcatattttatctacctatcatctatctatctatctatctatctatctatctatctaatcatctatttttgctttcttgagacagggtttctctgtatagctttggagcctgtcctggaactcactttgtagaccaggctggcctcaaattcacagagatccacctgcccctgccccctgagcactgggattaaagacatgcaccaccaccaccccacatgtgtatctcatactttagataaaagacttaagcatccatacattttgctgtgttggagtgtgtgtgtgtcctacacccaattccccgaagattccaagggacgactgtattgaaaacatgcatgttgagctggagagatagctcagcagctaagagtgagtgctgtttttgcaaaggaccgaaatccagttcccatagccataccaggcagctcacaaacaccagtaacttcagccacatgatctagtgcccccttctggccaccacaggcacttgtactcacatgcacagatacacatatgtatgtgatctaaaacaaaaatctttaaaacaggcctgcttccaaacacagaagttttaaaagtaacgtagaaaagtagaaaaaaagaggtaatgcttgtttataatattccaaggtaactgatgttaatcttacaattgcattcaactttccccctcctttccttaccatttaaaaacatatctttatgctcctgatcatgacatatgtacggtagtacatcctaccaagtcaaacccagcaaaatgggaaaacagaaagttccaactttccaaatgcttacaagttacaatttattggcaggatgatactttattgactcattccagcagggtattttgttcttggaggataaaggcctgtgttttttttttttttgtttttttgtttttttgtttttttttcctccagcatccagcacacttagaggcacagttgccacaagctaaactttctgaatccagctaactgcgcatgacgaattctagcccaaaccaacaagggtatgggagaaagatgtccttataaacagactgcttatttgggcatctgctggggcctctggtgaacagtaagaaagggttaaagttggcagcactctgtgaagatgtgagggtatgcaaccaagggaaagggcaggttttcaaggacattcttggacattagaaaaacaacaaataccagtttttcttgtcagtgctttgaccaaagttacaaaccctgcctgcagtagaaacataactctgagagttaggcctttcctctgcctttgatgtaaattatagagtccttttgatccttttgtctcatttaattccaccaccaaagcaactctaaattggttaaaagttcattagtgtacaacaatagcagcttgattaaataaattatggcacatccataccatgaatgtgaggcagtcaataaaaatcatgcctcttggactgtctaatcatgtagaggaagcttgcaatatgcagctgacagagaagaaataaacaaaaaaaatatctgaaacactagccacagctaatattgtcagggattatgagcaacttttttttctttttgagacaggtcttcctctgtagcccaggctggtctgagtctcgatatgtacatcaggctagctctgagctcacagagatcctcttgcctgcctcctaagtgctgggattaaagatatgcttcactgttgccagcttcaatttttatcctttaatttttttatatcatgaatgtatgatacttttaatttttaagtcacttaatttattcatataatttatttatttgtttgtttattatgtgtatgtgtcagggtatctgtgagccaaggcatgaaaatagagcccagaaaataactctcaggagtgagttctctccttcttgccatacgatcatggagacttaactcaggtggttaagcttggcagtaagaaccttgacctgctgagcatgaatgtacttgatttttaaataaatgttactattttgttgtttgtttttgttttgggacaaggtctcctgtagcctagattggcctcaagtctgctgtgtagcctaggataaccttggtcctcctgccttcatctcccaagtgctgggatcacagatacgtgtcaccatgcccacataagtgttactagtttgacaagctcattaagagtgagtctaaactgatgtggtcctgaacatagttagttcatgaaggacccaggtcacgtccagcacatggctgcctcccaagtctactttctgctctgcataatgcaacagaaagctttcaaggcctagaacgtctgtggagctcggtctggctaccagatccatagccagcctgctctcaatacttcttcagaaaggcctcaaatgccagaaaaggctcaggaaactgattgtcttccaaacacagctcatctgtagtggaactattctgctctctgtagcttttcttcattataggctcaaaacaaagagatggctagggccacagagtgagccaggcatggcggtgcatgcttgagatcccagtgcttgggaggtggtgggtctctaagagctccaggctggatcagtttctttctatggctgtgacaaaatacccaaatggaaggaaggaagggagggagggagggaggaagaaaggtgtcttagttactgttcattttccacgaggaaacaccatgaccaaggcaatttacaagagaaacatttaattggggacttgcttacagttttagagggctactccatgatcttcatggtgggaagcagacagacatggtgccggagcagtagctgagagttttaccttctgattcacaggcagcaggcagagaggttgggcctggcatgggcttttgaaacctcaaagcccactcctagtgagacacctgacaaggccacactttctaatccttcccaaacggttccattccttgatgactaagcattcaaatatattcgcctataggggcattctcattcaaaccaccacagaaggggtcattttgcccatagtctgaggggacagtccatcatggtggggaagtcattgcagcaggagcccgaggcagctggtcacaccacatccgtagtgggagggcagacatataaaacactgatgtgcatcttgtttactctttctcatgaattctgggatcccagcccaaattcagggtgcgttttcccacctcaatgaacccaatctaagaactccctctcatgatgagctgggaagcttgtctcctaagtaattgtaaagtcagtcaaattgacaatattagctgccacagaggtcaacttggttagttcaacatagttagttcaaggtcaggaggtttacatagagacactttgtctcaacaaaagttgccccgccttggtggcccacacctttagttcctgtactcgggaggtggaggcaggaagagctctgtgagttcaaggctagcctgttctacagagtgagttccaggacagtcaaggctacacagagaaaccctgtctcgaaaaaccaccaccaccaaaacaaaacaaaccaaacaaaccaacaaactaaattactagttcgaaagattcaggaagatagccacttggataagtcttctctagactgtaacagaacctgagcagccagggctcaggacaatgctgcaaaggaggctagcccagcttttgaccccatccaagaggctgccctccggagtcaggatacacagactgtaaatggcttgtcaactattgttagggtctccacccatccactttcaactttctttcttcgatttacaaacagggaagggaatgatctcagctgttgtctgcagctaggaattttttttttcttccttgagctctctctcataatccagaccctcctctcccggccttctgatggagttctcaaagccaaggttgcataacggatacacaggcctatcttgtgttatactgggagactggccaatgtttccatttatagacaagagcactaccgagctgccaaatggagtgctgtgctgctgtggctacaagatggagaaaggaaagagcaggagcccaagacttaaagggatgccttgaaccttcccgccagcctggggacagtgactgaagagacttagctctatgcatctcagagcagcttcttccaaatagctatccactcaatccccccaaacactgccacaggacactcaggtcagcctgctctgctggcctcatgacaacaggaaccatctgtaggcagactatgggagcacatgaggctgaggagagggctactgtggaccgctgtcctttgggtaagccatggtggttgccttcttgaactcagtagctgtgattagcagaaggtaacatgcctcagacaggacttgttaacattccattgtgcaaggggtggggctcacaaggtcccaccctcctgtggataaacaaattctgttgctgggaaagtgagagacattttctttggtggaatagctgcttgtaagttgcccacactcctcaaaaaccctctcacctctgctcctgtaagtgccattagttaaattcattggttcaccaaaccagaaggctggttgacatgagaaggctgggcctcagacatgtaaaaccctttgaattttagcttttatgcatattctgaacatgtggtttgacaacagggacattttggtgagattgaaagataacaagcattttcctactttacactgtgtcctctgttactcaccagggtgttctatgtctattatcaactaacgttcttctgtgtatgctcatgtatgtgcagctgcaggtgtgtacatgtaggagcaggctaaggacaaccttgggtgttgttccctaggagctgtccatcttgttttctagaaatagggtattccctagaacttcagcttgcaaatttagactaggctggccagccataaaacaacagggatcagcttgtctctgtctccccagtgctgggattaaagtacacaccacgtgcctgactgatttatttgttattatatgtacacatacacaagtgtatgtgtacgtgtacacatgttgtatgtgtgtgtggaggtcagtggacaatttgtggagttgtctttctgcatagaaccttttcacataggttctagcatcaaataggtttttaggcttgtgtgacaaaaaacctgctggcccatccctagtatttttttatgtggcttctggtgtgtaccaccgtgaccagcttttaaagaactgaatcctgggaactaaactcaggtccctgtgtgtgcaaggcaagcacttcgcccactgggccatctctccagctctcaactaattttctttctatatgtgctgcatgttagagaatgaaatcggtgctttctcccacccttcttagccctaatagcattttttgttcattttataaacatacatatgtagtgaatctaaagaatcaaactagtccaagcattttcttaaccttgagacttgggggaaaaaataggataaaaaacagtttgggaggaaatgtggacctcaatgagagtttcctagtcagtaggtgatggttagaatagtacatggtggagcctggatggaggtgtaggactctggactcaagagctagctggcctggttggaggtgcaggcctctggactcaagggctagctggcctggttggaggtgcaggcctctggactcaagggatagctggctttgcacaagacagaaaaccctctgcttctatttcacagcaggatcaaggctaaaggagatctgactgggatcgtagatggaagtgtagatttctattccaggggaggacaagagaaggggtagttaccgaaaagcaagggtgaggtgtttgtctaggcgtgtgggaaaccaaacttgccagtggggtggggacaatgactagcctcacacaggcctggacacaggcaagacaactgatgtgaccaacgagcaacaggagcctgggtaggctctcagggagtcgataagacgataaatgcatcgctctaagattgtcaagtgtcaggtagggcagagattagactgggtctggatgaggaggaaagtacacaagaaggatggggaggtagcacttgggggtggtctggccaactgctgaggtgaatctggtttcttactgtggaaactgagaaggataaatcaagcctcttgcaagatattatccagtaaagctgcaagacctctttatcacatgcaaaggccactttctggtccactgagtcccacctcctcatgctcacttcctgtctgttatttcccctttggtaagcccatgtgactactagagatgtggcagagatggtaagccctacctacagatccattgtagacctaggtgtggcagtgcatgccggtaatccataactcaggaggctgaggtaggaggatcatcagtttaaggtcagtctgtgttacacactgaagccctgtctcaaaattaaacaaataaaacaagaaggtcgatgaaataatcctagtgttccatgtcctttccagtcttaactagctcagtgcatgaactggggagatagctcaagggttaaagtacgtgcctggtaagcacgaggcatagagtttgtgtcctgagcacccatacgaatgccgggtaggtgttgtggttcacttactattccagcaacaggaaggtggagatgggatgcccagagcaagctggcccgctagtttgctgattagatggttagctgtactgccaagttgtggattcaagttgagagaccctacctcaatgaaaaatgtggaaagtgatcaaagaagatgggcctccatatgaatatacacaaatgcaagtgggcttatgaacacacatacacatgcacacacactcacatgcgaatacatgtatacacacacccatgcacacacacacacacacacacacacacacacacacatgacaatgtgtgtgaaaatacaattaccacaccatgtctaaaatactgtgtgtgggtggcttttaaagggactagaaagtatatagcataagtaggtacatgtcctgagtgttttcaaagccctaacagtatttcctggggatgaagggaagccgggaaacaacaggaaatcagatcaaaactaatttgagaggagggcaacttttaatttgtgcttcttttacttggctccccaactttctacttcatgctaaatactttggttaatgcctatcaaagcctggcaaggcataatgaaagtttgggggctgcccaatttgggttttaacaaagtggtcttcataacaaatgtggtaactagttatttcctaggcttaagctcactcttggagagaaacagccagaaaagtacttggttcttattgctacatcttgttcacaacagaaatattgtgctaaatatttcttttttcatttaaaaaataatgcttaagctagcacgaggcatgctgtattttatgggatagtgttgcccttttccactaatttttaaaactcaactagagatggtgattaaaaaaatatttgaacaaaacagtaaattagaatggggcccctcaggtcactgaaaattcctaactgaagctaagaatctgcaggaggttctaggtaaagcttgttttctaatttaagttggtggcctagagtcttccattgaaacacaaaacattttccctttgaaaaatcttccctttcttagatgacagtggggtgaagcaaagcctgccattcataacactaaaactctcttgctttggcagcacctgcctgggtctcccactcagagaggaggaattacaaatctctcaggctccccaggtccctgctgccagggtctttcccacactggcctctgtaggaacaaaattcctcagatggttgacaccagccaatttgttttcctttcccctcccccttcttttacccctccctttctaataagctatattctgcccgagcctctcaaagtagccaggggccagcagctacagcctctccttgtctgaatgagcctcttctattctgggttctgcctagtctgtgttctgaaggaagagaggaggcttgagctcaaaatatatgggcagaccaaatgtgtgcttgtttctttcctttctctgagacgaagtgttgctgtatgaccctggaacttgtggttctttgggattgcgggaatgttctgcagcacctagtttaaacattatttttgtattatggacctacctttcacgaatcctgaggagctgaaggaagtaggcaagtgggaaaataaaacccaaaggtaaacctgtaccactgaggaaaacaactcagggtgggagggaggaatggaaggaacaggagaagggcacagggcacaaggcaacagtttccctcttcaggataggatgtcccctctgagcatttgtgtgtctactttagagatggatttggggtgtgcatatttgaaaatctcgtatgagggctgggcatataggtttagatgcacaatgattacctagcaagggcctagattccatcttcaacaccacacacacacacacacacacacacacacacacacacacacacacacacacacacacacaaagaaataaaagtaaaaaaaaaacaataatactccccccaaatactgtaggtgatatttattccttgtccacagtattagtcctatgcctgttacttaaacaaaatgaaacaaaactgtggatgcctgtgtgtgcctgcagaattcagaggtcagttagggttgggtgtcctgctctgttactctccaccttaatttttgagacaggacccccttcttaatctggagcccattgactgtctggatgactggcaagccctcctccatctctggccttcccttcggcgctggcttcacagatgtgcaccgccatgcccagcttaccagtaaaggctttcccagctgagtgatccccctagctattatgcctgatacttctaacaaaatattttttaaaaattctttcttctttcatatattgcagactgactgcggtctctcctcctagcctcctcccccatatccccttctccccaaattaagtcaaactaccttaggaaattgggcaattcttagattgtgagaagactgggttaggctggcgggggtggggggggttagaggaaggtctcaatccagggtagtctacaggcagccattttgaaagactgcaaacacaacatggctttgtgttttggtcctcagatgacagatcatcttggtgactcagtgtgtgcaccatttctggtcctgcattttggtgaacagagggtggataagacctgtaggtgcatgagtcatgctcttaaagttccagagtatctaagtttttgtctgagttctgtgacggggtcaacaacaacccagcatttctacacagacttcaaacgtaacacacatacacacacacacacacacacacacacacacacacacacgtgcgcgcatgcatacatgcatgcacgcatgcactatatacttatacatgtagactcccatgtgtgtatggaggctgaggaccacttcaaacattatcatgcaccgtctgcttttcctttttaaagacaggtctctcattggtctgccgctcatcaaggtacaatggctagtgagctccagggaccctcctgactctgcattcccagagcaggggttataatgtcatgccaccacgcatagcttttttttatgtgggtgctgggtatcaaattcgtgtctcttgaaggactttattgactgagccatgttaccagctctgtaactaatattttctccccagaaaagactaggaatttcctcaaaatgggagaaaaattaaggaatggtttataaatatatagtttctatgttcaaaagactgaacttctgattataaaaagtaagggcgatgtttggatctgaccttatggtcctaatttagtgttttaaaatttttaatgtgtatgagggttttgcttgcaggtatgtgtgtgcatcacatgcattcctagtacctatgaggtcagaaggattccctaaaattggggttgaacttgagtcctatggaagagcaacaagtgttcttaattgctgaaccacctctccagaccttatgctttcagttttgaggtttctttgcaattacacagatttttgaaaatgaagcatacagtaatgctaaaatattgaaaagttttcactaagagatgctactactcaagtaccttggggccacagcacaggtttggcagcatgaacagtgatgtgcacacagctcctttcttgcctgttttctcacagatgcaagtgagactctgactgttctagacctgggccccacagagactgtcctggaggcaactgtaaccattttctttggctcatgagctctagctactatctatgggacagagaggtgcccataagaggaatttgagagacaggaatctgtcaggacatataagagggctccacactgaggtcatgttcatgtacaagcatgcagcacttctgagcaaatgctgtcctcacgtggaatcctcaaacctgaggcagtgatgttaactggtgaggatttcactcaactgtggtaaaaaacaggagctattgctcctcggatatgaatcatacagagtctctaagtattttacagttaatctatattactgtcatttctttatctctttgtgtactccatagtggagctgaatgagaacacccattgtcctaccttgcatgcccctacccccagagtggaattcatgttacttaaaaaaaagttagatggcaaagaaacaatttggatggtgacagtgaatttggttgtaacctgaagtgccaataggatgccaaacataactgcggaaagcccaagaaacacagaacgctctggaattcatctgtaagaattattctctggcatgatgaggtagcctggtgcctcccacagctctatggaactgggaagcgagaggaacagcccttcagccctagatgacattagaagctttacaaagttaatgtggggtgtcatcctccagtttcagtaaaaatcagtgaaaggagggaaggagaggcctcctaggccttgtggttgggtgggtggaggtcactagctttcctgaggacgtgccagcagttgcttcctctgaattccagctgaattcaagccaggcccgctctagtagtggcctctggggcagttgggggctctttgttccttagagacagtgagacttaaatcccagttgaacctcagacttagcaactgaacctcagctaacccatgttgtaccatgtgatgaaacctgaccctctggaatccaccctactctgttcactcttctaacccccccatcccatgcctacatttgtggagcccataagaaaataaattaaaagagggagttgggtcctcttcaggctccattaatttccttgtatatattacctagaaaaatgtgctccctaagacctgttttatttattttgagacaagggctcatttagcataggctggtctcaactcttaggtagcagagagatcttttaacttctggtccttgtctctacttcccatgtgtcagtgttataggcctgggctactatgctggccttgtacattttaaaatggaagttttcacatggggggggctgttttgctcctagtctcagattaagatgaaaacatacagtgtttataggcaggtggagaaaaaggcactggcttcagtttgggacaacccaagttttcttccaggatctaactactccttcccaaagcagcagcctctgcatgtggacagcactcctcaggtgggaggttctcactctaggttgccatggagtttaggccaagaacaagtgtgtttatttggaggagggtgggtgggagggggtgcagggtctcactaaagtagctcaggctggtcttgctgttttgatctctctgcctaaaccttctgagttctgagattaaaggtgtatgccaccaagctaggctgaggatggatcttaaatatgagcgtagtatgatttaccaaatgacaaactactactactttctcttcctcctccttcctcttcctctccttctcctctttttctgagatagggtctctatgtagccctggatattccagaatttgctacgtagaccaggctggccttgaactcaaagagatcttgcttctgtctctcgagtgctgggatttaaggcgtgcaccaccatgcctgactaacaaaaatgcttcttaaatctttgtcccacttctttgtcttaatgcaatattttccccccaaatgaatttagaacctttagaagattgttgtacctcaaatattacttggaatgtaagaagatgggctctaggtacccagagataggactttgtgcagggaacgagatgtgggttaggatagggtgggtagggaagggtgggatggacaggggatgaggggtgcagtggatactgacataaaccccacccaagccacaatttcaacctcaaaagatccatttttgatttctgcatgcgagactacagtgtgtctctttttggtaaataaaggtacccacccaatgcagtgacctccaaggaacctgatgtagaaggaggcctttcttgcctttatttccactgtgatctgggcccagaacagaagctggaagtctacaatttcctgcctgatcctggaataagaagagtcttcctcttggcctgtgacttggaggttcacaattgcccttaccaatagatattcaacagtttcctcaaaacatcacagatggctatgctcagggcctccccagtacatcatatttaatcagctctgagactcacgacattgaaggcacatactctgtaccactagaaaaggctacccctaactatggcatagcatccattgtaggatgcttactgaagagtggagaagagtgtttcaggatcatttagagaggccccttagtcatcacaatctcagaggccctttagcctctaaccaacaactagcctggagtggtcacttggatctggctggctctgttcccgcctttgcagctgtggaaagtggccaaggtcctgaggacacttcaaagccgggttctcccctcatggttgcattcagagaagtgcttggaaaaacacattctgcacttctttgttgaggatcaaacccaggatcttcaggatgctagacaaactttctacaactgtagttttcggaatgatagcaaaacaagacaaaaagccccatataatgttgtacatatttccccaagagaacatgtgtacagacaagaagtagtaagaaaaaagatgtggcatttcttactcagaagagaacaggaccagtccctaaatgatactggcttgattctagaagaatgaatgtccctccacatttccagtcaccagctgcttccttatgatggtccatgccaagggctcaaggaaggaaagaaaatgggatggttgcacataggctatctgctaagtcaagataacgggctacacacaaacctgaggaatttatcctttctgtcttcacaaagacacagtagtctgagtctaactcagaagaggttcaactagtaaaaaccagatatataggaagaatgggtgtcacatgattcaatttctgtttttctttccttttcacattgctaaaatattcacaacataaaacctttcattgtaactacttttgagtgtacaatttaataacgttaagtggatccacaatactttgtaactatttctactactttcaggacttttcatcattccaaacagaaactttgtacatttcaagcagcatctatttttttgttgttctagaagcattttaactgctattaagggtactgatataaatttggaaaggaatgtgggaaatgcatgatgggaaaaaactcagagtgaaagttaaaaatgttttcaaatcttgtaagtgaactatcatcaacgaccttcccagtagaatctaaaacttaacgtgaaaacaaaatataattttacaaaatgactaagggagaattgggcaacttcaggccttttgcgatccttccttacaaactcctgtgaatcgggggttggaagtcatgagttcataaggatgtttaaggcaaatagagctgacaactaaagcctggctgatcaattctcttccccatccacccactggtccccctcccctctgtctacacagggtcagtgtcagcccatgctaggcacaggggctaccaagaaccatggccactggctggctctcaaggagagctcccacataggagataacggattaacaaagagtgtctaagtacgaaaacacagatgagggggtggcaaattatacctggggactaagatgggtagggaaggagttactaaaaaccctctttgcctagtgcagagttaaaatctgagattacctacttactctgagtgtatgttatgagctgcaaatacgaccaccttggagtgtttgtgacaacgacagtagatcagtaaactataaatcaggtatagtgtacaggcctgtaatcccagtgcttgggaggtagaggcagggggatcaagagtttaaggctaccctaggctaactgaggacttgtctctaaaaaaaaacacgaaaaggaaagaagagtaaactataaactggtgtgtgccttgtgactgcaactgcataaaactgaaaggagtgcttgatacaaaacaagccaggcagggagtctattatgggtgcttaattaataattatttttttttcaagacagggtttttctgtgtggcagccttggctgtccaggaactcacaatttaaaccaggctggcctcgaactcacagagatcatcccaagtgctgggattaagggcatgagccaccatgcctggcttaataattttaacatgcacttatatttatttttctgattataaatttttgttttgattttttgagacagggtttctctatgtagtcctggttattctggaacttactttgtagaccaggctggctttgaaatcacataaagatctgcctgcctctgtctccagagtgctggattaaacacgtgagtcaccactgcccagcactgactataaatttatttgatatggaaaatctgaacaacacagaaaaacctaaaacaggaagatagaaggtctacaaaagattaccacaaaacagtaatgacttaatctctacccattattctcctgccaaatattcacctgaatgaaacaaagattgtggctgtattattccattatactcagctgttattacttgcttaaccaatggtctgttactggacattttgaatattttcaatttttcaccattgatttaaaaactatgtatttttgtgtgtgtacatgtgtatgcatatctttccatgcgtatgcatgcatgcagagtccagagacagatgtcaagtgtctttctccattgctctccatctattttttgagacagggtccctcactaagcctgaagaccacaggtttggcttgactggatagccagtgatatccagttatcactggataacagtgatatcactgtttctgcctccccattggtggaatcacaggtgtgtgttgtcatgcccagatttttacgtgggtgctggggatccaaattcatgtcctcatggttgtgtggcaactactattcatctcccaggttcttttatcacttattttaatatgggaagaaacctcactcttgtgtataataaactttttgtatatatcactgatgatttccttctagtcagttccaacaagtaaaaattctgcatcaaaacctgtgaacattttgttgtgctacataattatttttattattagttttagtgtataaaagaattgtttccatggcattttcacaaacattgttctttctcatatatgctcatccctttcctcctttctccaaacaggtcctctctcccccagcactggtattttttttttaaaagatttatttatatatcatgtgtacagtgttctgcctgcatgtcagaagagggcaccagatttcatagatggttgtgagccaccaggtgggtactgggaattgaactcaggaccttcggaggagcagccagtgctcttaacctctgagccatctctccagcccaagctctggtatttttaagggtctgttttggcatctctttctaaacagctctccccagagtttttcccaacttacatttccatgaggaacagagaagttctctgaattatataccttggactccaaggagtcctataatgatcatccagcacaactgtcttctatgcttccttcttaatgaacataacggaagacactgcaaacaagatcactgtcaaacacatggtcatcaagccccccccttccccgcctcacccccttcccaacctcaccccacttcccaacaccctgggtgcaggcgtgatctttgccatcactcagcagctagacaccctctctctgcagggaggtgaatgaccaaatgctacaaacactcttccccaggtgtgaaccgggattccttggctctctgtactgcagccagcctccatgtaacagagcaaaaggacagactggtttgttcttccactcaacagctgtgagccaaagtaacaccctccctaggctgtgggaatgagaagcacttggacaagcctggagaaagcctatctacttcagttatttggctgtaactttcaaccaccgtagcatcttggaccagaaggaaccatgccaacagtgacagcagtgaacttggaacccactcttcagttataatggcaacagcacagattcaggatttcaaattacttttttcctccctccatggatatcatttactgtaagagcacttcctgtccccatcccacccccaaataaaaggaaaacagggatgaatgtgaactattgcatctcagttttaaatgaacattgattgacacatctggtgttgctgatagaactaccaggggctgagaaattccatagaaaattttagctgtgtgaattttattcagtggatcaggacacggcaataggtaaaaaaattttaagacatgaacaaatgaaaacaagcagctggagagatggctcagtagttagaacactcgctgctcttgttgaggacctgggttaagttctctgcacccacacggtgcctcacaaccattggaaactgccatttgatgggacccaatgccttctttcaacctccttgggcacccggtacgtatgtggtacacagacaaacatgctggcaaacactcatacacataacatttaaaaaatattttaaaacccacaacaaaccccacatcgtgcaatatatcattcaagttcttttaagaacagattggtattttggttttttaattgtgtgtatatgcatatgtctaggtgtgggtgtgtgcatgtacctacagaatccagaagatggtgtctgatcccctggaactggagttacaagtaattgtgaacatagaagaaaagacccaaggagtcactgtagaatctaatcttctgttgtttttgctaaaagtttaagatgtggctacccatctgcatgtttagagattggatggggtattcacatgtgcttggccattctcatgaccagacacacacttggatctgtgacttggacctcctggaatggcccttttaaagtcagttctggatacatggccagaacatgtttccttcatctgtttaggctgcaggatgatgttctccatgttaccacactctggttccctctgccacttcccttttcatctttgctatctgctgacttgcttccctcagttcctttatatgatttacatcttcctccaggcttctgatggacaaaacaaaactctcatggagactgtcacgaactgacaaatatgccaagtgatactcctgcttccaaaatatcaatcatgcatccaaaggatgactgagctggaagagacctctgggcagtgtggtacctgaacttctcttgatgagaacagacaggagatttttgttagatgtttgtccatccatccatctgtgaaaaattactgtgatgggttgaaagactggttctaaactgaacacaatgcatttggagacagatgtccaacacatcacagtcacccagagagaaccttctcgctcatatgattcctctctaatccccgatgttcaaactgacatgcaagggatgagagaaatgtgtccagacaaaattcaggcaggggtggagcccaatggggatgacagagaaggaaaaaacccacaacggcagagtggtccagttatatccctagggaaacaatattgagagggttgggttgcaaccatgtactgccttgcatagcatatcaacacagcaaagtatgcaaaataaacagactaaacccactgcagcacacatgctggctcaaatggcagggacactcttccctgccaccctttatattcaccctgtactttccctggggctcagccttccttcttaccttgagtcagcattcctttttcaaaaacatagctgatattgggctattgcccctgctctggtgtgggtgacaaagcctaggacatgccacaaatgatttaggcagccaggcaagcagcctcagagttactaaaatgaattgtagtatcaggggctatctctagggctatgggacagttttgtttgtattttctttatctttttcctatttcctgtaagaagtattcccataagttttaatattttgggtgggagaggaaagtgatctaagacttaacagtctacatctgtggcaacggaagcaaagttgatgctgagaatgaatgactaatgggagatcagagtgaaccataaacacagaaccaaggtaacagcccacactcaaatgaggaggaaggtggccagcttctggagtgttttaggacaaaagattaaacacaggattttttgaaatgtaggaaagaaagaggccagtttgtggctgtcccctggcaccgtcagtcatgtgaactgtctcagacctagtcctcggatcgatgctgacttgaagttctctgatgggtaggatgaggccttgagtgatgtggacttggatgaaggcggcagatatgatgcaaagatgaagcgaaaatctgcctatggagtcagggagatgctggggcatcaagaagaaactctgtcaacagtagagttaattcagaatttaggtgaaaaaaaacccaaccaaacaaaaaaacaaaacaaaaaccaaaacaaacaaacaaacaaacaaccaggcatgtgagtttgggatgattagatcgaatatagattttgaataataacaagctagatttaaatggcagcatgttgggtaaactacttttaagcttagccttagagtaagaaggagaactaaggaaagcagacagcaaacacttagaagggcacctggaccatgggcatagggcattctcaataaccaggggatgtcattatcatcattattgctattagagacagggtctcactccatggcccaggctggcctgggactcaccatctattgcctcagtttcctgagtgctaggatgacaagtatatgctactatgctcacctccagctactattataaagattagaagtgatctgacacaggtttgtggtatgtagaacacccacaagagcaggaagagtggaagaggcaataaggctgtaacaccaacaaatatgaacttaggctgcagactcaagggaattgtactgcctgtgccggtcagagtcatgtggagtactgtttagcttgggacactgatgatttaagatgtgtgaggaggcctacgggcatccatccagagctgtgtgacatgacagaaactggacacatctggtaaggaaaaatgagtgtaacacaggccataactctcttgagatcctcaaggagctattattacacaggaggtagaatagcattattccacggctctaggagaaaaaaatttaaaagctctttagctgagtttgcttaacagaagagtaggtttttcagtagggtggacagaggaataggctgcttgattctctattactgcacatgctcagagagcctacccgagaatcacttagaagtgaagagggtggagaggacattctcttctttccttgcaaaatggaagccaccacggctcagtctcacaagacctttgcttgtcccattaaatcctgccaggaaggacactgtgttcacaaatctttcctatcaggatagagaaggcacagtgtcatgcagagatacacgttcatccaacaggtgctcactgatggaagtccacagtcactgtgccaagtgacagatcttcgaaaatgaatgaaataggtctcaagggcatgtggtgtgtaagtggagccctctttggatcctatgtagaggcaagtgctgaggtagagagtagcacaagggagcacattggaggttcaacttcctagtgcgacagggtccaggttggggttctgaggtagaagatctggaagctgaagagggcttgagtaagtagattgttcgtggtattatggtcagtatgtgcaaagtatcagaggtaggaagcagccctgtggccaggcagtcaggtgtagccaggctgaaaggtatagctttattggaaattgggtgagagggtcaggagggggccggagaccagagcactcagtatacacttctaaaggcctgcatgtcacacacaatcacaaggactattgatcaagcttcaaaattccaactagtctctggcctctagaaattattcaactgtttgtttagtggctctattagtcaatggtccatgactatgaccaatagaggggatactcaatctagccagagaataggcttattcttgttcatagttttgagggtttggctccatggttacctggcctcactacttttgaacttggtgaggcagcatgttatgatgggagcacacagcagatgcatagctgctcactacatgagatgccaatacagagaggaagaggaaggggccaaggccttactggtccttagagagcacactcttatcaaccaggtccccactctagaggattccctaactccaagaagaccatgggtctgggactaagccctttcacacaggcctctgaagaagatttagccaaaccagagcagttaccctgtgtggtgccttcatgagcgcaggagccctatctaactcattgctatattgctgttttgagactggtcctgaaaaacaaatgtgagggaacaggaaggatccaacctcacagggtttcaatgaggattcctgaaactaaatggcgcacacttagagtagtccctgtgcctagcaagcttggataggtgaaagccactgttattattattcatttgtctttctggtttacccttccttttgtgcctgtacttggttaacacacttttgggaggtggtgctgggaactgaactcagggcctcatacaggcaaggtgagtaccttatcacagaactatagcctcataacttgttctctacctttctattttaaaacagaggcccagagatggtggcacacactttttaatcccagcagttgggaggcagaggccaacctggtctataaggactgccagagctacatagagaaaccctgtctctcccccccccaaaaaaccccacaaaatagacagtggagttcagcgtaaattccttgttctgaagattcagggatgacagacagatctttctttgagaatccaaggaatttcttagggatgactctaatctgggagagatttctcctccaacaggataaggcctggaaagaccttgaacatttttcttctcattcaagccccagaaggtgatcttggggtgtcttcctgtgacccaggccccaggcaaagttgaagaatagtttggaatgaatgcggtgtcagctctgagctgacagtcaccatgccatttgtttaacagcacagtccaaaatgtatgtggcattaaaccattctggttcacactctagggcttttgaccagtttttgagtcagaagagaaaaggctaggtgttgaaggccggggtgggggagtggggagaaatggaaatgacttcaattgctaaaataaaccaaattacttaatctaactgaaacaaacaaatgaaaactgtttagtattagattaaaaacaaaagcaaaaaacaaagcttgttgctgtccctgtttgtgtggctggaccaggagggtatatttagtgtcatacgctgcagggttgcatcttgcagcccaacaggaagtatctggagtcacagctaaagatatccctgcatgtttggaaatttacgagcagctataaagtggctctatggtgggcagagggctggaacaggcttcctttcaaatgagagaggccgctgaattaaacactcaaatacaccaggttcgtggcaggcagagcacacctgacacgctaaaaataaccacagtagaagcttctgttgctaaaataatattgagctgatatgtgcctttccctcccaaacctcacaagggcagatgaaggggtggaggctgggtcctgagatttcacaaagggtgctagaaacctgtagaaatcaaagggagtcatttcctagatttggcactttccaaaaatgaccagcttccttaaaatgaggcaaccaaagtccgggtaatcgatatattattttctaataacacaagacagaaatggctgaaccaaacagaacttacacaccagtcctgctgacgagctgtgctgtagacaggtaagccttctccatcctggccaagaaccagttattttgaaacatccttttgctggcttcccttatcagcagcccccacaccctgctcactaatgctcggctggaaagccccacttactccatgcacacgagctgcttgcttgatgatatggaaaagggtgagtgtgtgcaattgcatgtggctgtggtgcaggccactaacctttacaggatgatctatatatccagggacaacctaacttctaaactttcattttgtgatcaaagacgacatggcttcattttttttcctcttccaattgttacctttggtctggggatacagtgcctgctgcataagcatgatgacccaagttcaacctccacaacccacataaaaaacatgattataatcccagcaacagggaggcaagagagggtgtctcaaataaacagatgacaatgacaatcaaaaaaggcagactgcctgggaaagaatgacacttgaggttgccctatggcttctacaagcacacatgtgcatgtacgcttggacacacacatacacacacgtacacacaataatgcacatgtatacacacacacacatgcacatgtacacacacatgtacacacacaataatgtacatgtatacacacacaaacatgcacatctacacacacacacacacacacacacacacacacacacacacacagacgttattttgctttctgagcacagtggaactgataaagaataccctggtgacctcaaaatttcttgtggtgatgaagggaccaatgcattcagaagcactgctgggtctgagggacgctgctgttaccaccattcctgggcatcttagtcaaggatgggtcagaggacagcagagagcactgagcacactgatctccatgttttcttttgtggagtggtgacattttaaaccggtcagagcaccgtttggatgtctctctgagcagtggggtctgcaggaaattgacctgctttgccctctccttgtctctttaccatctttgctggtctacactctgcattcctggcagctcactgtaggcagggctgggtctggttgttactgtggctcgcacaggctctgcaggctacttaattctctgatctgggaagaaagtccccacattctctgaagtgggtcttcctaaaaacttttgctttagtggccatttaagtagggagggtatcattgagtttatttggtcctttccctctcaacatgttccacttaagttaaaaactgtaacttcaccatgacagtacctgtgacacatggtcatgatcacacattctgcctctgactggagcttagtgtgacaaagatgaaatgacttgctgcgtcagaggatggggccacgaaggtttgtttcccttgttccctttttgcactgtctaaggttgttacacagtctttacaatttttttaaaacatattttatttttttgtgtagtgttttttgcctggatgtatgcctgtgcactgtgtgactacagtgcctgtgaaggccagaagagggcgttggcactatagttacagttgttagttgccatgtgggtggggggaaccaaacctggtcctctggatgcacaaccagtgctcttaactgctgagcatctctccagcctcattaaatagtctttaaaaataaagaaagagtaactgcggttttaacattttaaggaaatgccacacaggctaaatcatttcagtgaaagaattaaattctcagcatctaaaatattgtagaggtagcccacttcattgcaagtttttgttcctgagaatgtagtaagaggcaaaggatgtgcctcatctaaaaacttcagatcaaatgatggtttttctaattagaaccccttcagtactgaaatattgaagttgaaatatttttaaattgtcccccaaaggagcataagttgaaaggttggccttcagcctctgttgatactgggaggtgggggaagggccaagtggaaggaaaggagcacgctgaggacatgtctttgaggggatgagaagaccccgggtcttcctcttcctcttcctcttcctctgcttcctggccaccatgaggtgagcaacttccttgatcaaacactcccactcagatgtattatctcccacaggccccaaagcaacagttcaaccaaccatggacacaaaccttcaaatctgtgagccagaagaaggtttttacttttaaaagtgcttcatgccaggcatttactatagctataggatgctggctagcacagaagtcgacaatctttttattcaatgaagaatcacgtcgttgctcggcatctgttaggtgctgaacaatgcacaggtgctaggtatttacccttctccagcttctcccacagagtaccaacacaggttgctgataggggatgtccttctgtatatgtgtttctcttattagttgatgaataaaacactgtttggccaatagaggcaggaagataggcaggactaggagatgagaattctgagaaaggtaggcagagggagacccctgaaagatgccatgtagccaggattaacaggtctggacccttctctggtaagataagaccacataaaaacacttagattaatagaaatgggttaataattaagacagagatagccaataagaagctctagccactgggcaacagtttataattaatacagcatctccaggtgcctatttggggctaaagcagtgggacctggcaggacaagaaactccagcaacaggttgctttgtcaggcatcaggagacaacatcctccaggtatgactttctaagctctagatgccaagatagcatttgtgacaggaaccaccaacaatgtgcggctccttgaagaaagaagcagccatcaaggcttacaaagtgaagcttgtgatgccttgtgtggcaactagccactcttcactgtttcttcagggctgtaatagagtgggttcctgcccagaacttttttcttcagatggctttgaagtcagcagctcctctagcttgtttttttacagaaaagtccctgactctgacaaagagaagtagatgaagtcaggtgaggtaatggtaccagctgctgggcattcaacagacaaacagtggaaaggagaagagagccgatgctgggtggtatccggacccagactgtgagccctgggactggggttgtgtagtattacttaacatcatgaagtgtgaggtgtggctcctcatattgtcatgtccatgcataaaaaactggggatcatcatgtgtgctactcccatcctccaaaataatcacctgtgacctccattattgttcatttcataattacaccaaattggttaattaattggcatctcctttgcctctacagaaaacataccaaataaaatattcacaccacaataatgtccagtgggtactggtgattaattttaataaaataaagctccaaactggatcaacactttttggtggcaccaagggacatgttatgagagcaagcttgtcagtatccttcacaaatggtgagagccccaccccaggccacccagtttcctccaacatcccaccatgcaccgggcgtaaatcattttggaagctgttcatagctgtgttcttcccacttgtaagttagtgaagtcccacaagcttgtgaaaatagccacctaagtgatgatgcttttattcttttccctttgaatgtgcccctttcaggtgctgtcctgaggatatcattttaccatactggaatttagtggatgtgtccatagctctgacatttggagaccagagctccaatcaactccctgagtctttacaatcaagacaggagaatccaaacttttaaatctacccccataaagaaatcaatttctttaggagactggcttcagctgcccaactttgctgtggatttgcattaaaatcaatgcaaatctgtatgtgtatacaggcatttctctggagtccatctctctacaaaggttggaaactgttacccttcatcccgaggctccttctagaattttccttagttttgattagttaattattgagaccgaatagccaggatgatatccactagtccaaatgaggctatgtcaaaaattccaaaaaagatggttttctctgtaaccctccaccagaggatgcctgttatttggaggatttggagttacagcagctgccactgcatccaggtctttggggaatggtgtataatgatcctcatgtccatcttccgagtggaatattattatcccattagtacaacctaatttggattcttttccctagatacactgccttgtatttttccacactgtttcagctgctgcctgtctacctcttggctgccatcctgtcagatcttcaggaatttacataatgtggacttggctttatgttgtgacattgtcctctgcaaacgtgtggtgcttctgttacctccctgaacaatgtttaaacaaggaactgtccatatgatagtgacagccacacatcaccccaaaacatgctcctgtgtccacaggaaggcttcggctgggcagagtctacctggcagagaccacagtgcccaaaccctttgtgtctagatgggtccagagaaccagtctttgcagggatgtaaacagaggtaaaaggctggtgaaacatagtgtgtgtgtgtgtatgtgaatgtatgtgcacacaccgtgtgttaaatatatgtacaggcatgtgtatgagtgaatgtatggcatgtgtgtgtgtgtaaatatatgtacatgcatgtgcctatggctatgtgtgcataaatgtgcacatgtgttctccattatcttcccccatttgataccaggacagaacgaaccctttgaacccaccagagtcagaagtggggaggaaactaggttgagtcggtgtgacaccctggggggtgaggctgcctgctctctggggcgccacattgactgttggcaggtgagaaataagcatgcggtatcccaaaccccaaaccgtggtgcagcagacagcaggcagggggccactgttggaaatatttgcttcacagagagttcccgctccctccctccttcgttcaaccatgtccatgtctttttctcatccagaagaacaaggccctctttacatctgaagcaccttaattcgtttcagaaaggattttgtcaaagatattttttgatattttatgccatgagtttaaggtatttacctaaatagcaaggtttagtaaaagcttacacacctgaaaagtattttgatttgacataaacaactcatttcgagatttccatgtgttagtatttattatgtggctgaggctaatttggacttagcagtaaacaacccacgttttgactgacagtcgcaagtgcctctgcaggaaccaacaacatagacaagcagtaccatgtcctccgactgctctcggagtgtttagaaatgatgcagcatctctgtgagttccacaatagaggtgctttttgtgtagtgtggtactgacggatgcgtgggctcagggtagagagacttcaggttctgagagctgtcgtgatcctctgaggccaacaagaatccttgatatttcctctgcagcaacccacctctcctttcctcctagtcttctgataagagtttaaatcccttgctctgaccagcatctacacagagcacacctcgctctatcagaagaggacatggtgggatggagtctggctgagaccgcgctgtagctgtggccactgtgggaagagcctggagataaggatgaatagtccatgtctcctttaaagctaacctcttggggaactcactctaggaattccatgtccatcaaaaggcttggagaatgttccagatgggcaaaaaaaaaattctgggggcttcctacttcctggggtgtgtccttcttgcacagaaggtgacatccagagaggttctaggatgatggttcacacttatagtgatgtggtaagttaaaacaccctcccacaggacaaatcttaggctcatggaacagaaaagatggtgctccaattatgttctcctgaggagtttgttctgagctctacaggaaagtgacaatgccatggcagggacaccctagttcaccataacaagccttttctagggaaactaccttgagagcagcatcatccagaagaggaagagacctaatggcacaatcacaggaaaatcaacagggaagagacttgcttaccaaccaacaacaaagcttgctgatttcaaagactttctacatcagggctccttctctgctgtgagaattcagagacactcccaaaggcaccctcattacctttgcctatgaataaagcaaatggcggtgatgattctggcagtggtgatgtggctctcttttggaaacttctgactaagatggttagggtggaaactcttaggagtccaactgctacttccacagattggacagtgaccacggaaggaaaggagacatctccatcaccttagttcttggctttaaaagcactgttcagtttgtgttgccattaacaagcacccccaggctcctctgggggcatcaggaaaagagacaaggggtggttagggtgggagctggacagaatcggatgctgatggcaggggacaaggcagtcacttgtttggaaaattgctttgtttctaaaaagaaacctgacattttgggggtggggttagggcagggtagggacaggcttctctggagtgaagccagacaactgccatcttctttttagaagtatcttagtcttccacagtccacaggtgagcaccgcaggccctccagatcctccattctttgataaagttgagtaaatgacagagaggtagtttatcttaacagaatatggctggcatttctattgtaaagtaaaacaggttctgaagaaagaatggactaggacatggaggtgactattgaggacagagagggaatgctttggaagctgtgaaagctacacagagaaactctgtcttagaaaaaaaaaaaaaaaaggtgaacaatgagatgtggcaatgcactttaggaaatcctctaagacggttgggtgaggtgaggatgctactaccaacagtccctgtgttagtaacttgtctcatatgaccaaatacacaataattagataagaattgaaagggagaaaggaaggtttattggttcatggtttaagaatggattcgggctgttatatcacaggaaaggtgtgacagtagaagcataagaaggctggtcacgcagtgtctgaaggcaggaagcagggagcagaaaggaaatgggcctgagttacacatcctcaaggctctctcctggtgacccacttcctccagaaaggtgccatctcctgaaggttccacaagctcccaaacagtgacacctgctggggcccaagtgtccaatggttccatgtgcccgtggggggccatttcacattcaaaccgaatcactttcctgagggtccatactacatccttcttctctatagtacactcaatctttaactttctccactgggttccttcacctaaagttgcagctataatttatagcggcatgctgcatgccttagaaatacaggggtctgaattcttctgctttggaaagactatttgggggtcatcacggggcaaccctgtatagactgacaatatactagtttgggtccaaggaacaaagtgtttttttaagagcttgtcatattgagccttgtgctatgaattgctggccttggccacaaagagcttttacaaaacacccctgctttttgtattgttttaaaaatggtctcacatggcccaggctatcctttacctctgtatttgaaatgactatatgcacaaggcaaacatgaaatgatgttctttttcccctaggaggggaggcagtgtgtgggccttattgacatgctccagcatgcttccccagagccttggaagatttgctagggcctacatcatcattctccatatagatagttggagctaaaaggtgtaaaatactggacaaaatgtctcactagttcatctccactccacctttgagttcagttgttggaaacaacagtctggctgggaaaacaggtgtaatcagtttctgaagacctttccaagcctaggcaagagtttcttattcaagagagccacagagacttgcagtatcaatgattggtgctttgaaggtgcagattccacaggcttgcaggaccagaagggagtgtggtcatcagtaaccagaactggctcagctggggattcttacacacaccgagcctggggaattattaggcctcttttgttcaattggggtttttgagacagggtttgtactccgtagcccaagctagccttgaagttttggcaattcacctgcttcaacctttcaagtgctgggatcatggcatgagccaccacactcagttatagatttctgcctttttttttttttttttgtcatcacatttctctggagtagttcttgctcattgacttcacattcttaagacgttatattaacatcatttcctccattaatttttacatatatcctagcaagacgtaaagcgatgaactgtcccaaaatggaagggtttaggaaattttacaacactgaagctgttgggactgaggctggaaaaccacttaccagtaatactgggaagagaactcaagtatcatttgagggtccaaattttgaaacaatgtattacatttcctctatctctaggaacctacgataacattgtaacaaaatcagcttcactatgtcaagaaggacatattttaaaaatctccacactcagaattcttattggtagtttttaaaagcagcaagaatattagcctgtaaaataggaaggccacaagttgaagacagagcaatcaatggactttgggggttcttaagcttaaattttagctttgaaacctattagcaaaccatgaacacaagcagataaaaggcaaaagagagccggggtggtggcctgagcctgtaaatgctagtagtcaggaagaggtagaagcagggggatgatgtgtttgaggctagcctgggatacatagtgagacttcatcttcaacaatgacaaccactacccaaacagagcagacaaaagaaaagacttcagctatccacacccttccactcagggcccataggaaggaagaccggcctggctcaaataaaatgaaaggaagatcttgtaagtccctcatgaagtcagctgacacttcagactcacagggtgaataaatttgtaatctatttacatagatggagacaaccatgtgactgctgtcttacccatatgcggtacacattgtttggattgtgcacttgtcttgacagcgttgggcctcagaactgaccttggcactaagataactgaggaaaaaaaatactcaatatgataagaaatcacacacaacaggactcctgtgacatcacatttatggactgttgtcagtcgggcaggacattactgaaacagttttcaagtctgagaacccaaagcaaacggttaagctctgacacaagacacacctggacctcctttgcagcaggccaggtgaccttcactctcctgaaaaatgatgcacgggcttagagaagtgccagcatcataaaatggcacggcaccagtacttggcatgccttctcttcagaaagctacccttcaggggtgagctttgtttcactgctctcaaatccctgaatcagaaagagctggagtcttccctgtttgtgtaagtcctccccagagtcgcacactgggcaagcatttatttaattgaactacagtttatcacaatctttggctcatctacaggcacgagggcaaagaccatgtctgttttgttcactgatttttctcttgtacataaaggtggtggtacataaagggtgttctctcatccctggagagtggaggatgctgtgctctcccttgtcacatgggttctgctactctcaactaattaaaggtcttcaagaaaccatttcatttttttcatcaatgcattctatcatctgatatttactatatcactccagtgtgtcaggtactgatcaagtcttgaggtgaccactgtcatcagctagataaggctcccaatctcaaggtaagctcacttctggagccactggaaagtctctgtggtccatagcatcactaaagatgagatgaggactcagcagagactaggagccggaggacaacaagggggacagtgggcattgtaatctaagtgtgaaggcactcatttttgttctggaaggcagctgtcttaagagtggttgaccactgaatatcctcaaggcttaggttcaagaaagtgataatgactgcctggattcagaatgaatgaatggataacaaaagaagtaattggggttcaatcctgaggccccctcttatgagtaattgtatttagagtatcccatattttagtttcagagagtgggaagaataattttgtgaattagggaaagaatttaaattctgtgctgctccattaagaatcaagacaaggcatgtcttaaaaagagaatcagcagcagaaaaacaaaacaaaacaaaacaaaaaacaaaacaaaaaaccctgggagaggaaactgttgggggaggatcatgtttgggaactaactgaagatttacgacagtaatttttaaatcatagacatgaattagtctgaaccatgatggctgaattcactacacacaacatttgtaggatgatatgaacggttacatgatattaaattgagcctccatgttacaaaattgttggaaattaagctgtttgtaacttcctttggaggcaagagaaatatgtgtgcaaatgttaatcaggcccccgacctgtcttttggtgcagtttgatagccatatctgggataggagccaaactctcttttgggggagaactagcagtccccagagccacagtgatgaattacactggtctgagaacaagaaaggaagtcactagggctagaacaaagggctagtgcttcggagggggcttggctccctgtggctgcatgtggtatatgattctctggtttttataccattcctttctcagccctcagaattcttaatcctattttcactgccctaggtaaacctggaaatatttccttcttgactgcaggttactcacacaataaacaggtaataaacattttactgccccgagcaacctcctgctgggcaggcaggcaggagaaaggggctgcagagggtgaccccctacaggacaaacggcaggcgacaaaggaggctagtaaccctttaacagtgctcacctcagttgttccaggagagtgaccctgagctgctggtgcgcattagccggcccccagcgctctggagtcctccctgcttgaggctagtaaggaagatttgatttcaccaaaaggtaatttagttgccatttccaagctctgtctggctaaattaaggatgaggatgaaactgagtttacagtctcccagtttaaaccacgagcagggagcccggaaggcaggaagaacagggcacgcagggtgttcaggcatcagagaagtggttctgggcccaatggttctttttccagctcacaccttgcttgtgaacacaactttattttcttatgcttgttgcatatcatattgtgtaatccttatgatctttgacttgtgcaaaacacagtggatatctttcttcccccatttcccctcccccctcctttcttcgcttccttctcttgctttactgaacatcaaacccagggaattgtacatgtcaggcatgtgttctaccactgagttacatcccagaccaacatcctattttttgtaaacatttcattttacatttatttatttatttgggggatactgtagaggtcagaggacaactttcaggagccagttctctccttccaccttgaggattttgaggatgaatctcaggtcatcaagtttggtggcaaagcaccttgaccagctaagccacacatggctgtgcctaacatcctatttttcaatcaccctcaagtttccctcaaaagcttgttaccaggctggggagatggctcagaggataaggttcttgccctgcaagccggaggctcacaattcaaaacccccaaacccataaaaggacagatgcgttagcaggcatctgtactcttagttcacttatggtggaatggaaagcagagatagggaagaatctccagctagcctgccatctgcagcggtgaccaacaagaaagcctgtctcaaagcaagctggaagacaaggactgacacctgagattgtgctccagtcttcacatgtatgtactagcatgtatatctgcattctcaaaaatgactacacacgctattgcacgtgtgtgtacacacacacacacacacacacacacacacacacacacacacacacccctccccaaaagactgttaccttcagctcagtgaaagctttttgtgatttccaactgcctgggaaatatttcagttttctttcacattgaaggtataactcatgacggcgaggaaacattggaccttcccccattgtagggtagaaaaagcatagccaaatagaaccggaaaactccacccccaccaccgccattcaacttatttatgggaaattaaaaccttacttacataaatatttcccaccaaatagcatgccaagtctgaatatattagcccagggcaaatgataaatgcattggcatagataattttccaattcatgtaggatgaaaaaaatgattattttataaatcaacacttctgtgatgccagctgcagttaatttatgatatctggttctaatcttatttcagaatattaatttctactgtattttgttgcagagcagtaagtactggccagcaggtactgtgacacactgcccagtgtatcttttcttgagacctgattggccatttgtgacgtagctactgtctggacacaaggcttcacatactcccacacgccatctctgcttttgattttcttttaatatttttctggaggggttaagggagtgaaggcattctgaagaatgacagagccatagcctgcagcagggctcaggggacattttggacattttggccgagggtttctagtagattggggttttccctccattgtctctgtaggaagcctcctacagagaaaggatagaggtaacactcaaagtgaaagacttcaagccccaaacaaagagtgcagaatagtacagcatggatacacacagcaacaaggggaaagaggtcacagaagaattggaatcggccaggcagggtccacatgagaaggggagtgcacccgtggatgacttgaaaagagcgaaaggcaggatgcaacccttttactttactggcattagacttttattaggcatctgtcctgatcagctttatctgtcaacttgacacagcctagaatcatctgagagtagagtgacaacctaggaattgcctagatcagagtatgtatgtgtgcaattgtcttgactgctcattgagatagaaaggctcagctccatttctaactaggtggtccagaacatcctctattgtccctgcaccacttcttggttgtgaagtgagttccgcggtggatgtgattctgtgtaggatagcgagcaggcatgccttcacgttcctacctgcaagtccctgccttgagtgactcctctcagtgatggactatgatctggaattgtaggctgaaacaaaccctttctttccctgggtggctttggacagggtatttgtcacagcaacagaagtgaaacttgaacagtcagtctttgactgtggttccagagttacaaaactctcatagaactgggcatggtgtcatacacctttaatcccagtacttaggagacctctgtgagtcgaaggccagcctggtctacaaagtgtgtttcaggatagccaaagctatatagaagaccaggtattaaaaaaacataataataataataataataataataataataataatgaatgccacacagaaaatgacagaggacccatggctaatggcagtggctacagagataaaaaggttcttgaactaagacgaagggaaaaggttaaggatgatggggtggtgtttgaatgcaggaagggctttagaggggcaccccttaactctatggtatactgggcaggtggttctgacaaagagcaacagatttaagtaaaaaccaacaactttcagtcagattgaagcaagatctgtggaatggcagggttaaagccataggcagacagatagggatcctgacttagaatggccaacattaaacttttggctcttgtctgaccactcctgaaatacaagaccaaggctactttgttcactaggtaaaagatcctcagcactgttcctactcccttcccctttgctaagcacaccatccaggcctttggcagactttgtaaggaagaggtgtagatgcctgtgttcagtacccaccatcaccctgacaacccaaggcatcattctcatttgcttgaatccaacctggaggatcctgtgtcctcctcttcatgctgaggatagcagctctacactacccagggtctaccagtcacactgagaacaaaccctactctctactggccttttgggccaggtgtcttcaggcttcttagaggactcctcagtggggtcctcatcccatccttacccccctcccagccactctcttgggctacaaggctgctttgttctgtctttgtggcagctgctccttcagcttggaccctcttgcctggctcttcacttggctggctcctctcagcagccaaggctcagctcagatgtcacctctcaggtgctgagtgggaacctcatctaagatacaatgtggtccagcctcaaacaggtgcctttccttacacactgggtaacacaataaatatcagtccaatgaaagaataaatgggcttcaggggcaggttgtctctggctagattgagagagtggcaggtgagaaaataaagaaaccattgtgggggattggggcaataactcagctggtgaagtgcttgccatgcaaatgtaaggatctgagttcaattcctagcacccatataaaaagctgggtgtggtggtatatgcttgtcatcctagcactggggaggtgagcacagttagtttagcgggatgggcgatctccaggccctagtgagaaaccctgtcaaaagataaagtggatggcacctgaggattggtactggaggttgacctctggcctctacacacatggacacacatgtgcacctgcacacatacacacatacactctgcctgggactggatgatgtttggggtagagaaagagatttacaggcctatccacctttgaagtgagcttctcactgcctccatcatagtctcagaaagaagttgaaccaaggctcaggggacatgcagaaaatggagcagaaagactataagagccagaagctcagggagtttgctgtgagagagtgtcacctagtaatatcagaagcccaacccataagggcccaccaacacgactgcccaaacatgtgctgaagaaggatgacaccagtgaacttgccaaactccatggggaaaaactcatgaggcctcaaccctccacaaagaactgtagacaaccgagggaaagcatagaagagtagaggtggcctttccaagggaagagcaagccaatcatagtgccacatgctcatcctggaaacatacatacaggtagcattatacagacggaatgtgttatatttagaaatatgcatgtcaatatattcatgcagtaacagtttgtgaaaaagaggccatggatttgaagtagagagaggaggggcttatgggagggtttggaaggaggaaatggaagggagaaatgttgtatttagatgataaccctcccactcccaccctatccccccaaagaaagaaacttgtgggttggccaacagcatagtcacccaaggcattggctttgcaatctgacacattagaatcccagcttggttccatgttacctacatgcagattacctggcttcatgaaatcctgtttcctcatattagagaagaaatgatggtgctcgagagatggctcagtggttaagaacactggctgctcttgcagaggacccaggttcgattcccagcacctacatgtcagctcataaccatctataactccagttccaggggatctcagacagacatacattcaggcagaacaataatgtacataaaacaaacaaacacatctttttgttaaaagagaaaataacaaactgtatgttattttgtggatatagacaggtaacatgcaaagtacctgtttgcctaccagcttgtggtgatctgaaagaaatgttccccatgagtgtatgcattagaatacttgatccctagttggctgcacatttcggggacactttgctgaaggatgtacattattgggagtggtccttgagtatttaaagcctctatcccactcccagtttgttttctctgcttgatgcttgcagtaaaagacccagtatctcagcttcctcatcccgctgccatgcatgctgttggctgccatgcttctctgccacggtgaactttcatccctttcttctatggtgtttgatcacagaaacagaaaagtaactaatatacagccataatgcaagcaaaacaaaacaacaaaaactaccaagttgtacagtccatcaggataaactgagccttccattgtccttcataaaggatgctaagatgctccctcattcttcctgaagctgcagcatctctccctctctatccaccccggacatttatccctatggttctaggttcttagaagggtttgagctgtcctaattttacctggacagtgcctactttgatttgggatgggattataagattcccagacatttctcacgaagcagcttaccaaggtcccagccagttagccaaggcatttctagggagactggtgtcttctgttttacttttgcccctaatttctgtaaagagttgaagggcagcctttgagggttctataaatgttaatggttgactgacatacagatctcttggaatgtttttactagggctaggtggtatttgttggtctttggttgaaaaatgccaaagtgtaaccgctcagttgcttgatagaaattgaaaacaactctgtacattttgagattttatttttaaaaattaatttatgattcctgctcccaaaagcctagttagtggtcacaattttagttgttgtttctaaaaaagcaataaactattttcttttaaatccaggaatgcaggttaatatttattgcctgttgaaagaaataaatcaaagactctgtctgtaccctgagatttgctggcattacacgtgaccattggtgatactgacaggctggaacatggagaggttctttataagttagtaactggaggaggggtgatggtgaggagggtggggctttggtgatttcattcccagccacagctggcaaaattgcttattggaaaataaaagtcatggtaaattgagcttgacaataaccaggcttgactatgtagaccccttctccactcaaagcagttagagtgggggggggggaggcggggaggtggcagggaaaggaagcccctgtcacacatccatcttccttatcttgcagggcactagccatatgctgtttgtgtgagtgctgctctctgacggctcctgggctctgtacctttgcagcttctggacatggggtgaagtgtagtcattttacctttcctattcctcaagaggggacgaacaatcagagccatgctgtccaacacagtaaccatttaattttaaaaattcacaggctggagagatgtctcagtgtctcagagcatatactgccctgcagaggacctgcatccagttcccagcacccatacctagtgaccccaaatggtctgcatcccctgatccatgggagccaacacacctggcttcctcagataactacctccacctatacacataattaaaaatttctttttagtcttaaaaatgcagtcactccagccacttaccaagtgtccatagccacatggactaatggctactatactgggggctacatggccacaaatcaacccccactccccagaatgttctatcagacagctgcaattcagaaaacccaattggcaccaagaagcccttccttttttggccccaaaccctgaggtcacggtgacctctgtggtaaagatgttaactgaacctttgagaatgtggtgatcctctagtgtctcatgtcttcccaaacagtgggaaacaaatattgtgacttggggtgtggttcaaacatcctgattccatagacaaactctgaactttacatttccccatacgaatacggaacagcaacgggagacctgaggggtgctttattttttatgagctccctcccactgttacaagcagtttttttttttcttaacaaacctggtttttatcatctgtgtgactatgcaggtgtcatgtgctttgaggaccaagtatgacggagggtctggctcagaagacagtcagcaaagcaacgcagctgctttacccttgtcagggcactcagtctccccaactgtccttccagccaatgagctttaccaactgcaaatctcaagtgcatcaccctctggatattgcttgcaatatgtaccatgaattcctattttattttcacctttgagacaagatcttgctttgtagtccatgctgaccttgaacttgtgatcctcctgccgtagcatctaaagtgttgggattacaggtatagcacctccatacctggctcttaaattcttcatttatttacaaccctcaggatcattaatttaaaaaataaaattgtgaggaagagttgctaagaatcctcagaaacattctctgatgtgaagcaatataaacctgccttttcctatctggggcagcatttttgtgagggatagccccgttactgcaattttagggcaagcacagcaaagagagagcctttctgccttccaacagacataagacaggagggtcacacagtttgaaaggcaggggcatgctgttaaaatttggtaaacttcatactgtctaattttggtgagcctcaaaaatccctgtgctctgactggattgggtttacagcagaggctttcttcccatggtcccagagcacttttatgcatataatctgcattgcacacccaccctggctcctttttctccactggcctaatttgttctcctgcattaggcaggattaattcttgccctagtttgctaggtaggaaaacggacgaagccgtggaagactctggcttcacacagggcagtgaagtgtggctttactttcaggtcactgagcacaagccaagcttatttcacggctggaacacgtgacattctgcacttgtttcaacaccagctattccattcatggtgatactgcctctcaatgaaaactccataaaatctctgacactttcaagtcaagggaactgtcagaataaagagtgtaatgttgaggatgacaaaaaacacttcatgacatttttttttaaaaccaggcaagaacctgcctgtctcttgtcaggggttaataatatggttgccaaattggtacatgttatgagttgaatatggaatgtcccccacaggctcttgtgtttgaatcttagcctccagatgctggtgccatttcagggggacctggacctagctgatgatagatgtgggccaccagaaagcaggcgggcttaaggattgcagcttgacctggcttccaatcctcctctcattgctcattttccaggatgcgaacaaaccacagcacaagctcctgccatcacagaccacagcttcccggctgctgcatcttccctaccatgagactgtaagccagaatgaacttctcttcttttgggttgttcctggtaagtattccatcctagtgatggtaaaataatacagtccaacggaagccgaaaggggctgggtggatggaagggaaggtgccgtgcagaactgcatcgtagaacaagagcactggggaaattttttgagaagtggaagagaaagggaaaatgatgagacttgagaattaaggtcagatcactgctttgaaaccccaaactgtgagtgctgtggtttgggtgaatgttccctaatggtccattggttaaaagattggttcccaaggtgatgggacctttaggagttgggagatgttgggagttcttaggtcattgggggaacctgacaggctcatgaagtgagccgagccgtttgctctgccttgtgctctcagtgcgggtgatgtgctgccctttctggatagtcccaacatgggactatcaggcttacctgattgcctaccatgtgcaaggccctgggttcaaggtaccacacaaaatgagtagggaagaaagataaaaaggaaagaatgaggaagacggaagaagggaaggataaaaggaaagaaggcagctcgccagtcagcagatcttgacttagactggaatcctcagaactgaggcaaaataaaccctttttctttataagttggctgtgtcagatattttgtcatagtaatgtgaagctgactaatacaattagtcaggccagtttttaaggacattttatggaataatcccaccttttttttctttttcttttcttttctttttttttaaccaaccaggcatagtgacactttcagttctcatggtcacagggataggagacttaaatatagtaggacagccttctttggaggactctgttagaaagagcacacaggcacactaaatgtaggtggccttcctgctagttctttgggttgacttgtaatgaacggccaagctgggccagggagcagccgacaagaatcagttttccttggaactgaggagagacggtgagtctggcttctctgcaggcaggtggccctgcttcggagccctggctttgggccatcagggttctatatgcccccctcctccatcttagaggaagatttgactcctctaaggaaggaccttataatgttatttactgctattccctatgctccaaatttggctttgggcagcccattttcagtatttgggaaccgtaagacccaagcaaggcatgaaaccaacagttaatacaaaactttccccagggcttggcatttagctgcagccccagcaggcattttgaatttaaaaaaaaaaaaaaaaaaaaaaaaaaaaaaagagtccatgcaggctctccaagtacggggccttaaaggcaatgcaggtctgaaagcccctttgtgctgtggagctgtggaaagagacaatgaaacgctgcctggtattcctatgtaaatgccacctcgaggacagagttttcgccaggcagatggctcatttctgggctgtaacctcatttttccagtgttccctgttcttgtgaagttctgcccctggagtcaggtcctaattggtgtcaaacgctcagagacaaaagtgaagtgtacacatcattcatgggaaggctgtggaggctatggctacggcagtggctgtggtataaagcttgtggccagcaggacaggctggtgcaggcctgctcagaacttatttctggatgccaagctaacacggctctcgttgtcaacacttccattcgcctgactctagcatgcccccacctccccacgccttcccagagacagggtttctctgtgtagccctggctgtcctggaactcactctggagaccaggctggcctcgaattcagagatccgcctgcctttgcctcctgagtgctgggattaaaggcgtgcgccaccaccattgggcttctagtatgtcttcatgctgaggtcctctttaggttatccatatgttgacttcagtctggctcagaaaatcttgggtaggattaaatagagggtccatttatctcatcacagatttgggggcccgctcagaagccctgctgccacccagcagacaggtaatcccatagccaggactctgcagtcagcgaacggccgtctgattggatgcacattcatcttcaaattatgttgtgtgacagcctgggctgcagaacaccattttaacatgcagattgactcctcggaggctcttcattatgcatttagcggcctgttttcagactaaccagcatgtcagagaggccctatcctttttccacctgggtggaggaaatcacttgctgactgtgggggagctgtggatattaaaatgcatgtttatttttctgagtatccacatacaacacttttccccatgcaggaggagagaagaaaaggagcagacagctttgactctgaagcaaagaaaatggctatgccaacaagccagtctcggtggaagacaggggctgacaaggccaggccagcccagtgccttctggctaccctggctgcccgcaggccggcctgggtgtgtccacacaaatgctcttctaagacagcacagactctctttcctcgtacacacagcccaagtattttaagcaacacacttccaatttcctgtttctaaaattgtcccgcatctccaatggcattccatgcaatcctggcaagtaacaggcagaggggctgagccaagtccactccaaggacagtgagggtgccttgtctgttgaggggacagcacatcagggcgctgggtcactcacccctcttctcttcttggtgtgacttaatttcagtctgctgggtctgtgtctctatgacctctctatgacctccagctgttactgggcaagcacagccttattccgttgcccctgtgtgtgtgtgtgtgtgtgtgtgtgtgtgtgtgtgtgtgtgtgtgtatgacctgctgctactgagcaagaacagccatttcctgtgtgtttgtgtgtttgtgagtgcctgtgtgtgtatgtttgcatgtgtgtgtgtgtgtgtgtgtgtgtgtgtgtgtgtgtgtgtgtcacttggtatggtgtgtgtgtgtcctttcatgatgatctctttccctttcttaaaaaggaactgtatttgcattggctttaaggtttcactctcattccactaaggccctcactgtggcattttctccatttgtttgaaagactcctcacattctagacaaggactctactactggattatatccgcaggcagccttcacttcttgagaggcccctgttccttcagcccctgctgtggattatgctctctgttcagatagcaaacccctctgtcatccaatttgggaggctttcggatgtgtagtcaggcccagctgattcttttctttgttgccatgaaagaacagttcttcaggggcttggaaggttggcttgggcacacgaacttagaggccaggcttgacaccagccactgccagtgtccccagagggcaggcatgtgtgctgaacagcttctaggccttgcagggtagtgccgaatgctgctatcaacgatgcagccggggcttagctatttacattaaaatattacatagtattttcatagggctccaggcacaaaataaaatggaaggcagagctgtactccggattctgccggcagggctgtgagggggaatgaaatggttcagatgctcggtctgggactgcagtattcctgatgagcgaacaatggtgcagaaactgcggccttttatttgcacatggaatgcggtgatccccaccggcaggaacaggttgcatgtggttgtgaggctgttgctggctggtgtcacactgtggagtattatctgaaaaggtctcaaccagcaagaacaatatggcaacccggtgccagaggcaatgcttagtgatctgtcccttcattcacgcgtctcgctggccatttatttatttatttctgtgactagacacaaggtaattcttaattttaagatgctactgaaggatttgtcctcgaactactgtttttgggaaaatccttgaaggggaactaaagggactaggggagaggggaggcctgagaagtgggacaggagggggaaataggctcaaagtgtattatatatgtatatgaaaatggcctcttgcacaatagtcaaatgatttagggacacacacacacacacacacacacacacagagagagagagagagagagagagagagagaggttgagtaggaagtaagtagggaacaacttgcagtttgcaagcttcttataggcacagaaaggggattgaatttcagtgacaacccctttaggttcctaacacagggaccatgatggtacagtaggggtgctgttttgaactcccatcatccacgaaatcccccagtacctcagaaggtgactgtttagtgactgaggctaaaggaagtaatgagtacccgcccatatccaatgtgactggtgttcatatctgaggaggggatttgaaaacagaagtgggggggaaattgcactaggacacaggtaaaggtgaccatctctacacccaagaggcctcagaagaaagtgagcctgtcaacatcgtgatcttaggtttcctgcctctcaaactccaagaaaacaaggtccacccacacttcagtacttggttaactccacaaaagcaggtaagtagaagtgtggatgagggggccagtcagagcattttagggatttccagcatcattttctctactagatcttcaagaagtggctcataaactgcaagccagatgctaatttcacagggatcaggtggaaattgggttgttctgtcttggaaatatctccacagaagcggatttgctctttagcttcttgtgcatacggcagaactgacattttgaactgagaaaatgccacgaaggacctatctggcctctcaaataaatctctagatttttctttgaaccaatcaattggctctctgaggtgtcagccagtaacagacacatccgtcgataccacagggcagtcagggctggctatgcttacactgggcagtgtggccgagcggatcctcagatgtagagcacaagagaagactgtgtgtttcaggaggtgagggtaaagtggggtgaaggaccaggtgatgcttcactctccagcagaggaagacagcgtaatgtatggactgtggggggtgcatgggtccagcctttttaagactccctgctcccttctacctgagacatccatgacagtgcaggacacaaactgtgtctgaaggttcacttctaccacctagttctacaggtgataatgactcatgagagtacagttggaggcaaaaataaatattccaatctatcagaactgcaatctaatacagtggcacaggcctctccacttagcctcaggatagaagcagaaggattgctgtgagtttaaaactaatctgggctacatagcaaacatcaacctagcctggaccacaatgcaacatcctgtcttaaaaaatcctgaacaaaactctccaaaagctcccctcccaccaagaactaacgagatccccaaagaaacaaatacacgcctcctcctcaggtttgacccctgaacttgttggttctttgctctgcccagcagtgagcagccctgggctgtactactcacatccaaagcttggctggacctagcatcccacagagaactccattatcctttacttactggctctcagctgagcagacacaaatgtttatgtaatcctgtgccccttaacaaatatatattcctacccagagcagggaaatctccagtcaaggaatcctgggaaagagtacatctgggtgttattgctgcattcactacatgctgtgtttcctcaccaaggacagtagaaccaaggggaaatagccttccaagtccctcgcctgtcgtcctctgaatgacacgtccgcttccttcttccaagctacagtttccaaatcagtacacttctataaaccccaaaccttacttcttttctaaatgattttcaactcccctttctgggatttaatttctctgtggataacctagactggacacagaatagccctaacgttttatccgttatcttaagttttcaatatgatttccttttcttttaagcccccagcataccattggctttttaaattgctgctgcatattagacaggtatcccccaagttatcaaccatgactctaaacttactttactacgagttcagagctgatgagagattatgagtagtttacatgatttctcccaaagtgcactgttttgcacttaaccaaattaaatttcatctgccttcacgctcctcagtcccctggtttgttcagctttgcccaaagtatctcatagtaatccttaattgttttattaactgtgcctgttcgtgctcagctctccacttgggtgccttggcctgagactctcctcatactccgggaactttaaaagggatgtcatgaagctggcagaatctgtgtgacatgtaaatgattcccccaaacttatagggagactcctgaggacaaactctggagtcacttttggccccaagaagcctcatcctggctgagcaaaaagaatacaaacatgtttccccatgttttaggatgtcatgtggcaaacttggggaggaatctcagaaggctgctgagctgcctacagatcacctttgcctctggcttccttttgtgactatgagtggcagcagcctggaccactggagaccctgaactccattcatccttcccttctcttcctgaggcataacaaaaatatcttctttgtgtgtatctgaatcgtgtgtgtgtgtgtgtgtgtgtgtgtgtgtgtgtgtgtgtgtgtgcaagtgcaagaggcttatactatagcttgcatgtggaggtcagaggacaacttctcttgcccatagagatggtcccaaactcatgatttggcttgtgtgatgtaatgtcactttgggtgagtttttaaagacatttccacagaggaagagtgactgctccctgttcttagaacagataacctgcctggaactcacatgcacttatagcaagaccataagccattctagatcatgagcaaggagagcagagatgggtagaaccaaagatttatttgcttattatgtatacagtgtcctgtctgcatgtatggctgcatgtcagaagagggcaccagataccattctagatggttgtgagccaccatgtggttgatgggaattgaactcagccagtgctcttaatctctgagtcatctctccaggccctgaaacttgcattcttgatggctgtagctacttcaatagccctgaacccctcacttctgaacatccctatgagaggcaagaacaaactcacctgttaaagacactattctgggagtcagggctgggaggaaaatgaggttgaagattatgcttgggtttctttcatgtagccaaagcctttttaatgacacacagtatcattagaggtcaacaaattaattcttattcacttattgaatgactgcatataaaacatcatagactgagaaaagggagagaaaaatgtttctgttattcccttaagcaagatttgatcacacagtgagcagtaatacaggtgtgtgtgtgtgtgtgtgtgtgtgtgtgtgtgtgtgtgtgtgtgttaaatatcctaagagaggaagagtcctgcaatgaaatgggggatatggtatcaaaatcagggccatgggaagggcctaggccccaaatgtgcagcaagtagaaagcttggataggagtaggcagggtgcagaatgtccatgaagaagtctttcatcatagcctgaaagcttgtggtggcagcaaagctttctgtccaaaaaacatataatcagcttttttgttttgttttgttttgtttcgtttttttgtttggagaaggggttggggtttaattaccagcacccacatcaggcagctcacaaccatctgtagcaatagctccagtggatataacactctctttgctctctttggcctccaagggcactgtactcatgtgcacaaactcagacacacacacacacacacacacacacacacacacacacacacctagctaaaacactttacaaagtaattaccaaattaacacaaactaaatggactaatctatattagcttagtctggaaggcaatttgataggcattttctctttaaatattttgaaactctcaattatgaaggttgttttatggagatttcagaagtgttacaaccatagaaccttacccctacataaatctttaaagtttatgaagttatcatctcatactggaattaagcaggacactcaccattcaaagagattatctcattgtcttatcaagttatacataaacctgctctgaaacagtataaaagaagctttgcagagggtcagtggtagagcgtttgtctagcacgttgaggttctgggttcagcacatagcaccttaacgaacagggtttcattacaagacagaattccttccactacatacagtttttactttacacttttccattttagcaagtaatcaagtctaggctcctatatacactaggcaagtgtgctatcttttggctacatacatcctcagctctttaaactcttaaattttaaaatggtggtgaagggagctttgttcataacacagattaatgccctcctgggaattaaccatttagttctttggttacaaaacacattattctaaagccaatattattccagaagtctgggtagcactttagcctgttttattccagccgtatgttctccattgcttccttaatgatgtaagctactgtttagtaaccagcttcctggcattattgtagtatacaaaggtgttcccttctaggaccgcatctagacagatgggtcccaccatgaggctctctgttcataggcatgcatacactggagtccctgtttaaggcagactcaaagtatttgggcagattcatgttctaggtgagagggaacattaattcagacaatgtgatgtaagtttctgttgctgtgagtgaatcaactcaatccaaccaacatttcttgagcccttgctatgtcttagctgggctccaactgtgcaactgtgttggtgtagatatggacaaggcagatggaaacctgtcatacacaaagaaatgaagcttagatggacactgtattaaacccaagaaagacaagagaggccatatactccagttcttcctagaccaaagaattaatgatatcctttacagataatatattaaaaagactacatcggagtttggtttacctgtcacccagcactcaggaagccaagggaggaggattgttgagttcaatgaaagcctgggctacatagcaagattctctctgaagaaacaaaacagtatagatatctttggagactaaagatgatatctggacaccaatcaggtttcaaatctttgaactagaactttgatattaatttatgttcctcataaattaaaatggtatgagttagaaacagtctaccataataccctttcacagaggttaagagaattaactgagatgacacagctagtctgttctggtccgtgttatacagcatactttacatacttgctacttgtagattcctggaaaagaccaacaccctgtttgcagtagagatctaaacagacggatatgatgtggctgggggagtttccctacaggggacatttacagatgccagtcagtctgcatccatctccctaagggctccccagcttcctcatcatcagcactgactatgaaactgccaaatgtgtgcagctcacctctggccatctgaacattagtactaagctttgaattcaaacagacaaggagataaaaatggcaggaaatgactcattttggtggttggcatcttgatagtctcagtaacatctcatattaagtctagaaggacctttattcttctgttttttccaggcatggcccctggggttctggaaactggctaacaattttcaagtccttgtgtcctgatcacctgagccacacacacacacacacacacacacacacacacacaatttctactgccctcaaagcacccaaagaatatactgagtccatacacagagctctgtttgcagatgaccaggtataactccttctaaaattttgtttgattagtgaacttctttgtgttgtatggtttgtgtgtgtaagtgcacagctatgaagaggtgagaagacagcttgggtattgtacctcactggcctggaacttgctaagtaggctaggatgagtggctagtgaaccctgtggatccagctatcgctgactccccagagctgggattacaagtatgtgctactatgcataattaaaaaaataaataaaacaaaactgggtcctgggaattgaccccaaatctgtaagtttcaaactaaatattttatcaatctagctatctcccagccctagaatacctaattactacaggctgatgctcaaatactacacctgtgtcatctactggagattttgagaatatcattgtggtttttaatactgagggtgtgttactttgatgataaacacaaaaagaaaaaacaccttggctagccccttttagcaaaggctggaactccttgtcaggacatggtgtttaaagagcaagtatttgtagaagatcaatactcttggtcaagactccctggctcctctatgacctgaggtaacctataactcattatccaagaaagattacataaaactcccttcattttaaagtgattgatcttctttgaaaaaaatcacaatattcctattcagtgctctgattactccagtaagattaagcagcacactgtctgtctaggaaagctggataacagacgaggtcagcagacacttttggccaaagaatgcccctcggccattgctctgttttcctgatttgaagctaatgaggctcacaaagtggtgaggagggtggagagacagccactgagcccacagggtaggtggtctgtcaggagctcaactcaccttcccaagacagctggtggattactaggcaactttccagtcttgcctgcatgtttacctgcaaagccctgcttacacatgctgctgtttccagtttcttccatctgtgccacagcaggtccttcactctccaacatgaactgctgggacctactgaggtgccttcaaaacaagccaggtctgagttctctccccgttaccaaaatgacttcctgagggaaacgtcagctttgtgactaaaatgtagcttctgaggacaaatctttaccctgggctggaagagcccatctgaatttgagtctatctaatggcactgccaataatccctgctcctctatggagctgaccaagaccatactgctcatagactggggtcaggtgtcaaggggttatctgccccaaaggcatccttctggaagagaggtgggcaatgacacctagaaacttccaaatagctaaagtctttgagagagaggaaaaacactcttctgccttagcaatatagttctctctatttagaaagtggctgaaaatcaacacactgcttcttgcccagggctctgaaagggtggccacactgttaggggaaaaggcacagttaaagtgatgcaagatatgcatggcacctgtcaagtatgtcaataatacattctgaactctagggaagcctgagaaactgtctaagttgaagtattcattagtaatactaataaaaaaaaaccctgcctaacgataaccctgcacaatgtaggatgtcacagacattttgccaaagagaaagtcaagcaagcaaattttgaagccccttaaaatgcagacttctgcccacttttaaacaaacaaccccaaagtgtaagggggttggctagatttgaatccagttgggtgggtcatgctttatgtgctgtgtgtattgtacataaaacatttgtgaatacattttagtgagtgttaggggcgaaattagaacatcttaacactctgaggcaatttcccgttaaattgtcatcatctattttgttataggagtttctggggaatgtttaaagcaccatcattcctgcattctcttttataagaaacagaagaagtggagagatctttagaaggctccattttctggtaaggaaaggactccatttttcagaaaacagccagaattcctcggtaacagcctgacaaacctctgcctcagagttgaaggattcaggcaggaaaggaacatccacagtcatgactgatctttcctgaggacacttcaggctgttcccactgacaacctgcaggactggtgttgttagtatataaaacatttctggaagattctaaagtactctagaagagctatccaggtgtgttcctcttccggtacatccatacagatatgctcacgggtaaagacagaagcctgtcacagagtgacacccatctcagacaaatacccccctcaaacacccaggcttttactcaccactgggatgtctaccttcagtgactatatgtcacaacccacagacatctgggtggggaaggagggtcctagtgggtggagacctctgaggctggaaaactcatttctcttggcagataatttgaggtgagattttagagaacatggacacgggggcagggcttacttttttcttgtagagtgcctgctctgtaagtttttttttgggggggggggtaaacaaaggacaacctggtgtttcctgctgaagctgattcgttctgcgttataatccttggcttactgacatgatggcgttatgggggctttaggaaccgcttctatccactagggctttagagagggaaaaactttgaaaaaaaagaagatattttacgcttcacatgtctgacaagggtgtgtggggccaatttacagcaggggcttaatatatttttgatgaaaattgctgcaatgtggcacacagattaaagagaaaacagctcttttgtaatgacagcagtgggctctgaaatgaagcccagctggtacaaagatcctacatggatttcaagagatgtaccctcttcccaggcttcacccagcatggaagagtcctccaggctgcaggccttattgattttctgtgggagcgactcccaggattccactttctaaagaatcagtccgtcatggaaaactctaatgacacaaatgtgttgaaaagccagccaagcaatctggacaggtcacagtgaggatcatcaaacccaaacctctatcagacacctaatgtcatatacagggatccacccagcagcagtgacagtggtatctctctatagaggcaatataaggtgtttacagtttgtatgctttgaaatgattacattattacaaaagaaagtattttctccaggactgggaatatagctcagttgctagagtgctttcctagaatgtacaaagccctgggttccaaccatgcaaacctggagtgttagcacatgactgtagttctacaactctagagttgggggcagaaacaagttcaaagttttccttatttacacagggagcttgaggtcagcatgagatagaagccctgtctgaaaaaccaaagccaagacacaaaaacaaacaagcaaacaaaaggatattcactggacctttgggtatggcacagaaagaccaaagaataaatggtggctccatctaaggctcagaaataaggttttccagagctcattttatatataactccaggagccttctgagaatggactctctctctctctctctctctctctctctctctctctctctctctctctctctcactctctctctctctctctctctctctctctggcactctgagccttgtgcatgttaggcaatacactctactaataggaagatgatcatcttaataacattaggtcatttaatttccataaatccaattttctcatctgtaaaatgggttgacacctcataggatcaccagggtacctcacagtgataacatcaaagcactcagctacctaaggtggctggttctgtttgagcttatttgtggagatggcagccttcaattgggtgttacagttcaaaatacgtatgttgtgtgaaacctcagttgtagagtttatatcaaagttagcatcattttacatttatttatttgatgcaaggggtcactaagtagtcttgtctagccatgaaatcacagagatctgcctgcctctgcctcccatgagctgggattaaaagcatgtgccacctctcctggtagttttcattattgtaaaggaataaaagccacggtaagatacatttatatctatgtggtgacatttaactaactagagtccagtcaggttgaagtctgggctctcagagtattagacatgtgtcagcaggttcatgctactgtgtgtgacactgagctgggtatctggaaagccaggtgacaggccctggtgaggatcacttgacagctaataacgtcacagggcactgcgcgtatcaattcaggccataacacaaggcaactgacaagttccttcaacaggctgggagcacataatacaacaggaaggagtgcatttccccctgtgacttaaaggagatataattgtgatgctgcatccttgatgggaagccctgtcttttcacagtaagactctgagcagagagcatcatgggttgggctgtgaacacaaagaggtggagggatccagcagagggcattgtactgtttgagaacacactctgtagagaagggtgagcgtgatggctggaacttgccacctacataccttaacatgaggaaaggaagaacacatgacttatatgttccctcaatccttgaccttaccaaagacacttcaaagatgtaacacttaaatgtaacaggtggaatttacagattgcctccctaaaactaaccatacccaacattttgagatgatctaactatagacaagacacttcctacaaattttaatagccgtgataaagattctgatacttagaattactagatatacataatatgaaggtggtgaagctacctgaagcccaaagtctgcttgaaaacacccagatgctgacacacaaaggaggcagagactgattacagaagtgtggcactatctctgtaactgaatttccatgtcatgcttaggggggctcaaaaagaaaatccatttattttgagcactggtcccaaatatttatttaaaatgttaagccatatggaattgctatctttgtaagaaaaacatgagttaatgctgactattttaaaatgctgaactaggagctggggttgtagttcattggtagagcacttctccagcatgtatgaaatctgtgggttcaattccccaacaccataaaaacacaacagaccaaccaacaaacaaacaagaccctaaaccctcgtaaccctcgtgtgtgtgtgtgtgtgtgtgtgtgtgtgtgagagagagagagagagagagagagagagagagagagacagacagagagagagagagagagagagagagagagagatgtgttcacgtctatgagtgtgcatatatgcttttgtgcatgtggtggtcagcaaccttgggtcctcaggtattgtcaactttataattctgatcctttactcggctcatttataattttcacccataaattctgttaaactcaaatatctaagaagtttacttttcttatctgggcagattaaaagcagatacatctctgggtctctaagtaattagtttaagcagttaatccaatttagacttaagcatgagttctagagattctttccatagctttcttctgttctgtggctagcaggagtattgcaacactcgccagccctactgttggttccaggcccctgagagccaaccttgaagaatgtagtcaaaagcatgacctggcttgtattccttgaacagaattttgtgtgtgaaagggatcaccagctctccaagtgattcaagaacataagaaaatttatcccaacactatggacccgattcatgctacaagtggcctgatgatcaaagtgaccattctgctttcgaagctgaagtaactgaactctgaaagtaactagagaaatgtccatcaagtgtgcactgtgtgtgcatgaagggaaaagagtgtttgagaaggaaacccccaagtccaaagaagggaagtagcaacactctgttctgtcttcattagatacaacattatcaggttcctgttaggaaaactgaaaagcaacattgtggaccaggctgggtggtggtggcacatgcctttgatcccaggcgttgggaggcagaggtaggcagatctctgtgagttcgaggccagcctggtctacagagcaagttccagggcagttagggctacacagtgaaagtgtgtctctaaaaaccaaaaagaaaaaaaaaagaaagaaagaaagaaaaagaaaatgtgaaccagactgagcatgaggcaggagccagcaagcgagggaaggccaaaaggaactggacggcatctttactcgacactttctgtagaaagcaatgactaacaggcagtcagagtcaatcacttccctcctacgtccatcgaggaggacaagggcagctacagctgattctgattgtggtcctctatgaccctttttccccagggaggccccagggcagcctgtgactcaacatttaaacagaagcaaacatgtttccattttgacctcagggaaaggggaggaaaagggaaccacgaaaccaaatatctacgtcaggaagaaaagtgcaaatctctacatgaaacaaaatggtactgccaaggattgtacttattctatcattcaacaacaacactatcaaattcatgatgcaaacttttttcattttagtaaacagcagaatccagttatttttctttcagatcctcacagtcaacactcctttttttttttttttttatgttacacatgtctccaagagtggaacaggagcctgtttggtctcagcaatcacgaattgtattctaaagactttgttttcccttatgtaaagcctgtgtatggatgatcacagatgctgttgtgcttagtatgactaagggagggagggagggagggagagagggagggaggaagggagagagggagagagggagggcaagatcgagccattccttttcaggagtcgctcagaacttaatcatgcaggagtattatggtttggatcctaaacaccacaaaggcaaacgtgctaacaactctgtagccagcctgtggtaacaactcagttactagcctgtgctaacaactgggttgtcagcttgtggtattactgggaggaggtaatggaaccttaagaggtgggcccagtgggaagaaggtaaggagttggaggcatgccctcgaagggctcaaactctatcccctcctttctctctctctctctctctctctctctctctctctctttctttttgcttctggattgtcataacactagcagatgtcttgtattctgcactccccacctgatgtgtggctttgccacagacccaaagtgactgggccaagcaaccaagggccaaaactctgaaatcatgatccaaaataacccttccctagctgtaagctgtttatgataggtatcttgtcacactcatgaaaaagccaactagcgcagaaagaaggttctcatccctggaagactatgtgcaggcagcaaaacagagtcagaaatgccccttgttcacttgtaattgaaagcccaacccatctttaattttttaaaagaatgggagttaatgactccaacatggaagactagttttataaatagtcacttgcccagaatgagtcataatcttggagcgctgagttgtaaacagcagtcatctcacttgttttgcaagcagtcaccctggtgagtccaggcaagctggcagattatctccatggccgaaatatttttggtccctatttgcaaagttggaggaaaatcccagcagaaagacatcaagatgcttgtaacgagatgtatccggtgggtcaggtactcgggggaccaggtctagtaccagtgggctgcagatgtctggttccactaacaaagacaagccagttgtggtgggaaagaccaccctcacttagcacagggttgcatcatctcaagactcttcctcaagcaatgctgagttgacaaacatggctgctaaggcacaccactaagtgacatggaggattctcagttaaacttgaccttcaaaacaatttatactctacacttacacacataccaagaaatgatttgtcattcatttacctgaggttcgaattcaattagacaacatttttttgggggtggtggtgtttctgaatatgcagcttgattcattcccaagacaaggctgtgagaaacgacgagaaacaaaggcagaaggagggggagagcagagcaaaaaacacaggctcagaaacaatggacttttgcccttttagtggtttgaacaaggatggtctccataggtttatatatttgaatatctggtgccaagttggtggaacttttggggaagaagtcggaggtgtggctttgttagaggaagtatgttcatgggagcaggctttgaggtttcaaaagcccacaccattcccagttagctcacttccttgtggctgtgtctcaagatgtgaactctcagctactgtctagcaccatgccttcacacctgttgccatgcctccaccatgatagctgtggactccaaccctctggaaccataaaccttaaataaactcctttttctacaagttgccttggtcatggtgtttaatcacagcaatagacaagtaactaagatacaacccagtgaaaagtcttgacatatgtctcagtgaaaatggtagatgtgggaacagatttcagacttagattagcatccaagagagacccaaactgaagggagcagaaacaaggggtgtgtgtgtccacataggctcacctgtctggtcatgtctgaaatttcaggtgttccctataagggaagtgggcagcgttcaatgggagcagacagaaaaggcgcacattccaggaaatagctgtttctataccagctctcaggcaagatgccacaggtctcaggtctccatacatgggctcctcagatacccaggagactgaggcaagaacagtggacacttaagacttttccctttagagtgggtctaggtatgtgtggcagtttcaatgcatttggccccgataatcttacagggagtggcactattaggaggtgaggttttgttggagtatggccttactggaggaattgtgtcactatgaaggccacttttgaggtttcctatgctcaggatacctcccagtgtttcagtccacttcacgttgcctgcaagccaagatgtagccagccccacatctgcccacatgccaccatgctccctgccttgatgataatggactgaacctctgaaactataagccaccatccccaattaaatgttttccttacaagaattgccatggccatggtatctcttcacagcaataaaaaccctaactaagacagcatgtggcatagagaattgtggtctggttaattctgaacatcaaggatgctctttgtctatagagtacctgagtcctgggctcagattaacatcaccttagatgctcccaaatcccccaggtgcgtggtagaacttcaactcctcagcatcactgggtccagctgtggcaaagatacataggtggagtacaagagggactgctggagacaccttgtaactggagatttttgacatggagtatgttgctttttaaaatggctacaacttcaaaatatccactttctcatatgcatgtcctgctacggctgggtaagtgtctgccactgcggtccctctccatctatttctctgcctatctttactgcacagagttacatttggcccgtttgcctgtgtataactcctcttctatttttctttatcctaattattagaataatacaactttaagatgaaaggacaaataccaaaaatcaaacttagtgcaactgtttgttgcaggggcaaggtttcttcagttccatctccccggggtggtgcactcttggagacaaggctgtctagatgcttcagagagatagatggatggacagacggatggatggatggatggatggatggatggatggatggatctggggcttgtcctcacagtactaatgtttaagcatccaccttaaactgctcaaggctggagatggctcagtggttaagggcctttgttactcttacagaggacctggatttggtccccagaatccacatggtagctcacgaccattgataactccatttccaggggatccaattccttcttttgacctcctcggataccaggcatgcaaagactgcagacagacatttgggcaaaagactcaatatataaaacaaataaatcttaaaggactaaaaactaaggacaatcattccttcataataggactgctgggaggactggatgaaatgtatatttatacattgctagtgttataccagtgcttgagaaattgaacagcacttccaaaaattagttattagtgtgtatgcgtgtgcatgaatgagtgtgtgtatatgtgtgggtctgtatgtgtgtgagtgtgtgtgtgtgtgtgagagagggagagagagtgggtgtgtgtatgtgtgtgtgtgtgagagtgtgtgtgtgtgaaagagagtgtgtgtgtgagagtgtgtgtgtgtgtgtgtgtgagagagagagagagaagagggaagagaataactgtggagtaggttctctcctttcaccttcatatgtcttctggggattacagtccaggacactagatgtgtatagcaaacccctttacaccctgaaccatttaacttctttctggcccttgagcagcaattttcaaatgcaaaatatcatgacctacatgacaaaaatgtcttacaacttacttttttatgtaacaaatagtgttagacacatggatgtcagggtgttgagaaatggtagaacttgtcgttgtaaatgttcttatctgaagtttgtgttctcagttgcttcctgatagatgctaatgaactccacactgttttctttctgtattttggctgacacatatgtatgtatgtatatatgtatatatgtaacttatggggtaccctatgatgtttccatgcctgtaaacactggaccaattttaagtgccatgtttctggatataattaagtacttatcttgcaagcatgaggagttgagttcaatcctccagaacacaggtttaaacaacaacaacaaaaaagacagggtgtggtgactagggtttgtgataccaatgctggggagacaaataaagtttttttttttattttctggccagccaacttagcttaatgggcaaattctaagccagggagagaccctgtctcaaaaaacaaggtacctgaggagcaacagccgaggtgtcctcagagggtaccctctggcttttaaatatactcgtgcataagcgctcgtacatgtgcacctttgttcacacagacacatagcacacaatataagaagacaaacaaaaagatgtaagccatagtttgcagtggccctttatagactgatgaccaagttgcaggggggtggatttcataaagaaaaaaaaaaacagttctcctgttttgaatttggaagagttaatgtgcccaggcatagtgccacaaggaagactttgtcagcacatgttggggagatataggacttaatgactgtgcttgctatcaaaacagtggagagggctaattagcgcagggaggctggctctggtggagggtgcgacactggtgaacacggggtggcagctgaaaattactaatgctgccgcctgactccactctgttttccttacctccatcctcccagagttcggatgaaaacagccagtaccacccagcgtgtcacagtctagaaagcagccaggtttgtatgcatgtccaccatcccattacaagccagctggaaccccacgaggcagatcttattgctgcaaatggtctttatagaagaggaacaatgtgccaggtgggaggggggatgtacacaagtggtgagcccagagccaaatctactgtagggacttgtctccacacacccacgttggggtctccactcccagccagtgcgatgcagactccccaggatgccagcctctggtgcagccttcacagggagaacacaggaaggtgttacagagaagttggggtgaggaaacccagctttctgccatggagttccactgaagagtctggcaaatggtcctcaacagcttgggccttgtttgctcacttgatgattaagaagggttgagttgctcagtcttagggcatttggtaactgaaatgctacagtttgcatctcgaatcttttccaaaggcccaatagttgagaccctggctttgtgttactggtaggtggtgggaactttaggcatctaatgagagatatgaggtaattaagggacaatgtccagaaaggcactgtggagtccgggtctcttctctccccttccacttcctagccaagaaacgtgggatttttcttagaaaaaaagcaaaaaatattttatttttatgtacgtatgtatgtgcacatgtgtgtggtcatgggttgtacctgtggaagccggaagagagcaacagactctctgaagctcacaacaggtagctgtgagctgtgtgacgtgggtaccgggagccaaactccagttctctgggttctctgcaagggcagcaactgctcctcacccctgcgccatctttccagctcccacacaaatgactttctccactctttccactgtgatgtatctcccaaggaaccaagcattagagttaacttaccagggacagaaacctctgaaaccctgagccaaagtgaaacttttctctttataaagttgattgtcccagttatttcctttttcttcctttttttttgtttttgtttttgttttttttgagacagggtttctctgtggctttggaggctgtcctgagactagctcttgtggaccaggctggtctcgaactcacagagatccgcctgcctctgcctcccgattgctgggattgaaggcgtgcaccaccaccacctggcaggtatttcttataccgatagaaatctgactgacagctgggtgttggtggtgcatgcttttaatcccagcactcgggaggcagagacaggcgtatctctgtgagttcgaggccagtgtggtctccagagggagtgccaggataggctccaaagctacacagagaaaccctgactcgaaaaaccaaaggaaaaaaaaaagaaatctgactgacatacaagagagatttttctgctcagacaaatgcacatatataaactataaagccacgggaaccttactaacaataccaggggatttgtggatcctagagagaagagatggtttggattaggcgatttttgaagtctgtttccagtctaaatttctgcaagccaccctttgccacctttctgggaacccccttccttcttgttaagccacatgtagcccaggctggccctgaatttggtctcctgagtagcagggaatacagacgcatgctactgtgcctggttagacattttccccacaaccatgttaatctagatctgcttacactttcatatgtaggtgcagatttaaggggagcaagaaggctttcacccttttaaaaagcatatgtgtgtgtgtgtgtgtgtgtgtgtgtgtgtgtgtgtgtgtgtgtgtgtgtgtgtgtgtgtgtgtgtgtgtgtgtatgtttcaggaagtcaaaagaaaagattcactgggctaagcctggggagctgacttgtgagtgaggcgtgacttcagaagcagagaacaatgcagccgaaacattgccacttttgcaatgacaaataacaatttgattataaatgaatttgttataggttaaaagttcatttatttccatttactcactaagtgggatatgactaaggaaagtcactatcagaacagcgcttgggcatttcttgtctgaagaataataccttaaaatgagttaatttaatccaattagttttcaaatgaaattatttaattactaatgacttctgccttgtcaggttctgttgggttttcacagtctaaccccaatttagctaatcaggaccctctttttaaaatgccactttgcaatgatttcagaaacagaaataattaaatacttgctttatccaagaataaccttagtaagaaatgaagaggaattatatgaagaaaaggaaagagtcataaaaagatgagcagatggagatagagttcatttctgagtggggtgacatttgctacactaaagatgtcatttaccccaaattattctgtatatttattgtaacttaaaccaaaatcccagatttttttttttttagacaagatccctctacatagtcttgactgtcctaaaactcactatgtagacctggtttgcttcagattcacctttgcctgcctctctcttctgcgttctgggatcccaaagggatttaatacattttttagagttattttagaaatatcaactggaggaagagctaagggagccaaagaggagtgatgtgagagactgaaacctgcctgtaagcagtaagaatggagagagagagagagagagagagagagagagagagagagagagagagagaggtgacggcacagaaattgtcttcagagctattatctgctaggaaatatgaggagaggaggggttactagcaatgcaagttccgtgcctcataattcgatcactatccatgtttctgtatgtgttcacatgtacatatgtccaaggatgtagaagtcagagggcaacttttgggagtcagctctgtagttccatcatgtgagtgctggggctaaactcaggtcgtcttgctcaacagcaagctcctctacccactgagcacacctacagacatttttacaaatcatataattactgtaaaaaaaaaatgagcttccctaagcatttagaaagtgaatatttaaaaagtttggtagagaggaagtctttataagcattaaatattttgaaattaaaaatgaagaagatgatgactaaaaaacttaaaattaaggaactgattaaatactaaaatcttggcaaagcatgtacatttctggtgcatagggctttaagtatctattgtaaacaccaggcaatagttatgacaagaaaacagtttattaatgaacaattaggcattgaccatagtgcttttggggttttgttttgttttgagacacagttgtactatataaaccagggtgaacttgaactcacaatgctcttgcctctgcttcctgagttcagggattataaccatgtgctacaaggctccactcactcaaaattcttaatggttgcctagtctttctaataatggtacaaataagaattaaaatttcaaaaggtggtatgagtgtgtagctcacagggagtacttaactagtatgtggaaggctttgggtttagtccccaccttcgcaaaactaactatctaaacaaacaaacaaacaaacaaacaaataagtaatatttgtgttatattccaatttaaaaagaaatcatagctcttaaaatgagacaaaggtatggtgatcaacatttagatggtgtgtcttggctacttttctgttgttgagccacaataacctgccaaaaccaagtaacaggagaaagggctatgattcatagttcagtcatagagaggaaagcaagtctaaggagtaggaacatgactggtcacgtggcatgggcagtgaggaagcagagaacaaacaggaagtggggcctggctatgaaacctcaatttgtgaccccagttatgtccttcctccagacaggctccaccttccaaaggttctacatcctttccaaacaccagcaccagctagggaccacacgtcaaacatgtgagcctgtgagagacacttcacacacaggccacaatagatgctagaagccagttacaaacacacatgacccaaaatatgttcaaatagtttccaacctagaaatttttcttctaagacacaatacaaataatcagaaattctactgaaaatttatctagaaggatgtccataaacaaaaaatgtaaacaataaaatgttcaacaagaagggacagattaaattttaaattattgatggtataaccataccaagggaaattatgtgggcattaaaatcatgttttataaataatgtttaatgacaaagaaaaaaatctcccataagtgaaagaccaaagaaactaaacgaaatgctgtatgatttaatgcaatgaaaatccagatttcacatttagtcttacatgcatagaaatgactggagcaaatgctttccaaatgataactgaggaaccatcctggatggtatgatcatgtatagccctaaaaacatggattattggaatgaagtccacaggagcctggactaaagggaagtcaggttatttattgcagagtcactcacaaatgacaaataaaaaagagacccaccaaggtcttctgcccaggagtggtgaaagcggcaatcagatcttggccgccatgagagagagagagagagagagagagagagagagagagagagaggagagcctgtttccagtatacatttagcacctaagaccccggcccagaaggagtcagtacctcaaagactattggctgaatgagttcccacaacatgtatgtatgtatgtatgtacacacacacacacacacacacacacacacacacacacacacccctttctgaaatacacgttttcaggattgaaaaggcaagctaccttagctgactcatcactgtacatgattcatattgatcatggtattgacatgcccatgctggtcttccccaaatggctaatggatccataaccaagaaaggaatgacaagtaacatctaggtgaggcagacaagagaaagttttgaccaagaatggatgtcctggctgacacagcacaagtatgacacctgaaaagggcacacatgtgctcaaacatgctgtaccttggaggcaagagaaactcgtggtacaatgaacatacctacctttatgcacagggcacatcgggaaggacatatctcttaccaacggtgccctgcaaaagctggaggtcattggcaaagcaatttaagaggttgactctgtgcttaaccggaaggtgaaataggctctgggaacttgcatgtgtggcacataagtaatgacagtgtgcactagttggatgcattttcttatcaaacaaaagaaatgacctagcttatcaagtcccctgttcaacaggagcatggattcatagccagtgctgttctataatcaggactgaggcatatagtagggctccagctgttcctaacccatttctcctctctagccatgggcatctgaggatagttataacttagtttgtggagaaggcccagtcatttgtcagagaagttgggcaatccgctccccccacattctcagctatgtttctaacaatatgccaagctgtgttcaagctgtgttatccatcatccatccatctatccatccatccatccatccatccatccatccatccactcactcttcaaataattgtgtgtgcctaaaatagcccctcccccatacctctggtgactttactacttcaatgaagatgtaccagtgtgtaagtgaaggatgagtatcacaggcccgtggccaaccattgcaggtaccataccatgcctaagcccagagattttattatcactgtctttattggccacagaggggaaagggtattgtagctttgtggcttctgagagttcattccttagcgaactgccaagcctcttggcagcagctcccagatcacaggaagggggatttttttttttatgactacactgcagttttcgtcagaaaagcaaaagagagaagcaggtgacatggaatacacggcgatagataagcctaacaaagctgagtagcggtcattttccttcttacctctgtgttctctccctcccactcctctgtcaactcttctaatatcccctcccaaaccagactccagaagaatctaaattggcttcacctcaaaaaaataataaaagggaaacatagagttgtttattatattctatcatgctttaaaaaatatggctctcagagcccatctcagtgtgagcagtctctctctgtgagctctgggggtgggaggagagtacagtgtgtgtgtgtgtgtgtgtgtgtgtgtgtgtgtgtgtgtgtgtgttagagagaggggggagcacagtgtgtgtgagagagatggagagtgtgtgagtaggtgtatgtgtgtgtgcctgtgtgtgtgtaagagagagagagggagagagaggggggagtacagtgtgagtaggtgtgtgtgtgtgtgtgtgtgtgtgtgtaagagagaagatcacagtgtgagtaggcatgtgtgtatgagagggggagagacagagagagagagagagagagagagagagagagagagagagagagagggagcctatgaatggcatcatgtgagtccctcctctgtgttgcagagctgagtggctctcctctctcagagcaattactacaaatgatttatgtggccagtcaagagggcctgccagggttcttatttcatctccagaaaaaggaactctgctggaatgttatcagggagcttgggattaaactgacagctgccttttgttttcccgtgaaagcttctcctctggactgtggcgctcctgcactttccacccagagagccagaattctaggctgtaaagccctgctaggaaagagccacagtaagggaactggggaggagaggtctccttctcccctctgtatttatcttcagttccattccagatgcagctggctctgcaggctggaagattggctccttattgaactgtgcacacacaagcagggcaccacatcttgactccctgttaccaagctcatcttggctgtgccgggggaacaaaggctccttgcaaatataggtcagtgaaatgtgaccctggctctcaatctctgccagactggcacatgtcaggtcacagggaatgaaagtgtgtgtgtgtgtgtgtgtgtgtgtgtgtgtgtgtgtgtgtgtgtgaagaaactgggcaagaagcaaagacaccaggttggggcaggcagagacgagctctggacacaaaccacacaacctgtacatcttctcatctgcagacatcccaactctaagagactgtggtgctaatctcaaggcctgggtcatataggcgtggttggctatagccttccctgtccaacctggtttgctggatgaagggagggagcaaggatctggccagccctgaccctgatttaaaaaatgcatttacttgcacttatacaaaagtatgcacacacatacatatacacacacatacacacatgcatatacatatacacacagatgcatacacacatgctatacacatacatgacatacatgcacatgcatgcacacaaagatgcatgcaagcacacactacacatcctgatgttcggatgactgcatcacaaaattctggagataaataatagtaaatacaaattaaagaaactctcaagggaacagagaagcatatgatgaaaagagactagggggtgggatgaaaatgaggaagcgattataaagaagaggaaggtttaaagtaaaataatggactgtaaaaatcatgtttatgagtttatattttctgtcctagccagagacattttggcttttgatttccaacttttgttcttaagtaacaccttgccaagcggtattgagtaatgcctaacacgagattaatttttatcaagtcacacataactatttagctctccacagtgtgtatagatacaaggctgtgtgcgcatatcaaactagagggggtgttttgtggttatgggggatctctgatctcagaagggaattcatactgatagagacatatgataggttagttatgctgctacacattttctgtacattttccctttattcctcagtacagctctatgaagtatttctagtctccctttacacctgttagagatgacaagtgagattaaataactcattgcctagtttgacagatatcagtagctgcccagctaatattcctttcattttcttccttagaattgtgatggtgtttgaagaaggatttcccagcctcctttgcagtttgggttggtggtctatctgagttatggctaataagatgcctgcagaagtctgggaattcctgattggcccaccccttctcctgttgctttctaatttcttctctagtctagagagcagataaggttggtcatgaaaatatgtggatgatgtaacaaccgtgttgctaaaggtgatgggaaatactgtataccttcgatgagttacaatccccttcatgtgcccctcactggcttctgactacaggagaaaaaggagacacatttatatcgtgcctctgtaatcaaccgctccttacacagagaaaatgtaatcagaactgacagcctacaaaggagagctagagctggaaccaaatcttactacataaggacctccatcatcctctgcaaccactctagaggagcacagacatgggaacaagtatggtgagccctctgcagctaacagtagttatttgtcttacacttccacgttactattggtcatcaaaggaagtcaggacaggaactcacacagggcagaaacctggagccaggagctgatgcagaggcgatgaggggtgctgcttcctggcttgctccagatggcttgctcagcctgctttctaatagaatccaagactaccagcccagcgatggcacccacccacaataggctgggccctcctacaacaatcactaattaagaaaatgccttacaggcttgtctacagcccagtcttatggagacattttcttaattgaggctccctcctctcaattgactctagcttgtgtcaagttgacataaaactatccagcacttgttaagaaccttaaaaatctcaggaattggagaccctgggtaccagaacctctatgatggggttaaccatgaaacttacccacaggagagttggttgacataaatgccatgcctctggtgagtctgtgaggcatttcttggaaggataacctgaagagggacactccttttgcagagggggaagcaccttccagatataaggagctggggagaacagcgcatctttgcttgccttcacttcctgctgatgagtaagtatttcctctcccttgctgccctcaaggtgggctgaagtccatggctctccaggaatccctctagacttttaaggtcaaagtggaactgctgaggcaaaagacttgttgactgagcagctattgtgttcatggcctcttcagtgtgcagacagtcattattggacaggccagactgtgtcatgtaagccaacctaataaattcccttcgtattatagatacatcttatcagttctgttcttctagacaatgctgaataatccaggtcctatccccaagacatctcatcactgtaagcactccaaaatctgaaacacgtcagagatactcaaacctatatttgctctccatcctggaaacatctgtggaaatctgcaactcagcagtaagatggtctcattttacacccaatcaacccacacagtttcaccgcttcccacctggctgcagcacactgcatagtctcaccgcttcccacctggctgcagcacactgcacagtctcacccttcccacctggctgcagcacactgcatagtctcactgcttcccacctggctgtagcacactgcatagtctcactgcttcccacctggctgtagcacactggcagatggccttgctgcttctagataggagtctggtatctcctttgggaaattagcctgactatgagaatgacaaatagagcctgtattccccaaggcttagaggctaaggatcaccacttgagagtccttacatataaatagcagcctcctagttagagtattaatctcttattctatgaacgtagaggcaagaatcaccacacatttgagaaagcttctaacaaaaaatccagcacccaattaacagatggaaaagagaacataaaagcaatgaaacaataccatgtctgtctagtggtgtgtgtgtgtgtgtgtgtgtgtgtgtgtgtgttgtggtgtggtgtgtgtgtgtgtgtgtgtgtgtgtgtgtgtgttgtgatgtgtagtgtgtatgtatggtgttcgtggtatatgtatgtgtgatgtttatggtatacgtatttgtaagagaggtgtgagtggtacatgtgtggtgtagtgtgtgtgcatgtggtatgtgtatagtatgtggtatgtgtatgcatggtgtagtgtgtatgtgcatgtgtggtgtatgtatggtaagtggtacctgtgtgtaaggtgtagtgtgtttgtgtggggtgtgtgtggtgtgagccacagtactcttggggtgtcagttttctgacaggaactgaggaggtcaggtgaagcatggagagcttcaaacttcctttttaaatgtgtttgcagtctggcatcctgcatccagtcggacatgagctcaacgtgaatctatttctccacatgcaagacctcaaaatacccatctctcttccctcctcagtgtcagctcacagaacctctagccatgctccttgcctctctctctgggatagagttggtaagatttgctgtggccttgaagccttgctgtccttacagatgtaggatgcactcagggtcctacctagtgaaggctttcatgtctcctggcacacaggctaggtcaggcaaggtctcatggtgtgccccgaaaccttctaagacaagaatgccatttgttatcacaatctgaagggaaccaagggatcgagaggccccagtctccatctagcagcccccacagctgcttatggccattgttctatgtctcccctgatcttcggagaattaaagggtctttctcccttcaagactccatttgcctggtggtggtgcacacctttgatcccagcactgggagcagaggcaggtggatctgtgtgttcaaagccagcctggtctacagagtgagttccaggacagccagtgctgtcctgtctcaactcccaccctcaaaaaaggacccattacactgtctatagtgcagttctctctctctctctctctctctctctctctctctctctctctctctctctcgcacccacacacacacacacacacacacacagacacatcacacacacacacacacacacacatccctcccacttcaaggcctgaccatggctgcctgtggcattgaggctctctcttctaataaagtccttgaagtgtaacttgctgtcagctcctttccatgaacacattttctaggtatagcagtcaggaagtgatcacagagaacacttcactaaaatgagtttctaagctaagctagaagagacacagaatctgagaacaaggggccccacacaggagcaacagaacaaaggctctgccaccagctccctagtcacctagcacctctccagaagggaattgaagggtgtggggcccctgggagaacagtctgcaaatgagtgggaagtatccagcgaagggtctgtggatgatttaagcctaggaacagaggaaacagaacagcacagggaaaaacaaaacaaaacagcaatgatacaaaaatccttaagttgcacctagtagaaatgtcatcaaaatccactattcagctcactgataaactatttaactaccaaatgcacagacacatacacacaaatacaaatctcactcaaagttgtgatatatatgtatgtatatgcacacacgatatatacatatgtggtatgtatacacacatacataatatatactattcatggtgaagggggaaggaaaggaaggtagttggagaagtagaagagcagagggcaaactcctgacttccatgctggagtcaaaaggtagcatcaaaacagagatccagaaacaactgcagaaatgctctcttttagaaggggattcattccaggagaaacagctggaatattttcaagctttggagaacagaaattagggtgggcagaaggatgctgtgaggattaatgcttttatcgcacatactcactagcctctcatattaagtaagtgtaatgcctggataatgacacagatcaaaaaccaagggctggagagatagatcagtggttaagagcactgcctgctcttccagaggtcctgagttcaattcccagcaatcacatggtggatcaccaccatctgtaatgagatctggtgccctcttttggcatccaagcatccatacaggcagaacacagtatacataattaacaaacaaacaaataaataaatctttaaaataataaagaaggaaaagaaaaccaaaagagccaagtccttgtccttgaacacctactcaggatgaaggatgcatcttactatcctcctgtgagcatttcccacacaggagatttggtaccttgttctctctaactctgtgcccaagatccccagagtcttggtttgtggcttcggtgcaggtacagcacactgcatgaagttcagacaatgttttggatagctggaaagtgggtgtgacctctgagagatgttaagtcacatgcttagtgtagtttctgggactcacagggtggctggagttttctggagactgcttgaatcttacttgtgtctgggttctctgactttcctgtccttggattccaaccacccacccttcaattagtaaagatcgcagggctagaagtgatggagagacccaggtgataaggacaaaggaaaactttctgctattttcatggctgcactatagaaaagaaagagcatcattagagtttagtctaatgaggtgacattagataagacaaggaaaagtcaccgcatgtaaaatataattatctggagaagatgtaacatgcaagtgcccttggatttagaacacaaaaaccaattctgatgaaatgagaataaaattctaggaaaggcagagtgggaaaagctagaaggctctgcttgtgtatgaaagacaaataggtttgttctatagcacaggattcccgtagtctatgtagaaagatggcttgaaaacgcagaaaaaagggaaggcaacaacctgaggtgttctgtgcttaataaaggagaacttgtgtgtgtgctggagagaggtgtgtgtgcatgtgtgacagacagaagtgtgtgtgtgtgcgtgtgtgtgagtgagaagtgtgtgcacgtgatagtgcacgaatgtgcttgaggtgtgtgtgtgtgtgtgtgtgtgtgtgtgtgtgtgtgtgtgtgtgtaagccagaagaccaccttgttcttagacactgtctatctgatttcttgagactgggcctctcactgttatttggagctcaacaagtaggctaggctggctcatcagggagtcccaggataccttctccttcccaacagtgccattgtaagcacatatcacagcctctggcttttcatgagaatagtggggatcaaagaggtccccatgcctgagcattttactaactgagctgccactctggcctaagaaaactcttaaagactgaattatttttcttaggacagatatgacatgatgtagaataatagacaacttttttttttttagaagttattatgtgctggttaagttcctcctgaaaactagatttttttaaacttttttctttaaatttagatatatgatgtatgttcatggggttaacgcttccaaatttacaaaacagaaacaagatacaaagaaatgacatatttaggctgtcgagatggcgcagcagttaagagcttctcttttggagaagacacaggtttggttcccagcactcacactgggcagctcacaatccccacaactccagttccggggggaatccagcaccctcttctggtctctgtgggcacctccacatgtggtacacataaatacactcaggcagacgtgatcataaaagaaaaatcttaaaaatagaaattaaacaatcagtcgaataatacaagcagcaagcaatagtagggtgggactccaatggaaggctccaaatttccaagcactcagcatgcctatgtctatgaaattaaaaaatttaaaatacttatcaacatgcagtgatctagccaggaaaaaaaaatccttcatcatcggggagttttttttaaaaaggtagtactactatattgtgtttagtttttgctttctacagattccaggtcagggttcctgaattcagctgggatggagttaaaagtttctgctcagtactgaagttttctctgaagatgagtttcagaaacgagatccaggctccctcccttgtctgtcatttatcttagacctcaggaggtaacagcagcttgagctgtaacacagccacaatgaagatggcagtgaacggtaataaataacacttccaacgcttgggccctgtgcatcagaaaaaaatggaaagccactcaaggctttgaatggtagatatgccacatctgtgcatatattcaccctggatccaacacaagtcttttaagatgccaggctctgagacctagccgtggtgcgtcagtggggaggggagaagcagagataaaaatagagatgttgattgcattgttgctaattcagcccagctcaacagctccagccggggtgagtcaacagcagcggttcaaagacacaaaaaggagaggagcagggtgctctgtgccactgagcaaaggggactcggtcacaccagcacctctctgactaaatagacccatgacactgaggctgtgtggtgtgagttcaaaaacgaacaagtggaaagcagtgagggacaaagtggctgcagatcgatggacagcagagggctgacccactggcaaaaaagctgccttttgtaagactcctgggctgtgggggatgggcgaaagagactgagcttagaggccaacttccactcttcaaacacagtattgttttctctggggcataaggcttactgccattccagactggtctccatggcagcaggggaggaggaggggagaggaggaacagatgggggtcatggaggtcttaattctaatgcagaggtcctccctgccagcccctctctccttgaggacctgtgacatgttgcaccatcttgggggcccaggaagcctctggtattagttcaattcaactggccagatcttgggaacctactttgtgttagtcgttcgcttctaattggcaggagcgtctgttcagtcagtctctgcttggttggaaagctggaaatgaggaaaagacctactttctgttcctttagctttatcttttcccaatcctaggctacacttcttcacaaactgaagatatgctgccacgatgttggggtagcagaaaggaggaatgcacacttgctctcttgacccagatgctagctaaccttacagcaccattggaaagggtgagagagatagtcactctgcagccttagagttcctgggctgctccccctctttctagctcctttgcttgtgtacgatactgcaggatggtgcaaggtcaaccgttcagaaacaaactccagccatgacatttccttcactatcattaatggtgaccccaaaccactatcttggaattcaagatctgcccctgcctggccttcctcactcttaataatcattctcttctatcttttgaatggtttcatggccttgggggacataataggttgaatgaatgaatgaatgaatgaatgaatgaatgacaaacgagcaaacggacatcaaagaactcacttttgtctccattttttttttttttgttttggttcatgttgttaccatatctcacccttgaaaataaactttctcctggcttttacctgcaatttctatcaaggtctagttcatagctcaaatgcactgcctacttcatatgattcaaatgaaatacatcatgttttacctctaccctctcagggcctggagccatcactatcactctgttttggaagccaggatccactctccctcaggctccattttccactatcagcaaggcccttttccttcctcagtgtctgttgtactgaattccattcactccctcctgtctctatttctcctcacccctttccctcagccttcaaattataggactaaagttgcttccaaataagtctctccatgtccactcccctccaccagctgtgtggtcagatggaggatttcaaaatgcaaatataatccctccataacagcctgtctgtaagtcttcagtggcttcgcttcacttttagcatggtgggtacagtccttgaatcaacatgaccctagcctattttccagcttcaccccctcacttttctcctcttatgagctgtgttccttggagccctgggatctcatgacactatttcttctagttacaatgttctgcctctgctgtttgaacactggttcccaaacttcaggattcaccctagctatcttactatctcatggtgaacaggggagcattactttgttgtataatgcacagttctgtcacttgtagtaacaaggctggagtggggggaataagttaggaatagaacagcatcctgctcgaacatacatggaagcaaaagagttgctctcacagaaacagagagcagaagagtggttgctagagcctgggagtgggagagggaggactggagagaggatgcttaacggggacaggaatacccaccactgggtaggaagaaagaacttgccaacgttctataactgctatggcacaacaatggctgataacagtcccttaaaatttcaaagtgggttacacaaaggattccaggatcttccccaaagaaggaggtgacctttgtctgaagtgacaaatatgccagtcgccctgaatcgatcattatacattgtatacatggtgttactgaaatgtcatagtgtaccctgtatgtatgtgcaactactctgttttggcatataaaaacatgccaaaacaaaagcatgtggtgggtggcacatgcctgtaatctcagcatttggaaggccaaggcaggaggattgccatgaatttgaggctagcctgggatacagagtgttatctccatggcactgtcctttgcaggggctctacctgggcatatgcttgcttgttttattggtgtctttctctgtggatacaaacatgggcatgaggctaggggccatcttcatttgttgtccccgtcatttgctaacgatctggcacacagcatataattataaatacttatccaaacaagaatcatgtcgttgacatgggaagggcctaggcctggcctaggatgatgtggtagactttggggagccccttttgagggccttaccctgcctggggagtggaggggggatggctaggggcaggtgggatgttgggaggaggggagggagagggagaagggattgacatctgaagcaagcttgttcctaatttgaagtaataaaataaaataaaaattaaaaaaagaatcatgtcattgatgaagctttctgtagtcaactgaggatataccaccactgcttcccattttactggaaaaagcccagcttgcgcagaatgatatatttttagagggtccttggaataggaaaagcatcaaatactgttgaatatccgttaagagctggagaaaccaccacaaaacatccttctacccatcatgaagcccacctccttggctgggacaatctaatgatacagtgcactggaggagtttagtgtacagtccagactgtagcacaaactcaaaagtgtcagctatcattatgggctggcattagaatggcctgcacaatcagaatttttaagctctgtctaatttcaaagactctgtcttaaggtcacattccttgactttaatctggaaaaaaaaaaaaaggatcacgcatacagactctatcaagtcagattcctgtagtatgctgtctgtgtctcgatgtagtagtcattaagtaactgctgtatgagatcacttgacctgcacacagaggagtaagaacctgtctcagtccctccccattttcatcccctttatatgctgctcccagaaggctgatagtacagagtttgtctagcatgaacaaggctttggctctgatccttaccactgccccaaaccgaaatcagacaggtacagaaagaccagctaatatgtgaggcagaatgaaattgcaattaaatggagggacacatgaacatctgggaaaatggaaaagacaagtgatttctggataaattggcatctgattgcaccagggcagaagagagaaatctctggagccgaggacagcagtaaagtatgccaagacatccaggaggagagaacttactgggctgaggttctgactccatgtagtgtgtgggtcaccaatggaagagaagaaaacactgtgcattcatctgtgagatagggaaggagggaaggaggcagacagccaatcactggcagctgatgtacacctgtgaacacgaggctaagaggcagtctggcatctaggtagcttgtttccaattcagaagctgcacagtctctcatcacattccctgcttagaggtgactgaggaaggacaggtgtaatgtccacagtcacttagatggctaggtgggcaaggctagctcactttgggcggttatttcctcctaactggcttggatggccatcaggtatatggccacaggaggggacactattttctgaacactccactattctcagagagaggattatgaaagcaagatcagccaaaccctagggtaatgacgtagctttctcacaaatgccaggctatgatttctctccaatttaatcctgcccagctaggcagaacttcccacccaaccctcattcttggtattttatacgttaaatcaaaagtccttgtaggacaaagcagttttcatttacaccagatttccagtgtgttgaagaagaagctctttttctgctctgatccctgtgatattaagataatatctgaggattggacttcgtcattccactcatggtgctgtgttcagcacgggaagctctatgtccttctgtttcataacccatgtttagagaatgacctcttttattctcctgctgccccatgccatcctcccctctggcaaaaagccaaacccaaacctggtgggttgatggcatcctttcacaccttcatcgctaatttgatgtgtcatccaactggccaacttttcttggtatcttggtgatgaagcaacagtcatacaaatggtaccaatccctctgcttttcgctgaaagggattgattttgaagggacatgaaactacacaaatgcatagctcatatgaaagtatagctttcagtgaagtatgctttaaggtcaagaagaaaattaaagaaccatcaagtaatttaaagcccgatgtttgggtattctaccatttcttccttttttttctttttcttaaaaattatttatttgaagtgtgtgtgtgtgtgtgtgtgtgtgtgtgtgtgtgtgtgtacagatgccataaacatatgtggaggtcagagtacaacttgggggtaggatctattctttcctttcactacctgggactgagggactgaactcaggtcaccaagcttggcactgcatgctgctaccgatgagctattatggcattgtcccctattctgtcaccttactggaacttaggtagttaagaaaaattaattttcccccattgttaaatttttccctaggttacttcttaaaatctctagtcttgatttaaagatgaaaaaatccttcatttttcattttgttaaaaccaaacatccaatctcaagctgtttacatcgctgttctttaagataatgaaactgctctgtgtgatgactcatgtctgaaatcctagcactttggaggctgaggcaggaagactgctttgggttagagataagcctagactacacagaggccttgcttcaaaaatccagcgaacaaacaaataaaagacaaaaaatattgggattggagcccattttcgtgatggcttgcatctgtgttctcctagactgtaatcctcactagctccaaataaatataaacttcccttgtccttaaaaaaggaacaaaaatattggaatcatatttttataattctcctttcctcacttactataccatggacccccacggcattaaacattattttatggtattttaatagcagcttaatgtcccataatttagtcaaatccccactaagaccctcctcaattatttacagatatccatactatgatgagcatcctttatctgtatgcattcttttctttgtttccttctcttcccttccctcttctttccttttgggttgaactgagccaggaaagcattccaccatgaagctgtattccagcccccatttttacctattattctgagacagggtctcactgagggactcatcctgtagtccaagcaagccttgtgcttgcaataatcctcttgctgtagccgctcaagtatctcaggtcataggcctgtgccaccagattctaaaaccacatctgttcatttattgttttatttatttgtttattgttacatggctgggaatggaattctgggtcttccactctagacaggcattttaccactgagccacattcttagctctctgatcatactgttaaaatagctttcttttagagtcaccatgtcaaggaagaagagcgcttggaggagctcctcccacctgcactagcaatgaagaacaaggaacaaccagtgagatgcaaagggagcagagaggtggctgttctagcatgattctagaatgttctaaaatgacaaggccatttctactgctcagcttaacgtcagtcttcatttgtaacccggagccaagacaacacttttgggatagttttgtgtctcttgtcagcatttccacaggggaggaagagagcatatgccacagatctgcctaggttcgggactgtgaggtaaagagatgggcacacacttgaacaaggtgactttttttttctggtatgggtaccaccatcagttttatcattacctccatcacaaccattactgtcactatcaccaccatggtgacaataaggatctgggaggtcctagaaacaagggcttggcaacttgagagggctgatactggagctaactgtgcttagcatggagttcctgttggagttctggacagaggcctcctgccagcttcacatggtttctcaggcaacaggttcacagcaggaacaatccaccctcatgcttttcggtcccaggaggccctttattggctctagacatatggccaggccacacgttctccacccttaaacacagcatctgccctgtcaggaagagggcttcctttgagtctgttcctttcactgaccacaaacaaggagaaagcagctgcagaacggcacgcagacactaggattccggctggatgactgcctacacgaggcagtacaggcccccttccgtgctctgccccacatgtcaaaccctaatcaggcagggagccagtcgtcctcattgcagtctcagttaaagaatgggaaaggaggctgagaactgtgttttgctttttcactagatgataccatcagcattacagcagagagggaggcacacagcccagcagcagaggtgtgtctggcatctttgggctgcacatgtagaacaaatacacaagagaaggaaaagcacagagttagatttaataacatggcccctatagaaggcaggcctggacaactgcggagttttgtcttcgggaaactcaaggtgctggctcattgtccttagaacatccataagtgattctctgtcaactagattggagaaaatgtaatagccacacctgtgattatgatcattgttaggaggccacagggcaaatcagcatggaggcagaaaagcaaccaggaactccaggagttccaggcttaatgcagtgtgtgtgtgtgtgtgtgtgtgtgtgtgtgtgtgtgtgtgtgtgtgtgtgtaaagaggaggaggagaggaacacctgctaacaacagaccttaccacaaaggcaggactttcaacaacttcttacctgctgtccaactcagaccctttcctggtgtattcaaacacagacagacagacagacaggcagacaggcaggcagacagacagatggacacactcacagtcagagctgatgcaaccaagagggaagtacagctgctggtctcctgcctctcatgggtctgcagcttcagtgtgtgtgtgtgtgtgtgtgtgtgtgtgtgtgtgtgtgtgtaggtgcatggtgattttccataccctctatgtttgtgtgtgatcaggtgaatgtggcagcttgggatgaaactgaagtcaggagtggctctgaggtcatgtgtcctggtctttttctccatcttccttcactgagtctactctctctcttttccactgtcttacatgctgtgtaacatatatgtggtcactgttatctgcttaaatgggagtaactgcagggtagagttcttcattttaagcacctaggtcagtggctggcatgaaagaggtgcttggtagatttctgtttaaggaatgaatgcttattagccattctaatttagactctagttaagtggattgatgagtgcagagacttactcatctgcctgaaatatttccactccccctctccccagccctcaggctcagcacagctccccctgtccaagtcacagttgcttctgacacagccaagcaatcactgtcacttggccaaattgaggaggaagtgaaatatttactggagcagaaattccaggggtcagtagcctggcttgtcctcacataagtaatgatggttagcgacaccccagcctaccttagtgtttacttctgaagcacaactggccagagtgtggtttcagtcagtgattcatgaatattcaaaattgtttcacatcttcaaagtcttcatattgtcaccagaaaaaaaaaaatcctaccttaaccgtctttctagcctcagaatgccttatatacttactttctgtatttctttgaaaatggtcttgaaaactatgcaagaaaaatggagaataaaattaaagtcacagactggcaagatggcttttgtgggtaaaggcatttgctgctaagcttgactactacttggaaaatcagtcttgagaaatgacatagttgaaggagggaaatgactcccacaagcataccacacacacacacacacacacacacacacacacacacacacgaataaatgtaacaaatggaataaatataatcgatcacaatgaaacaaggggcttattagtatctcccagttgctgagatacaaagagtaaatagtttgccagccaaaccaagacaagcggcataaactctgatggacggtttgaggcagagtttatataggacactgtagagacagtgtcctatgtctaaccaggttccatcacaatagaagatgggaaagggctaacaatgtccaagccctgtgatttgcatcctactcagtttgaatcaaagggtcatggatgttgaatccaatattcatagtgtcgatttgcactaatttcaccagtttgtaagtatcaagcaagtctgttcaatagttgacctagcaaattaatctatttcccctattagtttttcactctttagcatgacaatatcagatacactgttaaagaaaaggccagtgcaaacttcctcctcagggatgcatctgtctgcttgccactcccaccagcccacagataatccccctccccagttgcagccaggtttctatttttcaatttctaaccacaatagaaaaagggaagaaggactctgattttccggagggaccacacaatcagaaaaggtactttttcaacatcattagcaattcatctcctgaaacctcagggcagcccctaggcagcccctcctgcaacccccactcccacccctacccccacccctacccctctcttttggtgtcggcttatcaaattaatgaagcctatctagacagaggaggttaggatagaaggcagcagcttaagagcaatttaatgcaaacccctccccaccttacaaaataagcatataggggggaaaaatcagaatatctttcatagaatgagaagaacaaacagggtgttgggggtggggtggatggctgagattgtctccctgtttggtgaaggagggagggatgtgtggtgactttctctggctggacatttgcatggtaaaaaggtgccattcatttgtgtacaggaacagtctgggccacactttctacttggtagtgcagaattcaggctaaggacttctggtaaagagtgaaacaactccttgcaaccttccctctcatcttttggtaacacaccttccctctgtcgtgctgaggtggccagggatgagatttctgtgacactgtgcatttgtgcagagcattggtgggtgacagatggctgatcccacttggggcagcagtgagctgcaaggcacagggcagacgacaggggcctcagagcctcccattttgcttgtatccggagagccaattttcaatgtgagttacaaaacatcaacatctctcatcacatcactgacctaaatatagacaatgacttcaaggaaaaaaaatagttgcatgttcttttatacctgtgaatgctacagagctcctccaacaagcaccaggcaatggggaacagatgagcagtgagataggaagtcagaagagcagagatgtgcctgttctagaatgatcactgcaataaggccattactgtagctcagcttcacatcaatcctcatgtaacccaaggttgagacaatagtttagaaacggttttgtgtcccttgtcagcttttccatggggagtgatggaaggggatgtccccatcccctgcagatgtttctagctaagctgctctggccaccagcttgcagaggtctctgatataaagagaaaggctcatccttgaccaaggtgccattttttcccacctgagaagactgagctgtggtgccttgtgctagtctgtgagagtgacttccagccattcccaatgcctttgtcacaatgtccaagtcccttttcacttggtaacactgaggtgggcaggctcaatagtgtcaggcagggttactttgtctttcctggatgagttcagagttgggtccaatgtttgaatgctgtgttcataagagttcatacctaattcttatcatcccactgcctgaatagaaggctatgctggaagcttttatgagcacggatctcacatcacatcaagggaccttgggaaaggtacctgaacaaaacattaagtacagacagcgcagtggtatcagcgattaagactcaattgtgggcaatccatctgagaaacagtcacatgcctctcacatatttctaatgctcttcctgttcactcaggcaactatctgcatgagaacaactgcgcagaggctccctgagtgtagcataattgcctgctgttagggaaccagcaagccacttcagacttaagctgcccagaactccatcatttagcctaaaacacaaacccacgctcttttgtgtcagcaaagtacccccaaatgcagccatcaatttgtttcttcagagaacatacacacaactctggcagaaacatattccaccactataaaaggagccttatttcttggaaaataatagcagagaatagtgggaagggcactgactgcacacaagctaaggaagccaagccaccaggacacgtggcaaaaacggagccaaaaccaaaaccaaaaaacaaaacaaaacagaaaacaaaaaattccccccacaaaatcaaaccctaaacaaacaaaaaacgaacaaacagacctgcagtagaaacccagcactagtaaatgagaagacctaattaaaaataaacaaacagcaattatttctgctaatggagagccttaagtgccaaggttaatagtatctatgcatggtcgtgtgggctggaacacctggcccagtgagactctgttatcaccgctcttctgtgcatcatggctaagttaaagcatggacaaaggtcagaggtgcacatttagaaataaagacatcagcaaaggtgatagacacagcagctctgaagtgcaggtaccacaactggaacaggaatctagttgtcctgtgatgtgtaggggatgatactgacagccttgctcttcagcaaggaaggctggctgctgaaagttcctacaaaggaccttgaactgggtttgtgtgaagatccagaagatgctgacagcagtatgcttcgctatagggtcttagcttccctacatagacttttggaaatagcactttgctagcataggtgagtgcaaaaaaaaaattataaaagacttgggggaggaggagaaaagcaatttggtcatgaagaaatacacccagagtcatttttttccaatccaatatctttgttaattaagcatttttccatcttacaatgagaatacgaatagcaatcgaatactataccactcattactaataaaacatatttatgaaatggaaatataatgtgcctatttccaaaatgtggttataaatgactgactctaagccacaatttaaagtggtttgagaaatgagtctttaataaagaattgatgaggatgatgactgctgaaaataattctatttggtaagattatgtggcttgcttatggcaatttgagctgaggtgattgcctcaaatattacagcaagtaactaatatagggaaatttaattgatgataaatacagtggttgtgtgtaattgaagaatcctgcatcctctcctgcactaattacatccagtcatttcagtgctgtcaaggtgttatttatctggtatatgtgcacatagtaggggtttaaaaggtgagtgaataagtgcctataattagtcctcaatgtgggttccttcgtacaattatggttaagcagaaagccattaacattaaggaaaaatataatacggctccagttagagccacactgcatctgcgatggtgaaacggaaggtcagcacgtcagaacacccagatcttaggacacattagctctccaccaattaaagcacagctgtatttttaatgatatttagaactacactaataggcacttgatataacttccttggctatctatccctttgactggacaaagaaagttctctgtcagcatagacatgaatagatctctctctctgtctcacacacacacacacacacacacacacacacacacagagagagagagagagagagagagagagagagagagagagagagagagaaagagagaggtcttaggttgtggtactacagagaacaaaaagacccagtgtttaagagactgaaagaccagtgagaaagatgggtgaatacacagcagaagggccagctcagaaaacacaaggccaaatgagaatgggccagagaagcattttcaagagagatttttatttttgtattattattattttggttttttgagacagggtttctcaaaaattgctttgagagcctatcttggaacttgttgttattttgtaaaagtttaaaaattagaagtctcgagatggaacctggcgcgatggaacacgaaccatagagaacataaagagtatattaaccgggctggagagatgtctcagaggttaagagcaccaactgctcttccagaggtcctgagtttaattcccagcaaccacatggtggctcacaaccatctgttatgagatctgatgccctcttctggtgtgcagatatacatggaagcagaatgttgtatacataataaataaataaagtcttaaaaaaaagaagtttaaaaaagagtatattaaccatagagtttattaagagacagaatgagagagaggagacaggaaggtaagacagcgtgacaataagagaagagagtgtaagtgggcgggggtctgtcttttaaaggggtcctttaccccttcgtgcagacttagttcccatggaaccctgggctgaccagggtactgcctgagtggtttctgtcaggtaactggggcaggccagcataaggcctgaacctttcagaactctctctgtagaccaggctagcctcgaactcacagagatccacctgcctctgccttccaagtgctgtgattaaaagtgtgtgacaccaacgcccagcttgagataattttttaaattaaatgatatttattattattgtgtatgagagagtgtgggcatgccacagcgttcctgtgtaagtcagggagcaatgcttgggagttggttctctcatcccaaggtagaacctatggatcaaacatcaaccttgcttagcaaggaagtacctttcgcccattaagctgtgtctcctgctgacctaaaagataatttttacttgctttgggatgggagatgttaatgaatgaatagtttttccatgacgtgaaacaaggtaaagtgaaaatacacatgggatgtcggccccaggggtctgtgggaaccatctgctttgccttcccctaatgatccacaacatcagggtaacaaaaaggcgacttgagtcaaaccatgagcggtagcttatgagttagatcaatgctgccaaaggctcccaagaagagaaatagcctgtgggaagacatgaagcttctgtgtttgaacaaatgccccattgaaccccataggatgcaagaggcagaggaaggagaggacactgcctggggtgactaatcaggcagatgatgaagttgtctgacaccgagggtctgcagtctactgtgtggagatggatgcctcagaaggagtcctgctctccatttgtagtgatgtttttgtatgctgtcataatgagtagaaaaacaacaattatatataaaaaaagggttttccaggccaagagagatagtattaatgtgcaaacatatactcataaatactacctgctcttgtgctatggtagaaaaaaaacttgtctactatggtttatgttaaaagataggaagtctgtaatttatttaggcatcttaggctgcagacaagttgctgtcattttaaggaactctgcaccggaattttatctgcaaatctgagaaccctcattttaaagaagacatcaattattctaagccataccagagagagggcggcctttgtgacaatgggtcagataagcgtgctggcgggaagagttgtagaaggcgggaagagttgtagaagggactggcaatgcctggggtcaggaaggagccaagtgagaagtttgaaggctttctcaggtccccagaggatgtgtgtaaaacaaaagaacaaacaaacaaacaaaaaacaaaacagtttctactgcattactagatgtgtggacaccgtacggacacatttcatttgaatgtctaatcactccacatcttaaaacagaaagtggtgacaagcaagaacttcacagccattctcacagtcttggaggggattctcaattttgccaagagtcaagctagatgaacctgacacccttttgtagccccagctcatctaaaaggccagcataccctgaccatcacaggcccctataatgtcaaaatcaccaaatggtgtatatgtctagtttccacatcaaaataatcaaatacttttgcatatttggccagtgtttgagaaagagggaaaataggatgataggttcctgttatttctcttttcctggaagattcaggcaatgccatcccatggatcgccactgacttctcatgaaactggggactgagcgtaaattaggcattggttaggaaacagagatttagaaagagttataatggagggcacaaaggattccagagttatgagccctgatcaacagaagtggttggagtgagtgctgctggggtgaaatctcagaccctttctggtcccaatgtgtgcctatgacacagccatggccactactccatccccttatcctgctcagagaatagaggaggtatcatttttcatagacaagggacaggcgatgaggtcatggaggggaggtttctaatgacttgttgctaagccagtctaagtatcaagttcacacactagagatctatttctatctattatttcccataaagtcctcagggtaaaaaataaaccacgctgttgatttcacatttttaataactttttaaggctcataggaagctctttggatttgtttggggaagaaaagaccactccaagtattaaaagaaatctggattaagtgtttccagactttctgataacttatcagtcccaaactcaagcccagggttgggcttgggacctttaagccagatgcacaaacccgaaagcagtccggttttcatacaacacatctttcctcatttactggaaaacactcatgttacacagcaacatttttctgactaagagggtgtggtctgttcattccactgaccaagaagagcacagaaagagtatttctcacctatgaagcgccaactgtgtgtttatgctgggagcacactagcccttggcatgggaacaccttctcttatgtgtgaccaaagctgagatcctgaccatgtggtcaggagagagagagaaaaaaaaaaaaaaacaatctacagggacatgacaccacaaggaacaaaggccatcgtggctctgggagttgatcctctctctctgtattttaaacgtgggatttggcaaaagctgggaagatttaccatcagttcctctcactcccttaaagtgaagcccataacctttgttctgttttctggaccacttttcctcctctgcaaatggatctgtgtttcccaatcttctctttggtcttgatccatcagcaggcattttgtctggtatctccttcctaaatcctctgcttcagcaatcagcatcacaaaagtcagtacttaaaaaacattctaagggttgaccttcaggtgcctataatcatgtactctgtgtaacctaatgactggttctttggtagtaagtttatgtgtctaatatttgtgcacatgaccctgtgaccatcatggatcttaaacaataaccttggaaggagggagacaccactcctttatttctggttaagaaaaacaacagtccagagagcatactagtaatttatgattttgctggtgtattatcatccagtaataattgcaacgtgaaactgccaattatctcctaagaggggtatcaccttttctgttgcgaattactacatcaataactgtgggttcagcactcttactttcctgtgtcactagcagtttttcagcagaagaattgagccagaaaagcacagatcacacacacacacacacacacacacacacacacaccctcagtcattccagtttcaagcccaggaatacatagagggaacaagaagatacacacacacacacacacacacacacacacacacacacacacacactccactggtacccagagagggccaaggaagacagacaaggaagggggaggggtggtgggattgcctggagcagtcaagaggtcacaggcacaccgtgatcagcagcaaactcagtttacaaagagacatctgttccattgctccagtgcattgtggctaattacatcctggcccgtctgtgaaatgacagccacttattctccagtgaaccgtaaaatctgtacatgttcgattttgggagtgggagagcaaaggcgtggaggctggagtggggggaaggggcgcagccaaagggaaagaaaaggcaggagggactactttcccacaagagagcatgataaggtacaagaaggaagggtagaatcagaggcttggcaccccaggccagcatggacatgaaggcaggacactctgaccagactgctattacccttccttcctattcaacgactacagtgccaagtattggtggcctgaaattctccattatcattgccctaaggttgtggcttggggacagacttactcatttgctgtagtttcctggggtttgaaaaagaggcagctggtaggaaccagggtgcagccccagatgggcagggcaaggttctcccataagcctcctctaagtgtaggtcacagcatccatttccaccggacccctgctttcacaggaaagcctctttatcatacactgaggatggaggctggcctccatggagacaggaattagcactaagcattcctaagacggaaaaattcatagaagaagccctacagtcaaaaaagactttccctatgattttgattgacattaaaactttatcttaacaaaagtgacaacaacaacaacaacaaaaaccagtatcacttatatatcttggtgacaaggaccaggggaatagaaacagggactagagacaggaccatcttgaaaatagacttcaatcgactgtggggtttagtgggggtgcttatcattctcacacaaatgctcctgccagaagagtcgtacagccttctgttggaatctgtgtaaaacccaactggcgatatgacagggttcagctaaggttaaactcgggtctttcttcctctcggaacaatgctgggttctgtggatcacatgtacagtcataaaagtcctggagaaaagggttacctcacacttctactggctcccatctgtttcctcatgtggagatccaggctgtgtaccccagacctggtgcaatgcagactcggatcccaaaagttaaggttggggcctttgtggcttcatgatggtgtggaggctgctggccccaggacaggagggctctgaagtgctgagacagctagcacctctgtcgagcctttaggctggcctaatgtaaggggaggcacagtcagtgtgccacgaacacgaggcaacccatgaaaatgttgtagaaatttttactgattttgagtcaaagtaaacaactctgtgttaacgactgcatcatcataaaattaatgagaaggtaaccaaccgctgtctgagagaggaggtccggggagttaaacataattagagaaaaggggtgagacacagaataagccttgattttatgcgaaccccaagaagttaattttgttcagtttaaaaggggaaggcactcttaaaagagtcctgaattttcgctcccatcctgccagtacattgtctttttgaccaaggaaaaagaaagagctctaacaaaaatataaggcgagggagtaaaagaaagacatccataccctgatggaaattcttttgttttgctttgctttgctttgaggatctcatcatgtatccctgactgggttagaacttcctatgtagagaaatctgggaccaaactcacagagatctgcctgcctctgcttcctgtaaattattttatttatccctactgtccagagaagtcagaagagagattggacaccccccccctcacataactggagttacagacagttgtgagccgccatatgggtgctgtgaattgaaccctggtcctctgttttatgtatacagtcttctgcctgcatgccagcagagggcaccagatttcattcaaggtggttgtgagccaccatgtggttgcctggaattgaactcaggacctctggaagaacactcagtgctcctaacctctgagccatctctccagctctgcagccattgttcttaactactgagccatctctctagcccctggtataaattcttgagtagtaggttagatccaagtaaagttaaagtttatgtaaaggttttttctaagagcagaaggcaaagagagatgacccctgggctcacagtgtgtataagaaccctggtttgggtgcacatttgtatttctgtgctatgtgagtgatggatgtagctttggctgtagggttcctgatagaatgttataaaaacagtgtttactaggtggcactaactgactaaacacagagttcagtgctcatttatttttgaaggcacatggcatggcttttgttttggtccatgtcatctttctttaggactctgaaccgctcagtcgctaagaaccagacacccgtgagtggccagtgactgagttcaagaattcagtcagcactgggcagtagccttcaaactgccatggagtacaattagtttcaaggctgatggagtctagagatgaagtacgttgatctctccaatttatcaatggagtctgtgcccatttttactcagtgatctttgagtaaaatcttagctggtatgagcacttcaaagattcaacttcccaatccttgcttgagtttatctggttaattgctgctgctgcctctaactcaaaatgtgtaatttcctaggaaagtccttaatgtcctcaaagggtgacagaagaacagaagattcaagtattatttcttttctttcacttttaaaaaggatataaaacattttaaagtgtgtgtgtgtgtgtgtgtgtgtgtgtgtgtgtgtgtgtgtacagtgtgcacatgtgagcacagaagagcgcatgggatcccctggaggcagagttataggcagttgagagccaatccacctagccatgccacgtgccttcaaaaataaatgagcactgaactctgtgtacctaacttgggtcctttgtaagaataagatgtgtttttaacctctgggccatctctctagccccttaggtattatttctatgaaggaattaattgtggctcaaaagaagtaaatgcaaatgataatgtgagaaactccactgaaaagatggaagtgggtaaccgtttaattaagggaatccatcttcagcaacatgtccttgcttattcacaaaggtaccatcaggtcctatactagcggtgcggatggagttctacaagagagggaatgacattgaaacatgtcaggggtgctggggcagatggccttcgatactctgtgactcaaattctaatcagaagacagcaagtctcccccactgtgtctctttacatttatggagtttctatagatcaagttacgttgtaaaatatacaaaacaatggctacaaaacagagaaataccagctggggccaaaagtgtattctaatgaccagatgaccatctacatagcagccacccactctgcctcagccttatattgtctgtgaactcattgaaaaatgaagcaagctggagaaggaagttctgagaaagacatcaatagaatcaaaaaccagactttgtgcaagagtgcgggagcggaagttatgtgggttatgaagagttgttacagaaaccacttccaatgcaaatggcatggccaagttcattcagttatcaaatgctgccgtcttcatgccacatattgggctggccagactacaaaataaaaaatgaactctactatggatcctatgaacaggctcctggagtgtagaagaatgttggggccgtccttttttttttttttttcctcagatttttttctaaatttgaattagaaataagattgttttacatgacaatcccagttcccttctccctcccatcctcccctaccacccccccccaactaaaaccctacatatcacatatcctttctgctccccctggatggtgaggccttccatggggagtcatcagagtctatgatatcctttgggatagggcctaggcccacccccatgtgtcttggctcagggagtattcctctatgtggaatgggctcccaaagtccaaaactatgctagggataagtattgaactactacaggaggtcccatagatttccaaggtttcctcactgaaacccatgttcctggggtctggatcagtcccatgctggtatctcagctatcagtctggggagcaagagctccccaatgtttaggtcagctgtttctgtgggtttcaccagcctggtctggacccctttgatcttcactcatcctttgagtgaaggacagtatatctttttgcagtgcctttttctctccatctccaggggcacacaaatagtttgacagccttgttgtaagcaaatggcttgcgctatcctctttcattatcaggggagggcatataaagtaacctctcctctgttgcttaggttgttagctgctgtcatctttgtagatctccagtcattttcctagtgtctgatttctctataaacctaaaatgtttccctctattatggtatctccattcttgttatcttctattcttcccctgactccacgtttctgctccctcatgtcctcctcacccctcctcttctccccttctcattctcctagctccctcccccctcttcctgtgctcccaatttgctcaggagatattgaccctttcctcttctctaggggaccatgtatgtacctcttagggtcctccttgttcactagcttttctggcagtgtggattgtaggctggtcatcctttactctatgtctaaaatccacatatgagtgagtaataccatatttatctttttatgattgggttacctcgctcagaatggtttcttctagttccatccattttcctgcaaatttcaagattccattgtttttttccactgagtagtactccattgtgtaaatgtaccacattttctctatccattctttggttgaggggcatctaggctgcttccagtttctggctattacaaatagtgctgttatgaacatggttgaacagatgtccttgttgtatgaatgtgcttcttttgggtatatgcctaagagtggaattgctggatcttgtggtagactcattcccattttcttgaggagtcgccatactgatttccaaagtggctgtacaagttggcactcccaccagcagtggagaagtgttcccctttatccacatcctctccagcataaactgtcattggtgtttttgattttggccattctggcaggagtaagatggtatctcagagttgttttgatttgcatttccctgatggctaaggatgttgaacactttcttatgtgtctttcagccattttagattcctgtgttgagaattgtctatttagttctgtaccccacttttaaattggattgtttggtgttttggagactagcttcttgagttctttgtatattttggagaccattcctctgtcagatgtggggttggtgaatatcttttcccagtctgtaggctgctgttttgtcttgctgatggtgccctttcccttcagaagcgtctcagtttcaggaggtcccatttatcaattgctgttctcactgtctatgctactggtgtaatgttcaggaagcagtttcctgtaccaattaattcaagggtatttcccactttgtcttgtaataggttcagtgtggctgggtttatgttgagatctttgatccattttgacttaagtttgtgcatggcaataggctcaggtctatctgcagtcttctacatgtcctcatccagttatgccagcaccatttgttgaagatggttcctatgttccatcatataaatttggattgtttgtcaaaaataaggtattcataggtgtgtgggttaatatcagggctttcacatctattccattgttttaggtttctatttttgtgccaataccaagctggatgatagctctgtaatagagcttgaagtcagagatagtgatgcctccagaagttcctctattgtacagggttgttttggctatcctgggtcttttgtttcttcatatatagttgagaattgttcttccaaggtctgcgaagaattgtgttgggattttgatggagattgcattgaatctgtagattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggtttttcgagacagggttcctctgtggctgtggaggctgtcctggaactagctcttgtagaccaggctggcctcgaactcacagagatccgcctacctctgcttccagaaaaatatgctgggattaatggcgtgcgccaccaacgcccagcttttttctttttctttctttctttttttttttttgagattcaaaattcttaaagtacaggtctttcacttttttggtcagtgttaccccaaggtattttatgttgtttgtggcaattgtaaagggtgatgtttctctgacttctttcttcaccagtgtgtcatcagtatatagtagggctacctatttttttgagttaatcttgtatcctgccactttgctgaaagtgtttatcagctgtaggagttccctggtagcattttttgggccactgatgtagactatcatatcatctgcaaatagtgagagtttgacttcttcctttccgatttgtattcccttgatctccttttgttgtcttattgctctagctagaacttcaaggacagtattgaaattttgtcaaaggctttttcggcatctagtgagatgatcatgtggttttttttcccctcagtctgtgtatatggtggatgacattgatggattttcttatgttgaaccatccctgggatgaagcctacttgatcgtggtggatgatttctccgatgtgttcttggattctatttgccagtattttattgagaatttttgcatcaatgttcatgagggatattggtctgtagttctctttcttagttgtgtctttgtgtggcttgggtatcaaggttatggaagcctcataaaaagcgtttggcaatgacccttctgcttctagtgtgtggaatgctttacggagaattggtattagctgtttcttgaatttctggtagaattctgcactgaagccttcttgggctttttttttttttttttggttgggaaacatctgatgactgcttctatttcattaggggtaataggtctatttaagttgcttatctgttcttgatttaattttggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtttattctctgctgtttggtaagtttggataaaggtttgtctatcttgttgattttctcaaagaaccaacttgttatattgattctttgtattgttctcctagtttccattttattgatttcagccctcaatttgattatttcctggcgtctgctcctctggggtgtattggcttctttgttttttaaagctttcagctgtgctgttaattctctagtgtgattattcttctgtttcttcatgtgggcacttagcactatgaactttcctcttagcactactttcaaagtgtcccctaggtttgggtatgttgtgtccgaattctcattgaattctaggaaatctttaatttctttttttatttcttcctcaatccaggaattgtgcaattgggtgttacttaatttccatgagtttgtagtttttctgtagttcatgttgttgttgaattctaattttaaagcatggtggtctgataagacacagggggttacttcaattttttgtacttgttgaggtttgctatgttgccaagtttgtggttgattttacagaacgttccatgtggtgctgagaagtaggtaaattgttttgtatttggatgacatgttctatagatatctgttaagtccaattgtgccataacttctattagttcctttgtttctttgttaagtttcaatctgatgttcctgtccagtggtgagagtggggtgttgaaatctcccactataagtgtgtgcagttttatgtgtgagttgagttttagtaatgtttcttttacaaacatggatgcctttgtatttggggcataaatgttcagaattgagacttcatcctgatggatttctcctgtgatgagtaggaaatgaccttcttcatctcttttgattgattttagtttaaagtccaatttgttggatattaggatattacccctgcttgtttcttggatccatttgattggaaaatctttccccaacctttaattcttaggtaccatctgtttttgaggtggaggtgagtttcttgtaagaagcagaaggaaggattctgtcttcttatccattnnnnnnnnnnnnnnnnnnnnngctttgctgggtatagtagtctaggctggcatccatggtctcttagtgtaggtagaatatctatccaggaccttctggctttcagagtttacatggaaaagtcagatgtaattctgataggtttgccattataagttacttgaccttttttctttgctactcttaatattttctctttattctgcatgtttggcgttttgattattatgtggtgaggagaccttttttttttttttggttgagtctatttggtgttcttaggcttcttgtattttcattggcatgtctttctttaggttgggaaagttttcttctatgatcttgttgaatatattttctgtgcctttgagttgggtttcttcaccttcttctatacctagtattcttaggtttggtcttttcatggtatcccatatttcctggatattttttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgtttccttgagagatttgttgatattttgcattttttgttttgttttttctttccttttttcattcctttaagggattttctcatgtcctctatcattttcatgaagatgtttttaaggtcattctcttctgcttcatctgcattgtgatgttcaagtcttgctggtgtatggttcctagtctccagtgatgtcatattgggttttctgttgttggatgtgcttttacattgacctcttctcatcctttcttctggtgggtgtaccaggagtctctttctctcctggtgggtatgggaccaaagttcccttctggtagatgcaaacagttccaatactctgatgtctgtcctcttgttgtggattgaggtggcactgttacaggggccttggcagtgtctgggtgtgttagatcccactgctgagttcggatccagtcagcagacccctggagtcaggcacctctgagcagggtcgctgaaccggaactggaaaccacccctggcccacccgcccattggatggaggcggaactgtcactgcggccttggcagtgtccatgtgtgttggatcctgccgcggagctcggggagcaaacccctggcgtcaggtgcctccgatggggccgtcctttgatgctgatgactgagaactcttcctgacttttcagccccagcctgttttgttcgcacttaaaaaacaacactgttttcattattatctgatcatttctgggagaaaatatgaagtggttacttaatgtgcttgaatggctagctctaattcaacacaacaccctccctgtcaatatcccttcccctcccgaagcacagttcagacaccaggaaggatgagatcacatcacacaattattttgtaacttaccactaataatttattaattaaaagagtaatcaaaagcagattggctggctaataaaagccattctggttttcatttaatgaaaagtggggaggagaagatggtcaagagattgggcagtggtagactatatatagaaacacagacacacacagaggcaggttggaccagggaagggtaaggttgttgtatattaccattcctatggtaaggtggctggaggccattcttaacacatgtccttctgtgaattatggaacttcttcatttgacccaaggatatacttaatataggtatatggataggtactatgcatatgtgtggctgatgtttgtacttgtatgtacatatgcagatgctcacatatttcttctgcagatatgtgtatataacggtgcatatgcagaaatgcatgtggaggccaaggattgacgtcagatgccttcttccattactcaccttgcaaattgaggcagggtctcctgctgaacctggagctcaccaatagtaagctaggcagactagatggctctggggattccttgtggagggattacaggctggtcaccatgcttgcctggcctccacatgggttccagggatccagactctggtcctcataacttgcaaggcaagcactttaccaagtaagccatctccagctccatttaacagtgataatagcatgcatgcggatctactgtcatgtcccaccaggctccacatttttaactttcttttttcctttcctttttagtgatttctggaaaacactccagtagcagtccccaccttccggatatttctcttcccttgaaatcttcccttttgtctcacatcaggctgacactgcttctcaggaggagggttcccattagctattgcttagttcatcttttttcttcaccactgagcactcctctttgtgtactgactcactttggggaaagcagaacatctttcttagaaaaatgagtcctaggcttaggaagatgtatttccgagaaagagagaatctacaagcattagtgctcaggttcccaaaccataagtttttatctttggttctcatttgatttttctatctttatttgtgcaacaaggatgcatttcctatcattacataggaaaatgggtgttaggcatggttagaaccttctctttcatcttagaacagaaaatacatttaattgttattactattgcatctttaatgattattaaacactaattgcttccttgaagttatcttcattgacttaagatctggtgtgcctctgccttccaaggtaaggtgagccagggtgaggctggcgcttggctcctcttcttacccttggcgaacatcatttgaaaacattcactattaaattttcaggaagggggctgtaaagacagctcagtggttacgagtacatactgttcttggagaggacccaagtttagttctcagcacctatgtcaagtggttcatatttgcctgtgactccagctcaaggggttcctacacttcttgtctccacaggcacttgtacacacacacacacatacacacacacacacacacacacacacacacacacacacacacacacagataaatatatattttaactagggtggattgagcctcagctaaggtttcagtgtagccagaagttctcctgagagcagattctcaaaatccaggcagcttgcacatctgtttaactcaagaatttccttcaccatcttagaccttccagtatcactccttcaaaaacaacttgagatcctctctcactgggtcctccctgctcctcattgggaatgatgtcaagatgaagagaaaacaagacacagcaacagtcttgcttagctaagaaagtccatcactgtccactgctactcaaatcagatcttacaagagcaagggtctcaaggggctaaagaattcttgagaaactccctttaccagagcatgcgactaagaaccagcactcattaataggatccctacactttctcagactcagcaatcacaagagagcttgtggtctactgtacagcactgcattattgtccaacaaatcaatttcttttttcatggaaggttctttagttggcctgcctttgcccttcccccatgagggaccgagttcaggagtagatatgcagcgtgtgtgtgtgtgtgtgtgtgtgtgtgtgtgtgtgtgtgtgtgtgtgtacacgcgcgcacgcgcacccaggacacagtcttgttcccaccctacattgtttgttgaaataaatatggaaatcaggctgagcaagccagccaagccagccaaactgaaataaattcatcactcatggattctcaagggagggcaatggtgcatttttttctaaatgattatttctgaagcactgaaggaatggctatatcactaatgaggcctgtacgccatgactgctgattataaatgacccgcaaagagacaaggagatggtgggtatggagacacacatgggaggagtggaggaagcaactgtaagtggaggctgctgccaccggggccaagccaaggagatgcacccagaatgcactctctgttttcctaatcccaatcaccactccagaacagcatgtgactgattctgtgtgaattcaggtgaatggaaagttttcaaatgcctctcaagatagcaaagcagctcatggttatgttctcaaggtaccatcggctgcttctgtctgtgcatagaagttcttagcagtaaagacgatctgcagaagatctaatggggactcaagggacacaaaccataagatgacactaagtggtggctgtttccccactagggactgtctcttgatagctgtgaactgggaatatagggcatgaaggtgtggaaagaaagtctgttctggcaccagataggaagtgtccacagggcagatggtgacatccaggccaggcagacgacaatggactcacaaactaggaatgtcaatgcttggtctgagaaagccctgagtgatctcaacaaaactctgagctttgtgactcagcggcagtattatcatggcatgggtgatttaaagccaaagcatctcttagcatgatctggcaagatgttctcagccagtagaaaagatccaccaagggctgaagaaatggctcagcagctaaggtgcttgctgcacagtcatgaggatctgagttcaaatccccagaacgcatgtaaagagtcgggtgtctcagtaacaagcatctgtatttccagagcttctatgatgaggtgggaggtagagacaagagaaagcttaagtccagctagtctggcatatgcaacagtgaacaagagacccccatctcaaacaaagtggaagatgaagactgacacccaaggttgttctctcattgctacatgtgtgctgtggcatgtccatgctgcatagctgcacacacacacgcacacacacacacacacacacactgcattgaggccttgaatggctacttttgacaaacaacatggcctagttcttgagagcataagaaccacaaaatatatgctttctgttgctgttgttgtttgacatggttctgctatgtagcccagtctagtgtggtatcccttatgtagtccaacatgatttgtgatgatttttctacccctgcctctcaaatgtatctgtgagcttttaaataagaaaagtgcaatttaaaatgagtgcatcacttattccaattgcttaccctaatggtgacacccttacagaaagtacaggtggaagaaaagaaccttctccgacctgtcatgctgggacactgaggcaaggcgtgagatatatatcagagactgtgatggatccagacctcctgagcttatagaagatgtttgctctgtttgcccagttcgtgccttcctgtaacatccaaataagattccagaaatagcttttcatatgtcccatgcatacttcagcatgcacatccgtacacgcagagtcacccgccactcacagactaagagggaagcctgcacatcagctctttctgcaaaatacccaagctgttctaggatacctgcaaccagtcacggtgatcttaaaatgagccaaggattctggctgagcaccttcaatttcctaaataacaacactagacacaacacgaggcttcaagcatgatggaggaaagtgtgttcaccaaatttgttaagacagtcttcataaaacagggaggagggaggaggagacagaggactaattataaacttgcactcagtttacttctgcttctcagcctggctgccattgcaagaaagacacgtgctgtgttagcgccctccctgcagccctccaggcaacaaagagccacatggcagcttggagaaaagcaacaaacagcaggccctagccttcttattcttcatcactggggtgaatgctatgctccgatctgtctttctctctcatcttctccacctagggtcaaagaacaaacagggctctccaataatctaacaaagaaaagaatcaaaagtcacccaacccaagatgcaagctctgagccttgctgcttccagagaggggcagagagggggcagaatgattcccaccagatgctgcctcactcctgtgcagtgttctctaatgactcttaccccggctgtcattcttaaagggtgcagcagcatgctagtgtaaacagctaaacccagtgtcatgtcaagtggtaacaaggccactgctggttgtttatttatttatttatttatttatttatttatttttacaagcaccatgcacttagcagataaaaacgagcatcctatcgctggcttccacaagtcacacttatcaaccgtgaaaaaaaaataaaacaatgcttttgtttgacaggtgttgctcggtgcccgtggtaggaagttcatttttttttcccaggctgcccattagcatcatgaaaaggcgagtaacagctgcattcacagggtctttctgcatgtgtccactggtgagcacagcagagcatcctgatgtcccctccaataaagagaactaattaccctccaccgtaccacctgggcttgagacaagctgtgtcaggaaagggctttgacaaacacatttatttgtccaggaccaaggccagggccagcaaccgccattcttcctgatatcagaagggagccagatgcacacaggatcaataaaaggttcagagttcactgagggctcagggcagtacctgcagacaaggcatctcctgggagacaggacatgggcttccaacatggaggcagtggtgacgcaatgcaagtctgcatagagagtagcctggcgtgtacaccaggatgctgtactggttgaagttcttttcaaagaaagctgaaatatttgaaagttgtcaaagagaagtgggtgttgaagagggaaaaatgttgttttctttatgctaaagtagttgatttatagaataatggtgagtggcatgctgatgaacatgtgttgacatgagtatggttgttttatacacagggaaactgcacgtgagtgaggtgaacaaatgtatcacatacaaaaaaaggcagagaactcaagtttcctaaatagccccccccatgcattttcctaggaaggagatagatacacacacacacacacacacacacacacacacacacacacagagagagagagagagagagagagagagagagagagagagagcttaaaaagactcatgaactcaaaggaccaggatccttctgacttcagtgctcatctgattctaacctgctcaatgccacaggatttagtgactaaggtgaccaaagtggctttcttcagctgctgggcatgtaggaagctcttaggaaccctatgttccaggcccatttgtgaagtttcaatgtggcaaacaagcgagtctctgtctattagttgcaattctccctttaattttctttccctctgaagggaaggtaggaaggattaaaccttcaattactgataactgcccccatcccaagctctgtgtatacctatttgacagtgcagctttgattattgcctagtccctccctgcccaatgccttagcctactgtccagctcagtcagcaacagaaagaacattccatcagtcttctgccaaagatgagtatgcaattaggacatgtttcctctctggggatataggctcacatttaacaactcacctgggctgctgagatggcccagtttgcaaaatgcttgccacacaaggacaaggactcaagttcaaccccagcattcacataaagacaaacaaatcaaaaacaggcccagtggcacttcttagtattggaggatctccggagcccactggccagtcagactagtcaaaatggtgacctgtgagatactctattggaaaaaacgaggtcgacatctcccgaggaatgacacctggatttgacctttgacctccataagcttgtgcacacacagaattcaccacacaataattttactcaccataaaattcaattcaagaattatgaactaaaatgccaaattatacagccatcagctcctaattatccatgcatctgaacaatgcaaaaataagacctcaaacccgattaaaattcaggataatttcatccagcccattttgtaatcttctcagctcacaagtcatttgttggaagtttatagactacctattcacagagacagctaattatacgcagttaaagcaagtcctagaagtcagttctaagctgaggcaccttcactcttttgagacttgtcgtgaactagttactagtaacaggcaaattattactgccctgcttggccggtcctgtccacatctgtagtccagcttaggcttcaaaacaatgggcatcacttcatctcctgaactttctcgactggggcttgatgaagtgatgtcctgtgggtggcatcacagccatggagaaaaacaccacccaccaaagggaaaagctttgcccacgggacccctgggaggagccatttcctcttctggtgttccgcactgacatttttaaattataatgactccatatcccaaatgagtactaagaacattctgaatcagctaattaataaatcaattgctcttcaggatggcatttatcaaattcacaactaatatgagagatgagattagagtggaagacggcagctgctcttccactgcttctagtaggaccatgcttgagttctagcagggcccacaaccttagccctacgatgtctacatgcaaagcatgtccatgctacctggggtccaagttcagtgtcagagccattttatgaaataacaaatagctgttgaggtctgatgaacagtggtgttcctcttaaccagatcctgagcatccatggagtagtatatgctgagacagcctcatggaggagccaaactaggcaccgatacctagacattggcggttctcacatggtttttaccctgttcatacagcacagagatggcacataagtgccaaggtagacatggagcatgctggtgaattcttcatgcccttaacacctggttcttcttttctaaccttcagaattgctgtcaacacgttcttggtgtgtgtgcatggtgtttttgcgtgggtgcatgtgttcacgagactgtgtaggcacagaaaaccttaacttgggtgttattccttaggtgctgcccaccttttcttttttttttttcttcacttccactgcaccaccctctcccagatacagtctttcattgacctggaattcaacatgtaggtgggtttggctagcaggccagtcagtcccaaggacttgtgtatctctgcaccggtataacaagtatgtgtcacatgcctgccattttttttaaaggtgattctgaggcttacatgcaagtccttgtacagtcaagcattttaccaactgagcccagtgtgcactgctcttaactgtctacatagtgactccttctcagacaaaacatcacaaccacatgtcgttagggggctggtattgacagtgtgggctagacaaaggaatagtggcaaaatcccaaatgcgttattcatcaataatggaatgacatagaactagactagaaggggagagagagagaaagagagagagagagagagagagagagagagagagagagagagaggtccactgcttggagaccaatgggctaagcaaaggctcattattggttgaggcctagtctgcctcacactgatcacccccactccttctttatatcatcagtacgtttttctcctggaggagactttttgccttgtggagagagataatgggccttgactttgcagtcaaatagttactcaagcctaatggctctgcaaattacttagacagaatctaatctggagtgtagatatcgagggtataatgtgtgtgtggggaatcagaaacggcacattgtcctacagagtgggcataccaaaggactcgagaagagaggatggtgacagagggagacagaaccaggtacgtgactgtactagagtacagagtgggtgtcccagcgctgtgatggaaacaatgtgaaaagagagccagaagtccaccaatgcaagtggctgagggatgagcatcacaaatgtgtggccagcttgggatacatataagaccctcaaaaaaaggtagggacaatggaaagatagttcagttggcaaaatgcttaccatgcaggcgtaacacctatacacataaaaacaaatgtttaaaaataaaaataaagtaggacctagagaggtgtcctagtgcataagagtacttgctgagtaagaaggaggacctacgttgggaggacagcgctcatgtaaaaggctgggtgtgtcctcacgagcctgtagcctatgggctgtgtggagaccagatgggagaatctttggggcttgttggtcaccagctcagctccagtttagtgagaaattctgtggagaatgatagagcaggacacaatgctcttctctggctctacatatgtacacctgcacactcatgcgcacacatccctcccaacacacacacacacacacacacacacacacacacacacaaacacaccacacacacacacacacacacacacacacacacacacacacacgaatgaaaacaaaggaagcaatttttacccaaagtcagggtgtctgaatcaggccacatttacagagacactcagaagtcaagggtagaaaagtttagtgcaaagaaatcatatttatccactctcctcacgactgtttagagatcttataacagacactatctggagttaggctggctggagaccaaggtgaagcaggaagctacttggcatgagtcattacccattcattgttgtggattttaaccaggctcttctcacagcattttctaggactggatttcttgtttgtttgtttggagacaaggagaggtgtgtgtgtgtgtgtgtgtaacattggctgttctggaactcactcaggctaatctagaactcagagatctacctgcctctgtttcccgagtgcctggattaaaggtgtgtgccaccatggcctggctagggctagattttgtatttcttcttctgtaaaatctatggtgggtggcagataatagttttgcaaataacctcatctccttatgcttcacattatgctaattctgagatacaaactgaataaatacacaggtcatttccaaaatgatttttatttgcttgacagattgaatctgtgcacttgtaaaagtacagttggttaagtaaatcttgaggcagaggcaggtttagcagggcagtgttgctctttaaccccttcatctagaaggcattttttagggtgtgaggaaaccccaacatctctatcaacagagatgtcacagagctcaaaatgctccaagcactttctcacagttatttagaagacttgacagtgacgaaaagttggggagctggagtgtgtttccctccattctaaagatgactatttgtgcaagcctgcttgatcatttgatgctttaatttccctacctacatgttgccaggaaccttgccaacaacatcagggactgtaataagccagggcaacacggtatttttagtttatctgccaaactctcaccaaactaagattttatttttttggttgggagactcttgatgactgctcctatttcatttggggttataggtctgtttaaattgcttatctgtttttgatttaatttttgtaactgataactatccagaaaattgtccatttcctttagattattgaattttgtggagtacacgttttcaaagaatgacctgacgattctctggatttcctcagtgtccgttgttatgtcccccttttcatttctgattttgttaatttgcatgttcactcactctctgccttttggttagtttggataaaggtttgtctatcttgttgattttgtcgaagaaccaactccttgttacgttgattctttgtattgttttcttagtttgtactttattgatttcagctcacaatttgattatttcctggcatctactcctccggggtgagtttgcttccttttgttctagagctttcagttgtgctgctaattctctagtgtgactattctttagtttcttcatgtggacatttagtgctatgaactttcctcttggcactgctttcaaagtgtcccataagtttgagtatgttgtgtcttcactttcattgaattctaggaagtctttaatttcttccttgacccaggaatgttgcaattatgcactgttcaatttccatgagtttgtagggtttctgcaatttgtcttgttgttgaattctaactttaaagcatggtgatctgataagatatagggggttagtccaatttttttttgtacccattgaggtttgctatgttgctgaatatgtggtcgattttagagaaagttccatgtggcactgagaagtatattcttttgtgtttggatggaatgcccagggccagatagtttcagtgcagaattctatcagaaatccaaagaagagctaataccaatactccttaaattgttccacacaatagaagcagaaggttctatttttacagggctacaattacccaggtacccaagccacacatagacacaactaggacagagaactacagactaatatccctcatgaacattgatgtaaaatgatgtaaaaatactcaataaaatactggcaaattgaatccaagaagacatccaagaaatcatccaccatgatcaagtaggcttcagcccagggaagcagggatggttcaacacatgaaaatccatcaaagtaatccaccatataaacaaactgaaaaagaaaaaccacatgatcatctcgatagatgctgaaaaagcctttgacaaaatccaacatcccttcacgataaaggtcttggagacatcagggataacaggaacatacctaaacataataaaagcgatatataggaaaccaacagtcaacatcaaactaaatgcagagaaacttaatgtgattcctctaaaatcaggaacaagataaggctgttcactctcttcatatctcttcaatattgtagttgaagttctagcttgagcaacaagacaacaaaaggagatcaaggggatacaaattggaaaggaagaagtcaagctttcactgtttgcagatatgatagtttatgtaaaaactctaccagggagctcctacagatgataaacaccttcagcaaagtggcaggatacaagattaactaaaaaaaaaaaaaatcagtagccctactatatacagacaataaatgggcttaaaacaaaaatcagagaaacatcaccctttaaaatagccacaaacaacataaaatatcttggagaatgataactgaacaagttaaagacctgtataacaagaactttgagtcttcacagaaagaaattaaagaaggtaccagaaactggaaagatctcccatgctcttggataggtaggatcaacatagtaaaaacggcaatcttgccaaaagcaatctacagattcaatgcgattcccatcaaaatcccacacaattcttcacataccttgaaagaataatactcaactttatatggaaaaacaaaagacccagactagccaaaaacccaggatagccaaaaatccctgtacaataaaggaacttctggaggcatcacaatccctgacttcaaactctattacagagctatagtcttgaaaacagcttggtattggcacaaaagtagacaggtagaccaatggaatagagttgaaaaaccctgatattaacccacacactttcaaacacctgatttttgacaaaaaagctaaaattaaacaatggaaaaaagaaaccatcttcaacaaatggtgctggcataactggatgctgtcatgtagaagactgcagatagatccatatctgtcaccatgcacaaaatttaagtcaaaatggatcaaagacctcaacataaatccagccaccctgaacctcttagaagagaaaatgagaagtacccttgaacaaattggaacaggagactgcttcctgaacataacaccagtagcacagacactgagattgacaattagtaaatgggacattctgaaactgagaagcttttataaggcaaaggacatagtcaacaagacaaaatagcagtccacagaatgggaaaagatattcaccaatctcacatctgacagagggctgatcatcaaaatatacaatgaactcaggaagctagccaccaaaacacaaaacaatgaaattaaaagttggagtgcagaactaaatagagaattctcaacagaggaatccaaaatggctcaaagacacttgagaaagtgctcaacatccttagctttcccttagccatcagggaaatgcaaatcaaaacaactctgagataccatcttactcctgtcagaatggctaaaatcaaaaacaccaatgacagtttttgctggagaggatgtagagaaaggggaacactcctccactgctggtgggatgtcccgcgtgattgtctcgccagcaagaacaacacaggacattcagatccttttgcagtaaagcttttatgcgtcttgagagagagagcataagcttacagagcggagaccccgagccaagaatcccgtcccctaataaaggctggcaaccgctgccttggacgtgtcaccccatgattggctgcagctcatcggaccatatgacgccatggaaggggcagagatcaaggaatggaaagttacccagcgcctgtgcaataacttgtttacattcggtgcctgccggatgcaggcgccatcttgtaatggagaatgcagggacggctccctacagtgggagtgcaaactcgtacagccactttggaaatcagtatggcggttccacaggaaaatgggaatgagtctaccacaagatccagcaattccaaagcagggtgttggtggtgcacacctttaatcccagcactcaggaggcagaggcaggcgatctctatgagtttgaggccagcctggtttaccgagcgagttccaggataggttccaaaacaatacagagaaaccctgtcttgaaaaaacaaaacaacaacaacaaaaaaaatccagcaattccactcttaggtataagccccaaagatgcacattcgtacaacaaggacatccgttcaactatgttcatagcagcattatttgtaatagccagaacttggaagcaatctagatgcccctaaactgaagaatggaccaagaaaatgtggttcagttacacaatggagtagtactcagtggggaaaaaaacaatggaatcttgaaattcacaggcatatggatggaactagaagaaaccatcctgagtgattacttcactcagtcacaaaaagacaaacatggtatgtactcactcatatatggattttagacatagggcaaaggattatcagcctacaatccacactgccagagaagctagtaaacaaggaagaccctaagagagacatacatggtcccccggagaaagggaaagggaaaagatctcctgagcaaattgggagcatggagggaggggagaggaagttaggagaaagagaaggggagaagaggaggggagaagaaggtatgagggagcaggaagattgagtcaggggaagaatagaggagagcaagaaaagagattacataataagtttaaagagaaatctggcactagggaaatgtccagagatctacaaggatgactccaactaacaatctaagtaacagtgaagaggctaccttaaatgctcttccccaataatgagattgatgactaccttatatgccatccaagagccttcatccagtagctgatggaagcagaagcagatacacacacctaaaaacactgagctgaactctggaatccagctgcagagagggaggagtgatgagcaaagggatcaagaccaggctggagaaacccacagcaacagctggcctgaacaaggggttgctcacagaccccatactgatatctgggaaatcagcataggaccaacccagacccccacccccaaatgtgggtgtcagttaggaggcctgggcaatctatggggcctctggcagtggatcagtatttatcttcagtataggaatggactttgccagcccatttcacatagagggatactctctcagcctagatacacagagggagggcctaggccctgctccagatgatgtgacagactttgtaatccaccatagaaggcctcaccctccctggggagcagaaagagtatgggacaggggaggaggggagggagggggacctgggattgacatgtaaaacaagcttgtttctaatttaaattaaaaagaaggaaaaaaagatttcattttttctttttaattatttattttgtctgtaagggagttgaaggaagaaatgatctactaggaatagatttaaatagtatttcccatttaaacatgtattttaaaaagaggcactgggttctatgacgtttggtagcaaatggagtttctccctgcagcctttgtgatttcatttgtgtgtgcctgtaggcaagcaagcagaggcagagcaggatggcaggtgtttctctctagagcggaccctattattgccttgagatgggatcttttagaggactgaaagcttggctttctggccaggctggctgtccagtaagtgctggggaatctacctatcttccctcttcccccaagcattggggctccaggcatgcacagccatgtacagtcttttatgtgggagtcagggattccaattcaggtcctactctcaccctctgagtcatctcttcagccccaattcgtctgaaaaacatagccgcctgcatctttgtttctggcctcctccatacctgaaaatacttactgctcactgttatcgagagatcctgtaatctagaaaatcaagatgattcattctgacattttggggaaaaccctggatgggttttccatgccccactcagctctttgataagtatagtggctggggggtagggacaccgaagtggtataatgagactggatggctctgctctttttcacatcgttccaggagattttcacagttcacactgaggattttctgaatctatgaaaaggcaggccagagacagaataatgggattgagctgtttctgacttgcaaatggtacacactacaccactccaagaatcctgccccctcccttcctctttcctccatcatttagggtgtgtgaaattgcaacattaaagaaacacgcatgctgttcttcccttctgggtcagtatgggctgctgctagttgtggcaaaagtgaagagtggggcacagagggcagggtttctaggcaagttcactcgttgattcagtctactgcgtaaatcatgaaagcagtttgcagtgggttctacaacagtcccaggtgcaaatttcacatgcatttccaggtcacagggagctatctccggaacaggattttgagtctacataccaagccttttaactgtgatttagggagctggaaacagattaagacacagtgcagtggctggaagatgactgcatgggcgaacacaacaattaaacacaggagtagccttcaaagatgcttctagccatgtcctgctactgatgaccaaactcacagtaatggagggatacagtcttagtgactgggactgtctatgatgcttccattgctgtgagacatttggctgaaaagctaagctaagttcttcttggaggaatgagtaactaggcagcaaggtctctcacaaagcaaggggcctcatcatctagcagcctgttggcatgggacttgagaaatggaattcagggtagtttgtttgtctatttgtttatttgataggatggttgatttgggcaggggagtatggtagcattttctaatcttatccatttgatctaatttcctcttaagcataaatgttagtaaattatatattgtaagtgaccctggggtgtgcaatcccttttcttttaatacacttttccattccgacaaggagcttcagtggcttggaataatcctcttcaattgacaaaggaagccccaatttctaagtttttaaaccattagtggctgatcagttgtaacaaatacggcaccactactgctgctgcacctaatgattgaattttaaatattcatgatggatggctgtctgtgtgtgcacacggaaatgacagcttcgacggctgcttctcaccagggcaccgttacagcacaggcagaagctgcatatgtcagatattttttttttctggctaaatattccagccattaaaaaaattattctatcatatagatacagcagcattagcgtgtgagatctatgcatctacacatacaacaatgcagaaatggaaaggacccattcttactgcctccctctgaaccccaaatggccttttaatgactgagagaaagcactgagcggaccagcaatcctggaagtggctactttggcgtactgtgattttcagtgatttaaattttcataattttacttatttgcattaaaaatcctctactaaacaacacattataataagataaaagttcattaaaaaatcccaagctaagcaaaatcacaatgtcataatcaaattctgacccaattgaaagattttgggaaattgtactcacaatttatagttattatggaaagatagtaagctgtatctaacttttagctctgaggctataagtgaggtttttatttttctttaagacaattagtttttggaagaattcaatagaggatatagtaattagaaaagggagatgtaaaatatgtgtatgttgcaaactatattatagcaaatgtatctttggttactatttgtggtccagattataaagaagtaagaaaaattacccaagtttcagactgagggggagcccctagtctcatttttcccttgtctttccttcttagcaattcctacggccccttcacagcctcctccagcaatgttcttctggatatttatatgaaacactgtggccagtgctgtttctagattgtatattcagaccatctgattttcaaatggattcatggttaacagtatatatggccatcctgaccacagaaaaggagttgtgaagaggggaagaacaacacagatatcgtagagagcaaaactacacacactaaaactgctctatctgtcgagctttcaagaccagtaattaagtggttaagaggaaaacagtataaattgcttgcctatgatcagttcctggggttccctgcagaaaaggattagggtaaaatacattgaaaggaaggttcagcctctataacatagatgtggaaaatcagacaagatctgaccccacagctgacccttaggtacactatgggtatgggctgggcttgtatcaagtgtttgttcaaggtaaaaaggagcaaagcaaagttgggaatgatgaagaaaaaaggagctccctggagaaaaaaacccaacaacttcaaaccttgaatgtgaaactttgtaatgctttgtaatgctgtggcgcctgcctactacacaagcccaaactactagtcaacccaaatgaaactgtcatttgttacattggctccatcttatcaaaagagcccttaatgctgcatttgtgtttcagagtatttcctggaaatgtcacatgaaattcagaagaatcatttttcctttaattgttaccatttccaataatatttgttcttgtttcataaaacacacatcccatgacttacatctgatttataagcaaattacattgatatggctaatcatctctttagtctgcttaatattttcacttgtctaatagcaaattttatttacattgcgtatgtccctcctcgactcaatttgtggctagctggttatgccatacctggaactagattaacacaaataaaatttaaaaaataaagtggtcttttatgaaatctaagctctatagaattctgtataaaagagttatatgaacatttaaatgatagcaaaatagtttcaagacaacttcaagtcattactgtcttagcatctggctaggctcactgtgtaattaaagcacccagatgtcctgacttgtcaaaagaatccttaatactgtagttgttctggtgaaccctttagttaaggaccccttacatcctcaaaggtgtcctggtttggatcatacatccaatgttttggccgtgactttctactagttcataagggctaagctgggtttccaacatgtagtactaagggactcctcaaccttccatgttttctttgcttcaaaacagactaatgacaatagagcttcaagtgtgtgtgggggggtagagagagagagagagagagagagagagagagagagagagaaacacagagagaaacagagagaaacacagagaatgctaaaggctaatgtcagatgtcatcagtttctctccaccttatttttgagacaggttttctctctgagcctggaacttactgattaagctagactgtctggctggtgagctttgttttctgccttcctcagtgctggggttacagacctgatccctggagtcaggatttgacgtgggtgctaggtatccaaactcacatgttgtgggatgttgtacactgtgggaagatatgttgctgtgattggtttaataaagagctgaacagccaatttctaggtaggaggtagaggtggaacttctgggcagagagagagaggaagtaggagatgaatctagatgcctgggagacactgaagaggtcacacacattgtacagagtaggcgtaactgagccacatgacagaatgtagattaatagatgcaggttaatttaagttataagagctagttggggacaagcctaagctaaaggccaagctttcataatcaacaagaagtctccgtgccattatttgggagctggctggcaggacagagaaagactcattacactcaagtttttatggctatgtggcactttagcaactgagccatctccccagtgcctgagagcatagcctgtgaggtgcatacaggcctctgttagaaatgaaggaagactattttgcaagataaagagagcactctaccaaagcatgaggtatgactggcctgatcattcagctttgattacaataaatgtcccaaacttatgctaaccctcatgttcttgtggtccagggaagggcacatggtgagagacaggatgctcccagagccctgccaggcctacagaatcaatgatgctaaatgacagattatacaaaacgatgtcttccatggtccatgtcaccatcagagacattttcatggacaagcccatgtagaagtctcactgtccaggagtagcaactgaagaggactaaaccagagtcctcaggtcaagaaatttgtgtctcaagggatcacagtgcaatgtcacttagaacaaatgcttttgagagatagaggcaactcttgtgctgcatgttggtggggacgtgggttacctggggggtttatctagatgacagctgtcacataagttattctggtaggacatcctgctgtgttgctggctctaacctaggtagggaatcatagacttaccctaggacatatggttgtggttctaaatctccatccacagccttctaacatttgctaagtcatctatgtgctctcgcccagaagaaagggaaatcaagcttacttaatcactaacccccatctacgttcaatttaaatcaatggatctgagctggaagctgtgcatctcaggggcctttaccactagagatgggcacactgagatgtctgaggtttccaaaagagctgcttgaggatgagcagggtgcagctggagcaggtgttatatattaagtgatcctgttctctttctatttgaatatgaacttcttcctatgctacatgctggtaggtaataaatctcaggacctgacacctctggaggtctgggcgaacgaagctacttcaagataaaaaatatttcaggcaaagagatgaaaggatgtcagaacaaaaagtttatcaatgtatatgttagagaaaagaaatctgtcccagcaaaatggcttcaggaatgttttacagtgagagtcatttccaaaaggcccctcttcattctctttcttttttacaacacacacaccaggcttatcagcctgggcacacatctgcagccatagcagccactcatccttccgtacgattacttgaagcaccagagatttaacaaagaaggaaaaataatcaaaacatgatgtttcttagcgctagaatgttgtgtttttgtggctgcctttgtaaagtgtgcttatgcacaggatcgtctctttgtcccactcttccacagtttctatcattcagagagactggctcaggttggtggagaaggaattactagttttaattttcatctggcagtaaaaatttttatgaggccataggaatacaaaataaactcataatgagaaaaataattataggtttcttcatataagatccttataaaaaatggttatatcccaaatgtaggctcaggaaactctgagtcacccagtagggctgtttacattatactccttctgagggcgtggccaggttctgtctctgccaggctgtttgctggggaactccagaggctcaggcctctttcagaatcagttcatgcaggcagcactgcccccaagcatctgcttggggcaaccccatgcctttctttacttccagataggagttcagtatatgtgtgatgagtggaaaaaagaagagcagacgaagcagccaaatgtattcggaacaaagtgtatgtgtgctgcaaactggaagcctgttggtctagttgcaggctatttattctgaaacagaaaggtgatgaaggctttggccacatgtgaagctcatactcaaatgggctaagagaggagtacaggagggaaggtgcaccctgatggtgaaaccatatctgtaaggatctgcgatgccggaagcctgggtggacctcagctctctcctccagcttagagtccttctgggagggctgagtgagcagggctgctcagtccatttccactgaggagaaagggaatgaatggcttctccctgatgggcatgtagtaaggttgactaaaagtcatctgcccaaatcctgtggagctgcaaagtgggtgagttggagtgagtgacacagaagccatgcaagggcctgcacctttcagaaagcaatcctccacttctacattctggggagaattagggtactctggcaccccatctcacccacccaaaggtagtaaatcaacaatcataacctttactattattgaggaatataatctgtaactcttaataaaccatatctgaacgatgttttataacattaacatacacttaagtcaacaacaaatctaacacacaaagatgaggaaaatcaacagctttctaagtgtggatgtagttctgaattttaaattctagcagggggaaaactgatgaaaaccaccaaaaggaaacagaaatacaacatcaaagggcagggttaatcagcataacaaagtactgtgatttaaacaatacaaaggacctgaagcaaacgggcactacaaacatcagtgacattaccacccaaaagaaagagggcagaaaggcagctttgcctctgcaactggctcactgagggcaagaggctgacagacatttaaaggagattcacgaagatgggcaggggagctgtgattccctgggctgtgggcatccagaaaagatgggggtctcagtttgtgctcatgacttccaacacctgcaaagccaggagacaggcaatgaaggaaggcttgcccctgcacatgatgggggtgttcctacccccatgaaaggtcctacccccatgagcctgaatggaacgacttctcataacagtctcttgctgggccaggcattggtggctcagaactttaatcccagcatttgagaggcagaggtaggtggatctctgtgagtttgaggctaggctggtctacagagcgagtgccaggacaggctccaaagctacacagaggaacctgttctttgaaaaacagaacaacaacaaaaaatagtctcgtgttggtaattaagaaatcaaaacagggctggggagatctcgggtcagctcaaacacaggaacctgagttctgatctgcagaatttatgtgaatagaaggtcaggtgtggtgttgcacccctgtaattccaaggcaggacagtggagatgaggtggacccttggtaactactgtccagccagcctggcaaattccaggcaaaagagactgtctcagacaaaatcatggtgaatagtgactgaggaagacatgtaaggctaacctctggcctcacacacatgaccacacaactgagcacacacacttgcagtctcataaacaggatcagtacacggatggcaagttttcttgctcattgtctcatctaatagtcagccccatgtgtcttcgcaattacagaattgccgagattgaacattaggggacatggaggccacgcatcaattcatcaagtggccatccagcctgtggacctctggtgacaaggtcctcatttcctcctgaacaggttgctaccacccctgagcagctgtgaatattagctcatccttcctgagacagagcccaaatttgtctttctgaaggatccacttttggcccctgggtagaaaataaatctaaaccatctccgatacgagaacctttcatattagaaaatgctattatgcactagcagagtctttgctacttcaggcaaaatacactcaattcctttaaccttccatcacgtgatcttaagtttttcaacttcaccagttactctcctctcagctcagtctggttcttacagctctttactaacagatggtaagggcctccctgtgaggcttactgtatgtttctacgaggctgaacatagtacctgcaacatttcctgcatgaatacaatgcacagcaccttgatacgctgatttcagtgctgagtctcacactgatgctggaacatttatttttggtcagttccaaattacaagtatgttttagatctgtttccccaccatcagtaaactgtattgattccattcagtctcatgtcatatccgactaataaatgtgcccttataactcaatacctgtaattcatacaaatatttgccaggatattactatggctgacttgcctggtgactcttgacgtttctgctgttgttgtaataccaaaggaaatgattgtgtttagtgaaattacaagatttaggtttaaaaaggcagttgttgtcagttggctgaatgctgaatgcatgaattgcacacaagcagtgtgtgcaatcaaaaccactgaaagaagtaccgtgctctgagatgtgaaggtctcaggtggcgcctgtgccgcccgccattttggggtcctgggaaaagagcctatgtagatgctctgcatggtgctcacatgtgctttcctcctttagcagatgctgctctgtgctccccacgtgtcagcaacactgaacatacacaggaagtaacacctgctagactggagaactaaccagtcatggagaaacccagaaaatgagccatgttcaagatggaaagaaaccactgctggaccagaagtaactataacgaaattttgaggatgacaggctcattccagggctgccatcaaggaacaagagcaaaacaacggaaatctggggtgggatattcctcactcttgaacacaagccatggacacaaacctatggatggacacacaccttcatatccactaagatttgggaacacaaaagagtcattttatcccatgaatatgtcatctatctcataaatatttgtgaaaacttctttaaaaatcctcagaactgtgccacttaactggttccaggccagcccccttcagtttctcatttgaatgcatgttttgctttactaagtaaacttctggttaaattgtctgtgtctcttgagtgaattctttcctctgagcagagaagtacgagaaacctctgtaacatgtccactcatgtggttctctacccctgcctgtggtcccttgggctacatgtgatctagctgtgcccagatgtgctgggtgagagtggatttgtcccttaatgattctttatccgggggacaagatctggcaaaggagatgatctgcagtgtaccacacacagatgaatgagtggctggtaagtctgtgcgtgcctatataggaagaggaaagcaggggctccggacaccaaactcttaagtgtcagtgatgatcttacgatgtgaagcaatacagaccgggtggatggcagccatgcagacctgataggggaccagcaaagcagcagatcctgaaagatgagctagaacattgttaggctcactccctggtatgcctgttcctgctcctagccttccattcagaatagctgattactcatagctggcctgttggcttgacctgggctcaacgatcagttcctgaacactgaaagccaacagtctgctttgttcctactgctgctgctggcgtgtttgggagtggggagctggaggaatctcaagcagttcacttctgagctgagagtggatgaggctaagcatggacaggggtgcttttaggacaactgagaactctgggtctagatttgtgccgcaaagcttgactgggtcctcttacttatccctcgaaaatcactcggtgtttttgattctaacaccaactaatttgtgaaatggagacatagtctaatgttgaactaccatcagggttttctgcagctctgcacagtatatttcggcataactggaagtgcctattcttgagctctacaaatagcataacttcaaatgcagcaacaatctttctccatttggctagactgtcgatgagctgttccaatctcacttttctacaaagttatcctttcctttttctctttggagaattaaaattaagcttcccttctgtccttctctagggggcgtgaccaggtggaatgtctgttggtgaatgagtccagggccagcatctagcaggagggggagggtgggaaataagatggtgccagatgaccttggggggaattcattactgtcatccctgcttttagctaccaaaccatcattcttgtgccttcatattccttgccattgaatcacagagccgcctggcctctgtaaaagcacctttccttcattctttaactaaacacaataatagattaaaaggtctaacctctgtagagctgggctggggccttaccttctttccctttctccatttactctcccccaacatcaactgagcactcttgaagtctgtgcctcaatctcccatcctttcttgagttgtgcttcttggagccttgtcctgctggccccacccctgctttagaaaccttgactgactgggcccttttctggccatacttactcctatagtctgcagggtcaaggtaggagacattgtcccacttccagcccatgctctggatacaggaaacccacttccaagttttctccctgaggcctgtcttccggcactggtaacattgctaacccaggatgagatggtgtttgtgatggaccctggaggtgtaggtatgtgtgtctcagtgtgggaggcctctgtggtagagcacagagccagagctgtccagggaagctctgtggtcacacccaggaggcaaacatttcacattcaaagctgccgtctgctggctctctgaaggtatacttgtcaaggactgttagttgagcaaactttaacttggtggggttttagctcaatgtataatgattcaatacaaggtgtatggtatttacactacggctttagcttccataaatgttagggacatgactgtcttaccctgcccctcccccagaaaggttcccacatgtcttctgagtacattactatggattctggtctgtgaggacagaacagtcagggccaggatttttagcccctttcctgtcgcccatctcttcttgctctccctgttcagccactgacaaggcacagtggttaactggtaaacaaggaagagaagtcgctgggtgtccccagagaggttttcatgcgcctgggtgctttcaggtcagcctctgcccagtatggaatccatctgcagcactaaccacagacacacagtgacctctttttcccccgtattgatttttctctcttcatcgctgtattatttcacccctcttttctgaactgtgtttcagacagagggagagactgtgatggaagtcggccaagcaaagacgaagggtgggggagccgctggcaattcccgtttgacgctaatgatttgtgtacaattcaaggtcagagaatgatatgtgaggcttgcgcacccacccacacaagcatacacaatttagtacttgattatatcagcatatagcactaatacatctcataccgcctgttcacttgactctccaattagaaagaaaacgtggagggcagggaccacatgtgaagcttccattgttccccatcacacccaccaccttattaggcacataataggcatttgataaataagttttgttaaaagaggcttgcctctgttaatgaaataaatgtgttcttgaaatgttctgaataaagtgagtttctgtaaatggggatgtgattttaatgacactgggagggttgcaacaggagtatggcaataaatccttctacaaaccaaataaccattacattcggattgttatatgttttttaccgtcttggacctgaaccagggaatccccagttgtgatctgtgagtctttcataactacaaccacatttatttgggggaatgcatgcatacttttttgttgattttccccctgcagcttttattgtattctcaaagagatgtactacttctaactgccacccccccccccacacacacacacatcatctctccatctctgtgtaatctgggctggccttgagttcacggctctcctgctggagtctcccaaagtgctgagattacaggcatgaaccaacacacttggctcaagcaatgtgctacttagaacagaaaaagccataactcatgggcaactgaagtgggtctaggtttcctgaaaattaatgcacaagtaaagagaaaacaatagtcagaactaacatttattgagcgtcttttgcatacgtttgtatgcaaaaggcgctcagtaaaagtatcatatgcagtgtttcctacaaggccaacatttctcattgtaagataaagaaactacagatttacccccagtacatacactgctaccagacactgtgtgtgagatttgaaccaggaatctgctttcaaatctggaatcttttcaacaaaatagtctccaatcttatttaaaataacaagaaggttcatggtaatgagaaatgattaggtttaagactatattgttgtatgtggagctgggaatatgaatgactcagtctataaagtgcttgcagtgtaagcatgatagccgagtttgatgctcagaagccacgtgagaaaagttcaacatacccttgggaggcaggggcaggctgatccctggggcactctggccaacttgcctagcctatttgtgagctgcaggccactgttccatgctgtcaaaacaacaacaaaaccaaaccaaacccagatgaacaaacaagcaaccatgatggggaattggagaaatggttcaggacatgggggaggggaggaagcatgtgccacagaaacataaagacattcccagaatccatacaattgctgggtgggtgtggcagtctgcccacaattccagcactaggaagttagagatggggttctcctaagcatgctggctagcaggactagtcattaggttcagctgagagacactttctcaaagaataatgtggagagtgatcaaaaagactcctgacgttaacctcaggcttctaacacttgaatttgtttttccccaacatacatgtaaacatgcatacctgtgaacataaacatatatggttagaaaaaaaaaaagatgggtggatcctgagcagtgacatctgaggttgtcctttggcctccacatatgcctccacacatgtacacccattcctcctctccagtgagtacattatactcatgtcataagtaagaaggtagacgttaaatacatggaaggtgctgagggtatatctcaagtggcagaatgcttttttggcacactcaaggtcagggatttgatttctgctacaagtacagaagataacttggtacagtctctacatctggctgatgaatggggccagcagctgaatcccagtccttgcgttggccaaggccactgctctctacccttttactgatggaatggcctggcttcctgaagatgcacacatcatcagtgttctgactcttggaaccaacataacaccatgactgccctagaattgaattctttctcttcaaattcctttagagataagtccaatcctccaaacattaacaaaatatttactcctaaggatgtgttaggtagcatatgaacctcaccctgtgtgtatgtgtgtgtgcatgtgtgtaaagtaaccatactttgaaactataatttgggggactgtttctgactggggctatctataaaatcggtgattatgtatttgatctgtgcaaatgtgtgcccttcctatctagacaatcctctagacaatccacttctatacttagcagggtcttggggacaatgctgttgatacctaatatatatagaaagttggctatccaatcactcaggagtcatttgatactaattcattccattccaccatgcacctcaatactacaagagcaaattagtgtgtgaaatgatgctagctcattgagagaaaataatattgaaatttaggctgaacatagaagcctggaagatactttcacccagaagggaaggaaagcccaagtcttgaactgaaagggccctgagttcaaatctctatcctgccatttactagctatatactcctgggggaaagtcacatggcctttctaagccccagctttctggaatacaaaaggagatgacacctatatgatggtgtgagaaaaataaatgaggaaatatataggcttcatgcttaacttcgtgtttaaagatgggatatacaaaacaacgaatggcttgtttctccaaacaggagaaatgatgcaaacaaatttctcttctctgtgagtgagtgctacttctaggtttgaaaagaaactccattcttacagtaaagctacaggaagcaaatgctaaaataagtctcttcctgtgcataggtttatccaaatttccttcccaattttatttattactgttgacattttattgcttaaaataatcttgggtgatcccaggggagacacagaaagggtggggtgctctttcttatatgtcaacactggaataaattgtctcaatctcatgtttgtgtgcaaagcatgcaaggaactggcagatgaagcccttgtggtatgttgcaattctgcctcatgaccattagaataggtaagacaaaactgtaaaaatcttagcttgcagcaaagacaggggtgaatgctggcagcacagcagaaacatgtgattgctcacaagttcctggggacttagctcttgaccagcaagccaatgagacccatggagctgggaaatcaatgttttcgaggccccatggaacttggcttcccaaaatcaatgaattttttgttttgatatgcagtgtccttctgtgaaaatgacaaggaggctgtggcagctttaggatgttgcagacaagaattctttatcttgagggaaagataaatctaggaacctgggaaagaggaatgtgaaaatacctgcttagatccttgccaatgtcaggctagaaagtattaattctcaaacagtcttacattgcttgctccatgaccctaagaattacagagcagaaatacaacagcacccatatgcacactcagccacattctacccaaatccaacagaagataacagtattcattagaaacaaaaggtgagatggtgggaagagtgaagaggaaagatacaggagtcttttttcatctattcattacattttagtggaagggctaactttttaggtgcaagtgggaaactgaggccagtgtggtgctgacaccttcaggtggctttctccagccatcttcctctatgcatgtgcacatacaggcaaaattacatcatgcttctgagctcagatttggattcagaaaccttttctttgggtcctaggtctggagctgactctatggtgttggacagtcttcttaatgcttgatgcccaagtttcaagatcacttgaaaatattggcacagaatatttcagtaatatgttcctcactctctatcagagttccttaacctctgcactgcgggcattttgagtagacaattcttagctgttggagctgtcttatgcgcagttgaataattagtagcacatctgatttctacatactagataccagtagcagtatgtccctgtccctacagtggtgaatatcaaaactaactcctgatagtgttaaatgttcagtgggtgaagaacatggctttggcccaatcaacttctgaaagatgagcataactccatctttctctttgacaaagattttaatgtctactttagaagtgtaagaaatttcataagtacagttatcagggtcttagtttcctcatcatgagaccattattttcaggccctctcttgttctaaattctgtccctgaaaattctattcctatctcatcaagaactcaagataatgaatctccaattaaaaacctatacaagtaatatatgttttactagaaaataccagaaatttagataagcagaaaaaaatgaagcaaaagacaacgaagtcacagaaaataaggaagagaattattacttataattcacctactcagaactaggttttataaaacacatgtatacacagatataaaaaatacacatatgcatacacattcatgcaacatcccaaatatttctcatttgattatcattgatgtcattaattctagcttaacctatatttttactattgttactagtctgtctacacgcatgggcgcacacacacacacacacacacacacacacacttttcttcccatcatatacaatatccttcaaagaataactgctcaaagtgggttagcatagaagcggatgattatggaatccacacccctttcttccttcacagaattttagctttaagtgaataaacgggcaagccaaacagagttgacaattgctcacattggtcagctctccttctccagcaaaggggccatcctcagtgtttcaaatcaaggtgtagaagtcggacggggccctctccctttcatacttaatgctacccatggtcacttcacttttctgtgactttttctttggatctatatccagggtctcatgcagtgcggacctaattattttgttccaggtgtgctgcatcctagcatctctcctgccactcactttgatcaagatagttctcaactccttttggatgcctgaaatggcttctcactgcttcttggatcacaaactagatcttagtaatgtgcgctggaggcttcctcctcctccatgcaagccctcccaggacctccttgtttgcttcactattcatgctttttactctttacaccctacttccgagcccactgctcttccactccccttattgatgaatattccattcaaagttaggtaaatcaaagcccaggactgccatctctcaaacaaggggggaaaaaaagaacataaatgaattatccttctgttgacatttcagttgccagatgtagctaattacctgtcatattaataggacatatttgtgttaaagattatcgatcaattatttatttattttggtttcaaaaccaccaaactaggtgaagtgtgtcaacttcaggtagcaattgtcttgtaacagtctctcccttgcagcctatgcatagacttaatccaaaggagagcttgctttttcccattaagtggtgtacaaaggaagagcccttggattttatcattcaagctcctggatgggatacgcctcagtactccagcatttgcctacatggcaagagctctctgtttgacctctagcaccgaaaaacaaaaaaataatctaatcattgtatctcggataacatgtcactcttgaatataaataggactttgcatgctgctatcattttatgaaatcttttaaatccagcttttaggagaggataaatttcttaagggcaggggccatgctttttgcttcctctgtgacgcttgcagttgctgggaacacagctgggtgtgctgttagtgggtcccgaatgaatgttgctaggtgattcagacttgaagaagaaatgaagagaaaagcccagggctcagaggatttgtttgcatgcattttgctgcgaagaaacacaaatgtggagagaaatgagcatgtggacaactcaggggctttggcccagcaatagtctgaagcaggaagttacaatgcaactaagagccacagctgggctgtggcctggaaaacagaggacaaggggtaaaaacaataaacaccttcaaaaataagaaggcagagggaaggacttttaaagaggaaatggaaaaatcctgtcaataactgacttgggtttagagtgaataagacacaaaggtcctctccagttctgtttcctgctttaaataaaggcaaaggtttcacatttagccatagaattatactctgtactgtgaggcataactttgacaccaggcctgaagctactaaagagaagggatagaaacatagcatgcctgggaggtggtgccatattacttaaaacctagcagtaaggagacagcagcaggaagatatccaaggctgaggccagcctggtctatagagttccaggacatccagggctatacacagaaaccctgtcttgaaaaacaaacaaacaaacaaacacacaacaacaacaaaagaaaggaagaaggaaaggagagagagggagagagagggaggataggagggagaaagaaacggaaggaaggaaggaaggaaggaaggaaggaaggaaggaaggacggacgaatgataggttggttggctggttggcttttatatgtttggaaccagtggctctgctcaaccaagcgagtctgaatgttctcaccactgccagttcaggtctccccttccggaaccctcctttaccaatatcactttatgaaatgtcaaaagccatccgtggcaattatggtgttcacaaatatgttcacaaattcttgacattctcttctgaagagagaatctaatctcccttccctagagagtaactggacttcattattttgctgctaatgaatggaataatgaagaaagtaaagatgtgtgaccttgacacgatcttgtgataggctccatggccttctccttgatctcccttgaattaccctctcagaggaagacatccaccatgtctggagagcagccagggaagtcggtccactctggaagtcactaaagccgctatgctgacacccatttgagggtgttaggatggaagtgatgcttgagccccagtgatgcaaagagatgaactcggtctcagtggcatcatgagtataacctatgtgagctatgagccaagaacccccagccacaatgtctctggattcctccaccccgtgaagctgctagttttaaggataatttgttacacagcaatccataaataagatgttttccaataaagcttttttttgagctttagttttagatgtttaaaaaagaactttaaattgggggggggacccagtgttcattatttaggaacacttgtttacctacttttagtaaatctaaaagtatatatggattgctgccaagactgacaaacagaattcaatccccaggatccacatggttgagggacagaacagacttccatagctatcctgtgaccttgacatatatgccatgacaggtgtgtgtgtgtgtgtgtgtgtgtgcgtgcgcgtgtgcgagtgcgtgacaaaggggggtgacaacacagccactgttttgtggcccacacaaatgatttcagatatttatgatcatatttctcctagaacttttccttcttagtgtgctcagtacccagattatagatataaaacaaatgcctagtgaatgaatgaagcagtctttgaggaacgctgaagcttacacattttctcagagaatttggacagtgtgtagatcataagaagtgattcctacttttctttaaattacacgtgaaaacacacatactgcatgctaagggcctgttgtagtttaaatgtgaaatgtccaccatttggctcatatattaggacatttggtctccgactagtggcactgctttaggagtttgaagaacctgtaggaggtagagcctagaggaaaaagtgcatcactgatccatttcctatctactgtgcctcttggtcggccaagatacaaggaggtgaggggtcgcctctatactcctctccacatgaagctgatggccacaatgccttcccctctaccattagctgtatccctttttaaccatgacgtcataaccctttcttatgttaggcattttgtcacagtagcaggaaaagtaactcacatgggatgtaacactattttaaatgttttacagacacaaggatataactttctaataagactgttactatttctgtgtcctagatggaaacctcaagttcagagagggtctgtaaactgtgcatggtctacaggaccatggtctggtcctactgatgatgaagtgttgtcctacattcagggctagttctgactccacccagtgtccccacccaatcaaggtccttctgccccttgctagaccacaccaggaagttcccaagttgtgagaaggtgggggagtggggaagccctccctttaaaacctgcctcttgtggtttagggaataaactcgtgtttattcacgagtttctctcactagaccaccaatttaacactctgccaactggccaattattccagttcatgtagagctaagcaggttcttctccagctgcacacctttcctgctcaacataattaacaaagctcatcaaaaccctggaaaacaagcccagctcactagcccctctgactgatgtgttaacagggggttggggtgttcccacttcaccatgggatgttatgtttatgtggccctaaggctgctcacaaatggtatgtgttgatgacaggggtatgggccagtgagggctactttacttttcataaagtagccaggtccccagacacacacaggattgtagcaggatctgatcagttctggtaaatgatgatgaccagggctcaagacaggctggggaacgacagattattcccggtggttcagaatgacagcctttaaagggtgatgcagaggcttgcagacagccaacaaaacattttcccgctgcttcacctctgttgccgagcacgcctttctgatcacagagcagatgtttttgttgtggtcctatgtcttgctgtccatcacagtggctgccacccacaggaggctgctgagctcttgaaatgtggctgctctaaacccagtgtgttgtgagtgtaaagaacacatccaaaccccaaggtttgctaagaaaagaatacaacatattgttcacttttacatagattacatgttgaagaaaccgtattttaatatattgtgttaaatgacaatatattaaaatcagttacaacagtttccgttttaccttttgtaacatggccatagacatggctcgcatttgtggcttggactatgtttttattgggtagtggtgttttagaaattgggacatctaaaactgacgcagaactgggagggatgcaaaggccaaatgatttccatgcctctccccagggctttttctgccacactaacgggtgttattgaaatgagtattacccacggccaagtctgctgtgtgctcagatgtgaactgcctcaagttccatgtggccatccttcagccccaaggcatcacaagacaggcttggacttgtgcaggcacacttggtgctgtgcagacccgtaacttactcttcccacacagaccggaaaagcggactgctctgtatttagtggttttttttagggaacagttgtatggccgtaagactgctccctgtgtcgtgagatgattgcaaagggcaataatgtacaaaagagggtacaaaagttgctgccatgaaactgggggcttcacttcccctgcctaggactggttttggatctgggggctctttacagcaaagctgagccttttccttgcatcactgctttacttcctggcactggatgtgcccctggaataacaagccatgaaaacacctagaacctcgttgtgtgaaatggctgacatgcaccacccaaatgcatcttcaaatgggtcagacctaagagcaattagagaatgcaggtttgtggagtgtgcccgaacctctctcaggaaacacactacttatcaatgaggattattagtttggatattcactgaggccactagttactgctcagcagataacaactggtaggaaaacggcaagatcttatgtatggttactaatcaagaataccacactggaaatctctctttgtgtttcatcgtctgagtatgtattttatcaaatgcaacaataggctgtcataacgttcaggcctgctgggtggtggtgatgcacacctttaatcccagcactcaggaggcaggtagatctctgtgaattcaaggccaccctggtctacagagcaattctgggacagccagggctctacagagaaaccctgtcttgaaaaacagaagaagaaaagagaaagagagaaagaaagaagaaggaaggaaggaaggaaggaaggaaggaaggaagggcaggcctgttgaagctgcccaagtagtaggatacagtagaagattattctactttataaaaatagaaaagtttagtagtttctagaaaagcccagaattgctatgaatagttgttcagtatagacatgctactttattttattatttttatttatatgcatgtgcctgagcgcgcgcgcacgcacacgcacacgcgcgcgcgcacacacacacacacacacacacacgcagtggaggccaggcgagggtgctgatctcctggaggtggagttacaggtgattgtggatgctgggaactaaactcagaagcgacttgtaacgcccacagctgtgttcttacttgctaaacaaagagccatctttagggagtacgttcttcaaaacatagacacaatcagttaatataataaaaacaccaggtaaagagaatacatgatactggtgtttattattgttttaaataaggaaaacaaatgctttcataatgctatgaatctatggggggaaaatcaatgcttgtaaagcaaaaaatctaaccacaaaataggagtagctatttgtggctccagtagtacaagctgaaacaaatgctagcagctaacttcacatttgctgcatatgtatcagaacatcaacagatgggaatgttcattggaagaataagataaaagggtgggatggctcatcaggtaatggcactctgtgtcaagcctaatgacccagttcaatacctgggacccacatactgaaaggagagaagccaccccataggtggtcctctgacttccacacatgcagaacacagcatggcatacccaaacatgggcatgccaacaccccccgacacacacatccacatacacacccgatataaatgaatgctaaaaaaaagagtaagaaatgatagcagggttaaatagcaagtgtttcaattgcttttaaagtaaagatacagcttgatatttagattaacatgcaacatgtcattcagaagccatgatattctaatattcagcatatgatcataatcattcacattatttcccttttatttggtcatattttcagtcactgaattgtattagtgatttcctctgactgactttcaacccagtctgcctaatctagctacttttctattgttggggagcaaatccaagaccttgtacattctaggcaagcactaccactgaaatcttctttaaaattctgtcctctgcttattagacagtcttactacatagtccatatttgggcatataactcttttatagccaaggctgtcctcaaactcatggaccttcctgcctcagccttctttaaatatcaatgtccaggtaaatattcttactgcatcgctagaagtagtagaaagagccctaactatctattctcctgtgccagtttcatgcactgtttcctggtgtgaatgctgccctctagcctggctgtgtcctggctacaatctgaattgttctctgaacagttcatttaagaaacatccttttgtttccactagcatgcctgctcacccactcttatccagagcctgctcagcctgggtccatctggaagctgctcccccccatgggactcctgtttgctcaggccatgctgaccactgtgctggccctggcactgcctttgcacacagaattttttgtttgggtttggttttctttctttttgatttaatacaggacctctggaagggtagtcaatactcttaaccactgagccatctctccagcccaatgtttttgtttttctgagacagggtttctctgtgtagaccagggtatcctagaactcgctttgtagaccaggcttgccttgaactcagagattctcctgcctctgctgggattaaatgcgtgcaccatcactgcccagctgcacacaaaatttagtatgttttatttcaacttgacacaaggcagaatcatctgaggaggggccctcagttgagaaaatgcctgatatagacaggccggtaaggcattttcttaatgagtgattgatgggggagggaccaccagtgctgatggttctgagttctataagaaaacagagtggcatcttcatcctcttgcagcagacgggaacaaataaagaatcccacagccagatgatatgcaaagagtgagaaaccttggaacactcagtcctaaacagggtcttgccatcaaattcctacaatcagggctcagggaacccagtggaagaggaggtggaaagaatgcaagcccataggggagggagggcaccaagaaaacaaggccctctaaatcaatctgagccaatctcctatgaactcacagagcctgaggcagcaagcacagggtctgcatgggtctcaccagatggggccctagagaagaagtggacacctgacccaaccctaacccaactgataaccacctgcaaatgaaactttagtttctttcatgtgagtctcactggggaaacaagctactcttaagggtaagctgtaggcccagagtaggtggccaacacaaaatgaactcaatggcgtctctggggattccttgcctcataatgttgtgtcaggctttaaacaaaaattatccctttttaaaattctactttttaatttcttatttatttattttatgtctctctcccctcttccctatcagtcctttgagtagctgttatggctttcagttttgtgtttttatgggattcctgggtgtgccaacaagcgggcctctgcatctatatctgtttcttgtgccctttcggaggctccttcttttccttctgtttatttgttttgtcctactcttctgtgttagtttttttcctattctattctactttatactatatcttattttattattatcccttagatgcctatttgctttctagtgagagatagaaagagggtggctttggatggagggttgtgtgtggagggactggggggagtagtgataaagcataccataatcatgatatattatgtgagaataaattgactttcaataaaagaaaaaatgggaaagaaggaaagaaaaaaagaaagcaggctgagttagccatgaggagcaagtcagtgaacagcatacttccatggcctctgcaccagctcctgcctccaggttcttgcctagtttgaattcttgccttggcttccctaaatggagcgtgattcagaatatgcaagccaaatgcaccatccccccccaacacacaagttgctttttgtcacagtgtctcatcacagcaataataaccctaagacagcaggtgataccttacttaatgcccagcattaatatgggacccactttatcttccagacaggactttctggggctgtacactctggttgacaggatatggacatctctttttagtctattggtcaaattttacaattgtccataattttgttgaactaatgaccagtaggcttctgttagggagcaaagctagacttgctctttgtctgtaactacaaaagatgctcttggagggttctggattggagtccatggtgctgaagaatatagtttgaaatgaagggaacccaagattcaagaggtaaagtgaaactgggcatgtggtccatgtgttatcactttcaaagcctaagaacatctaggaaagttgttcagctgccatacttgatataaccaagcaagcgcatccagagccgtggtcctaccaatacatctgaggagtcttgctgggggatgatatctcaagagggtgccacatacgcctcatgttgcctctgccatgtgtgctttccaccccactgccagcttttatccctgcagatcctggggaaggtatctcagcacacatgaggtcttaagaaaagagaagagccatccagctcttggaggattctaagctttgcaccattcccaatttactctctctgcttcccgtttgtggttcaagatgtgaactcccagctttcctgctaccatgactgtcacctgccaccatgatggactcctatcctcctggaaccacgagcccaagtgaactctttcttctctaagactccttggtcatgatgtcttatcacagcaataggggagtaactaatacactgccataggcaattgtattacacattgaacaatgaagtaaacacaggccactttactgtgttctgctgttatcttatgtaccgtttctccagtatgtaccatttttcattataaaatggcaacagccaggtggtggtgccacacacctttaatctcagcactcaggaggcagaggaaggtggatctctgtgagtttgaggccagcctggtctagaaggagagttccaggacagacgggactgttacacagagaaactctgcctcaaacaaaacaaaacaaaacaaaataaaaatggcatcagagttggtagcagctgtggggggtataaagggtgcactcccaggcctcatcacagatttgctgattacctgccctctcaacatctccctgggtgattcttaggtccataaacgctccagaacgctgcttgatgggctgtaagctctctgagtaaacaggaatcttcttgtcccacagcacctttcaagagcagtctcacagaggaccaattaaaacctcttgctcccacagtatattatacaactaattcctttcccgcacacttcttctctttggctgttttttcttagtctcatattcgcagactctgacagaatgtcaatcaggattttaaaagatcttccaggatgtgtatggaaatgattttattttatccatcaatagaaacctttcccttattatgtggatttttgagcactttcgcctgcctgttccctcagctgggaggcctggattgagccagtgatgaggattctgtcaatactttgcctggcacctgagttaccgggcaccacaagcttagtcggggtcatggaatctaaattgtttccacagtccttgaagtaagtcaatgttttcaagattctataaaaagactctgtgggtataatcatgagatcttaccccaaagtggctggaggatgatgttggcatttctgtcccctttaatatatacattcctgataagaaaacttatgtcccgaatgtcatcctggttttattttgttgcagtgataaaaataccccgccccatagcacagaggtgaggaagggttcatttgacacacagttccaagttatagtccattattgtagggaagtcaaggcaggaatttaatgtgtcacagccacagtcagaagctgagggagagtggacacgtggctctttgcttgcttgcttctcaatgcttagccagctttctctactcttacacactttgggggctcaactcatcaaatgctgccacccacaatgggccaggtcttcctctatcaataaaaaaccaagacaattccccacaggctaatctaacctagacaattcctcaactgaatctcttctcatgagattttaggttattgcaacctgacaatcaaaaactcaccatcacaagggtatcaagtttggttagtgcctgctttgcttcattaatggccaaaacgttggaaacaatcatgcaaattttgctgcaataaatttcagtatcaggcaatatttgatattcaaacagaaaggtgtccaaagccattgcagaagtctagaatgggcttggcattttcaagtgctccagtacagtgtcgatacaggagtaaaattaatataaacattggagaacgaaagggaagagagatggcaagatatgcatagctaggcagtcatgatccaggcgtggtcttgctcatgtcatctcggctttactctgtccagcaaagtgatctgaaaagttgttcaaagtgcctgaaatctcttcgggagaggcaagttcctcctctggctggtattaggaagaggttctgcctttctcctgcccagtgatgagattcccaaggaaattcactagtctgatagccaaagggcacagtatctgtttagatgatccccacagagctgcacagggaaatgggctgaaggtccacaaagtgaagagttaagactcttgcccttccccaaggaaggaaggttcctgactctatagagatggagctatcaggctcaggagccctgagataccaggcatcaaatgaaaacagagggtgtaagtgaaagtttaccagtgcttagagatacaaccctcacggtcagcaacacaaccaccaactccctttcatgctcggtttctagggccagcaatgagcttgggaatctcatctgtccttttcaagggaaagtcacctatggacactgatccagggaacaggctgggctctaacccagttatcccagggcaagtgaactccagtacagtgctatgctcctaaacagacggttaaggaaaagcttgtgacattatagaagcagaatgaacacaaggaagagagtaagcagagagcagaagaaaacctcatttcaaaatgataattagtgttcttgggttataaaggacaagccagagaataagaaggagcttatagaaattgaaaatgtggaaattaaaaatgaagtatttgatatcaaggttgggagacaaagttaaggaaatctaatagaacatgggataagaagacaaagacatggaaaatagaaaagaaatgagaatcagagagcagtcgaggaagttcacaatgcaaaaggagaagttccaaaaagttcaataaaaagaaataaaaggagtgagaaagtatcaaaaatatcttaaaccccagatatattaggaacatacattatcagatgttaaaataaatttcttactaccaaatagcaagggtaggcaagcggcttggtgggtaagagtgtctcctgcccaagcatgagacccagagttcaagtctcagcactgagtaaagtccctgctcaactgcacatgcctatcactccagcactgtgagggcagaggcaggggaacacaggttcagtgagaaaccctgcctcatgtgaataagggggaaagtgatatagcaggacaccacacatcattctttgccccccaagcacccacacacccacagccacaagataaatacatttcatggcatccagcataatgtgggaaagaagccacactaagatcacaaaatcttaaagattcaaaaagccctctgaggtaaggtgtagacacacatcactgggcctctcaatgctgtggatgtcacaggatcaggaagaaatgcctttaaggtagggtgtgtcctaagggttgaaaagggaaaaatgccatacctggggaatcaccaagaaaatgacttagtgaagtcaagtggctgtcttcatggagaggggcggggagggctgctgttgctggtttttgtttgtttgcttgttttactggaagtctgatagcactatctgaactgggtgcatgcgtttcttgggaaaagtaaacacatgtatttaagcaatccgacgaaagaggctcctggcttgtaaagttaaggatgtttaaagagattccccaagatgtctgtgaatactggaggcctgagcttcctgtggagatgctacaggtaacaggtttatactagcagagcttacacatattggaaaaataaaagggaaagtggaaagcatatcgacttatgacacacacagagccgaacacggaacacatgcagataaaacaaacagagctgagtacgattcagcccgtcctttcgctgctaggactagaagttagaagcctcaccttctggaaacctgtatctctgcactcatctgtgcaggaattgtacttgggctctgagttgcctgtgtcctcctttggccagcctggggccgtaggcctttgggttccttctgcatagctgcttccttgttttttgtttgtcagtcccaatggttgagtttgccttcccagcaatctcactggaactccacccctcaaaggtgcccttttaaactgctttgctagtactcctccttgctcttaaaaacacctttttgtcacttgtacccatgcgttctctggggaagcccacaggcagctgaaaacatatctctggcccacatgttgctatttttcatcaaatggtttattaaatggttttagacacggttgggcaatgtgcaaaaaactagctgggggtggaggtcttgttcttgagaaacagcaaaattaggaaattataacaaacaagagcaaagtaagaactggttgcttcatctcagaagtacatattaaaaaaaaaaaagtagatctcaattcagaaggctcagttatgacaactgggtacagaaatgtatttttacaaggtgggaggcacagggaaagagacacaatcaaagaaataacattgggacgcatcctggagaagactggtccaagaactatggtagaaattttggtggtattttcattgctgaagttttagctttttacaggaaaaagaaaagttgttaaaggatggagaaaggatgtactaagaaaacggaagagtattgggaggtgggatggctaaggttatcctggagcaggaatttacaactaatacacaccaactagagaacgatggcatgatggcatgaactcattcaaatgaaagtcaatttgacttaaactgatcctctaaaaagagaaaggatcgacttttgcttttaaaaatagggatttttccctacttaaaaaatactttcctggtggcagaaggaacatacacacatgagagcaatgaaaatacccattcacaatcagataaaaatctgaaatggtgtatttgtagatagaccctcacatgcttctgtaagtatcttgaaacttgtttcaaatgctaggcagttactacttcattaggaagcatctaccattgcctgtctgtgctctgtgctaagaagcatttgttctaatgagcccttgccaggaaagagtctgtccaccctgaaagcacctctgagatggacagtgtttcatgcagatttaatccagacactgcttcagccgactgaaccctttcaaaacacaacccctgtagctaaaggcctcagggacccacttgcaagcattaggaccccaaaggatctctttaaaaaaaccccgtgttccagctacgactgtttctagttatcatacttagaaaggggttagtgtgggtctccgaggacagagaggtatcattgcacccaaatgtctacagaacctgcaagttggaattaatcatctttggttgggctcagaagaaatcctggcctaaaaacagcctgagtagaagcataatttgtattaagattaacaacggatcatttgacagcatgcaatctcatgaacctcctggtgcctctgagctcctacaagcatccttgcacaagcctctatttttgcttgcttctgaacttaaagtgtataaaaggttgcatttccattgacatatatttctatattttaattttatttctatattttaattttgtttccgtatttcaaagatgtttcctactagttcccagttgcagttgatgtaaaatcaagccacacttttatttattcagacaggacttctttagatctagctggcatgtgaagacaagaaatcacagggaagggtgggggttggaaggctgcgaagggtaagaatgaagccatggagctttggcctgtctatacaggctagcaccatctccagccttgtagcatctactaacttcaggggtcggggtagagaatgggggtcataagtgggagccacaaaatgccgagttgcctagtatctacctacaggacactgtctgcatttcacaaggagggcacacagacaacaactgaaagtaaagagacactccccaccccctcacacacacacacaccatgaattcactagcaactcttgctgaaatccagctaaatgtctcagatagggatgccatactcctaagtcatgtggttgagatatctaactgttgctggcaaaatggcaaatgttaaaacattaaacacccctacaagacccgctctccacttcactctgaaaatacaaaaatgctttgatttttaaaggccaagagtccatattttccatcactcatagcctgttaagacagctgatgatttgtcccgaaggtataaaatggcgataggtaggcctgagaacccctgccctcctatcaccctttggctaatgaaccagaagaaaaactatagaggcatgccatgttgggtcatgtgacttctgcagcctgctttcctcacagtgaaaattggacataatttaaaattttcttggctgcagtcaggaataggatgttaggttcctaggtattcaagaattcaaggtttattggaccactctttttccaactctgaggaaaaaaaaaaaaaaaaaccgcacaaggatgtacaggagaggaattctggtggcgatcaggctcccttccaggccaagcctggtacctggtacacacaggacagtctggcacgcgggtaagaacggctcccacagtgtgctatttctcacttacctggctgtgggctggaagcgcagcataggccatgggcggattcatcactcctttctgcttaatgagaagcatgcgtttctggtcctcactcaggtgcgctctgggagcttgcagctgtggtggaggctgctgctgctggggaggctggggctggggctgcggctggggctgcggaggctgctgctgaatgtagggcatcaaggggtttttgttagggttggccatagggggtgtcattctcggactcaagtccgcattaaaatgggtcagaggcttagtgttgccataagtgagcatattgtgctgtttgtttaaggagtttgtacccaagttatttggctgctgactgatcatattcatgtgatttgaagggaggtagttgttcatggtcgtcttctgcaggctattggccattgcaggcactatagtgttttggttgttaaaggcttgggggtacatcattgggctatttggtttttctgcagtaaaagctgctccataaggacttgacggaggtcctaagggagaccaacttgaagtctgatttgagtggggctgctgctgctgctgctgctgctgctgctgctgctgctgctgctgtttnnnnnnnnnntgaagtgttggtgttgtgggtggcgtcatccttgtgctggtgctgcttctgctgctgctgctgctgtttctgctgcatgagtttcgccctctgttgttgctgggcagccatctgtttgagctgctctgctggggacatgtcagagctgggcactgccactgagcctgaccctgaaccagataccgtcaccgagattggattaaggagatagccattgccaggccgagctggggcttgacctggagtatgggcttgcgttggagtttggggggactggacagcacagttagctggtgagctggcagggtttggagccacgggagtattggccacggatggtaaactagtggctgtggatacagtagcaaagggaggaccagaagatgaaggtctggcctggggtgatcccatagagacgtgtgcaaaaggagaatgagaggcatcgctcttcacgctcgcactctcgtgggagagtggggtctccatggttgtctgtgagaattccggatccttcttctcttcaaagtcttcattgaacaggtcctggatgtcgtcttctggaactgtgttggccagttcgtctattagctcctgccactcttggtcattcaggttaatgtcagagaacagcttgttctgattagaaagtgacgtttctgatgtgtctatacaggcagggtcatcaagaggctcctgtttgaggtccttgctctgcaagatagcaaagctatcctccagatccccgcagccattgacagggagtttaatctcagggagcctgccattcttacccagatcttccagaagcccaggagtgtgagcagcgctgttctgcaagggcaaagaaggcttgaggtcaagttggtgacagggtgaagcggaaggcagtggcatgttgttgggcaaattgttgatggcttccatgcctgtgggaagatcctttcggatgcgcttgcttgttggagagaagctcccatcgcaagccccattctgctgctccccattaagtggtgatcgggccccttccagcttccttttcaccgtctcctggagctggaaaagaaatgggagataagatgacttaatctcataccaaactcttaaatattgtgatgtgtgttgttatgaactacctttgtgaggacgcatgttcgtgtgtatacatgagcacctgtgtggaagacaaccttgggcactgtccattctacgttgagacagggtgtctcattggcctggagcacacccacgagctgaggttagcctgtgaggccctgggacctacccacttgctttcttggtgctgggataacaagtggacatgtgcctgaattttttggttgttgttcacaggtttttggaatagaactcagatactatgatgaataacccattaccccctgaactgcatcttaagtgctttagaacacgcaaaaaggaaaggatgcttctagcttcaaaatcaggtgaccccatgatttgaaatctgtgagaaaagtcttcatctaaaagcggggttcagagagccaagagatacgcagggtagaggtcacagggaaaggtcacctgtgagcattttccaaatgagaagaatccatacttgagatgtggactaaaacacctcatacctgaaaaggatatctatccccaatcctcaccacacccccataattgaaaccatcaaggaattaaatcaacaattttttaagaacactaacaatgtcctttttaaaaacgtttgttataaggaactgaaaaaaatacacacagagagattaacatagcattttcccagatccaaagtctacaatggactacagagttaaagcagccaattagaagctgtggaacttgtcactagattttacactttcattatcagtcacatcattatgcacttacccaccacaagaaacagaaaaatcaagaagagagtcaaaactagaaaaaatagttttatatccttttgtgactttacttgaattctgtccctcctcgtctcccaatagtagcctttcctgttcttactatacctatactataggcgcacacacacacgtatatattatagaatagatccccaatgaggaaaaacatgcaatttttttctgagaatggataactctcacttagttttatactttctttgtgtttttaaaaatttattcacttcttatgcacattggggttttgcctgcatgtgtgtctgtgtgagggtgccagatcccctggaactggaattacagacagtcatgagctgccatcggtgtgttgggaatcaaacctgggtccttcggaagagcactcagtgctcttgaccactgagccatctctccagatcaagttttatactttctaagtccatttccctttgtggttcattttttctttagagctagacagtattccattttatgtatgcagcagagtttcattacccacttgtaggttgatggacaactaggttggttccattctcttgccatagtgaccagagcagcaaaaatttcttatgaatatggatttaacacattaccaaatagcaggcaatgaggattaatattaaacatagcccaagacttgaacctatctcttgatttatctcatttgcagcgccatctgatgcttggtgtgtttccatcctcttctgtgagtccacacttggtgagagttcctcttcctcactatcatgtattctttgttgtaaatgatgggattcttccaggtttcttcttaaacgttttttcttctgttcgtttatatgatttcctgggcatctccctctactccaagatccttgaccatcttccctaggctgatggtcacaaacagtgtagccagctccctctctgcagagccccactaatgccaactttctcagacacagtttaggagcgcctagaattcaatacaatgctcatttgttcaccatctcagttacctaggacagaaatgtgagcatcatacactgatatgctcatctcatgtctatccatatcatcactgccccagaccaggggaccatctctagttgacccactctctcccttaactgttcctctattcattgtttagctctctcgtctctactctatttactgtcaccttcttcaaaaagatacattgtcaagtggttcctgcttacaagcctgaagtaatcagactaaaatgtcaactgtcatctttgcatcttcctcctatcctgtccttctccatcctcgctatccttatccagtgtatgtacatcttctatcaattctcctaaaactctttttaaaatttgcttgtgtgtgtgtgtgtgtgtgtgtgtgtgtgtgtgtgtgtgtagtagggatcaaacccagggggccttgcccatgctaggcaagcactgcccatcaagctgcaccccaggcttcttcagcctctgtaagttccctaactatgtcaagcttccttctgtctccaggcaaagcaatgttttctttgcttggaaaaatctccccctctcctcccctttctctggtcagtactccctaaccattcccctttccttggttagcaccccctattccctccctttcctggttagttctcttatccccattatagactttatcataatttgtgccaaaaagttagggatcgtggatgacttgtttcttgggtatctgcagtggtcaggttctcagcaatagttaataagtagctgcaaaatgagtgaaaaatcctattgtctagtcagagatgtgacaagtgagttttgaatgacagtagaagccagcctggtcgccataaggagtttctgattgagaatcttcattcctggtaatggatggaacgatctcttgctccaaagagtgataactcttgctaactctatgagtttattagttttatacccagtttatgtctttgtgacctttctttctgccagaaagggatattcatgtggctctggtcaaagagtgtttgtcccagagtgggagctggcgaaatacctgttgtgtgggtgaaggttttccctttgtaaatttcccactgggttgcataagtggtgcagggtggagtccagttcttctacctacttaccccgttcttggcagagacactatattttagagaccctataagtgagaggtgtcagattccctctgagctgcatgctgtgtagttggcagggctccagaggagcccctcgggttgtaacacccatctgctgatgtgagtcttaaggagtacatgctttcttggaagcagggaactccattctttgagagtaagcagcgtcaaaggggactctgagccaaactcctatttaatccctttccccaaatcttagttttaataaaaaccagagcctgtcataatcactcagttgaggctcttgaacagctgaaaacaaggacctaactggaacacactagaacttgacttcaaagaaaatgatgcttcaatccatcatgtgaggggaactctgctaggaaacaacgttatttatggaacaaaccaggaaaccatgatgggatcatcgttgtgacaggtgcgcaaatgtatgtcgctcaagtgtcacagctgaaaggcctaacggagatgaggcccgggcacttcctgaatggatgttaaggtgcccgggcacctcttgaagggacattatgcttcagaaaatgagaacatgtcttttttttttttttttttttggtttttcaagacagggtttctctgtggctttggaggctgtcctggaactagctcttgtagaccagggtggtctcgaactcacagagatcctcctgcctccgcctcctgagtgctgggattaaaggcatgcgccaccaacgcccagcctatagaacaagtcttaaaaaacaaatctgatggcagtttagaacttacaggcccacaattctgttctaggtcatgtaatggatgactttctacttgtccccctataaaacagaggtggccaaggtgccaaaggccaatagttctgcttgggaacccactcacctctaaggggttaagtaggtgaaacacaagagtccagcattgttgaagtaaaagcgaggcactggagcgagaaggatgtctcaagacacccgctccccaacccatgcattaaaatggtgtacagcactcagtcatggatggctgtggtgcctaaaggaccacactgaaggtttctgttctgcttgcttctgagtccccggcagctctcagctgacacttaaaggacaaatttggagaaatgtctataaattgtcccaagttcagtttcatgagttcccaaatgggttagtagcgttagctcacagagttactgtgagggtgagttcataggagataatgtgcaaacacacaattttgcacgtgggacccagagtcagcactcaccatgccttagcttctctatttttaaaattcagtcacgaccgccatggggacagaatgcttcctgaatcttcaagacacagataggtataatgacaatatttctgttccctagctggccaaaccttaatgtttcccaggcatctggagtggctttcttaatatgaacaacaaaaatcaaatttgcaattcaagcctgagtccaagtgctaatgcatgcggggtgtcctagattgtagaacaggggagactgcattgttcaggttcaaaccaaatacattcccagagcaccacctgaaaggggctgtggaatagactcgtttccccaggggcttcacattctccactgctggccttttaaccaaatcttgatatatttttatcatgtattagcatttgcgagtatgagaaagacagcatcgaagatgttatgccatggtttttatgttcggttttgttatgtccaaaatagcagagcaatcttcacatcaattctctctgtctcatcatcctttgttttatggaaaggtggtctgaaaatctaattccctctttatgtccctcgtgggagaaggagctgtggggagggagacgtggagccggctgtgtgttggagaatctgacaagcagctcgctcagtgagtgggagactccttggctgcacacgagcaattgtcctgggagtccccactctcagagactcgggtcaatctcagctctaactgcctatctcaacaagactctggccctcttgcctcccagagcagaaaacctcttagtacactctgccctcatgaacaagcatggaagctttagtgaggcttagccctcttgtttccatgttaccaggcttacatagagatgttttctcccattaagggaagctgagctgccaggagctgaagtgtgccgttcagctaatgcctgtgacaatatgggttgctatcaggtgtcaagtgctttggagacataattccccttccagaatgctctagagatggcctcctctgcagtatggcttgatagctggtgtttatgttaaattacaggatatagatgaggtagaggaagtaagagaagagaaaaccagaggttgagagggacagaatggcatgtgcccctgagtgtattgtgtgtcccagatccacagtgataagaatagcaggtagctacacatcattgtttattgcaggctagccacaacagccaagatatggaaacgatccttcaacagagaaatagatttttaaaaacaatgtgatataggcctgggttagatgggttagtgggaaaaaacaaatagacaaacaacaaaaacctgttgccaagcctgacaagttaaattagattcccaggacctatgaggtggaatcagagagaaggcacccaaagactgtcctctgacctcatgtgtgtgctgtgacacagtcacatggcatatacattataacacacacacacacacacacacacacacacacacacacacacacacacacacgcgagagagagagagagagagagagagagagagagagaatatgaatatttttcagtcatagagaagaatgaataaaacatttgaaggaaaatagatgctagtagagagtatcatgttaaatgaagaaatctagtcccagaaagtcaaatattgcatgctttccctaatttgtgggtcctagactttatatagaggtacagaaaaatcacatatgtgcaggtgacagaaaagcagaagtaagagtctggggaacaaagcagataaatgggagagggggagtgaagagggaagtgcagacgatgcttgaagtatatcatgtacatgcatggggatggccttatatagcctggtttaataaaataatttctgagtgaattgctgtgccttttgagttacacgatcacaaaggataactgttatccttacagcagacttttgagccagtggactgatggttctatgctgggaaagagacagtgtttgcagggaggtggaagagaatgagtgggtggcacctgtttcaaggaaaaggatggctaaggtcaccagcctctgctgacatagtgaagtccattcctagtagagtcctgtggtgtcccctgacaccacaataaacaagacgctattccctgtgcggcgtccacccttgaccagcaagaaagacgccacatcgaggaatcttcttcaaacacagtttaatcgggaacctctttgctttgtacaatgtataatggcggcggccccgggccgagggagacggggcctgatatagtctacatctaccaatcacctaaccctacgtggcgcgccaggataggttgtctccaagcagaattaagaggatacatgacctttgcctaatttggagttgtttaccacagagagcgctcgccgtcgggctggcggagggcggaaaccggcgccatcttttgggtgcggttttctgcagctccctacatccctgtaacaagatctttttctctttagactgacacagttcctacaagctcaaagaaactctcattgcagtgtccctgattgaggaagaagttatccaggatcagtgagcttgggaataaagatgacagtcctacccataataataaagacccaaataaaataataggtgtggtgtaggcctgtactcccaacccagagaaggctatggtaggaggatgaagggttcaaggctaacctaggctacgtagtaagacctgtttaaaacaaactaaggaaaacaaaatcagctccctgctggaagacctggaaatgaaccaccatggtccctgccctctagtcctaaggagtgattttaaaagacagattcaatttgtttcattagacaggacttgagacatcatgagactgaacagtgtttgaggctcacatcagagaggtggctaaacccatattcaaattcaaactcagtctgactctgtagttggctccacatcctcatccaggactgggccaagtgccatcataccttcctcaaagatagatgtactcaaatgacaagtgcacagtactcccactgactatgcttttcaggagtccttggttccaccccatgcagttaagtctcaagaaggattattcttaggcatggatctgactaccattctctacaggtcactgtctctgttgagacagtttccaaaggatctctgcagcaaccaccaggcacttttcaggcagctctaactttcttcttccagtgtgactctgatcatgccctttcttcattccagactcttccgaactgcctgtgcccccccccagcattgtttaaaagaggtacacacagcccctgacttgatcctcctcccaccccaagtccttttctctttcttgcccacggacatgaagtaacctcaacattcactacatagttacgtgagtgtgagcacatgatataccttgagatctgcaccatttgctgattttgttactgaagcatcagagtaacgctaccaagtcaggggatcccactggatatgcagttcagtatgactgcgagggctctctgtggttcggtgctatattcagttatttgtggctccagcacaaattatgtttgttttccctctgatctttttgcatatgtgacaccttcttcagcttcttcattgggccatcatggttgctctgacagcccctccccatgactcctgaccttggtagggtgacccttcatgtgtttccctgacactggggtgcacatcacactgcaggactgctttcctttccttcatgagtgaaaaacaaacagttctcacttaaccacatcaagtttatagcatggctccttagatcaggcacaagcaaatgctgaactctgtgaggggatttggatcgaacaatttcttttggttatctgaagatgctttctcctctttaatgcttttgagaactccaaaggcccaaaggatcctctgtgggtgctataagaggacacacaaggcaacttaagatgagaaaaatagagtctaaaagtcagaatctttaagggacattgccaaggacatctcttctttattctattttatgtttattgggctttgcctgaaagggtgtttatgcaccatgtatgtgccttgtagccagaagagggcgccagattttgaggaactggagtgtagacagtagtgagctgctttgtgggtgctgggtattgaacctgggtcctctagacaagcagccggtgctcttaacagctgagtcatatctccagccccccaaggatatattttcacaaacatgtagaccccaaaggctgaacttcaaatattctcaagaggcttcctgtggttttttccctcctcacagctgtcccctcccccggtactagtttgtgtgactttcatttcctaactgttggcgacatggctccttccctgagatttggggatggattcaaatctatgctgcagatgttagcgaactccaggagagcgtcgtgattattttggtctattctgggcaaacctgaagatgattcactagcatcaatcatcgcatggttattctctttccattctatgagtagtaatacatctagggtcacatgaatgaatctgacttgcttattttgtctttgatggagtgacttagtatacacatatgttagatattctgtgtgtggatatgaacaatgttgaaacacttccagaatgttcccacatatgtaaatactcttacaacgacttgaagacttttagggatttggcttcctttttttctgttttcaagctttgttttgcaataagttattttaatttatttttatcagcatatgttaattgttcagaggtttccacggtggcatttccatatagacttataatgtacacttgatcatagtcaaggaattccattttctttagtgcccctccccctttagtggggctgtgaagctgttaataaggcagatgccctgattctgactccacaatccatggctaagcagctccgggtgctaagactggaacacagggtggtgggaggggctcagacatctcagaaatttaatgagttcctcgagttgtcctgagatagctggattacaatctcctgcatttagacactggggtccagacttcagttaccgctggattctggtattctggcatctgtgattagatttttgaagacacacacccaaacaacatggattatttcctacttgctccggggcatctcataagtagaaccagggaactgtactctagaatgagatcttcctgacctcaggggatcatgaattgaatgcaagattgatggatttccatcattttttcatgaaaaggtatgcacatattttaacactttgggtttttctgagcatagcaatatctgttactattccccataccacacaaccaatggataaagggcactatgcatctatctttgcgggctctgcagcttcagggtcaatccatgtccaagaacatggaccatcccagaaaacaaaaacatccacaaaggtgctgacagaagtcggatacatttgtttgaaagagatcttcccaacaggcagaacggcacagaaagaaaagagaaaatcataacctaactttgtgaagcccttgcaaatctcacaaactctcagaaatgagagagaaaacatcataaacaaacttaacatctgacaatataactatatgccataaacatatagtttgaatgtaattgccccccataagctcatagagagtgccactattaggaggtgtggctttgttgcaataggtatggccttgttggagaaagtgtgtcactgtgggggtgggctttgaagtcatatatgctcaagccacaccagtgagacaaaccacttcctgttgcctgctgatgaagatatataaccccctgctccttctgcagcaccatgtctgcctgcacgccacaatgtcccaccatgatgataatggactaaacctttgaaactgtgagccacccaactaaatgttttcctttataagagttgctgtggtcatggtgtctcctcacaacaacagaaaccctaactaagacacatacctagtatacataaacccagagattaaaattctgcttgtgaggaattcccgaatggtagtttcctggacctgtttggttgaaaacgctgggtctctggaagagatacatactcggaaaattttgccgtttccattttgaaatgctttgggaaacatgggatttccctcaaagggctttgcccttagtggacatcaaaaatgtcaaagaatccccttggaaggcctgtagacatggaacctgtgccaaggagccagcactacccacagcatttcaaggccattgtgtgctgatggtacttctttcccagttttggaacacagacacccaaatctggctgtgaggtccttaattcattagttttagacttttctaaatttttttatgaacaatggaattttagggtatgcttttatctttggttatgcttaaatgtgtagtaagcaccacaacaatggatgccaacacactgggagcagtggtagacaaggtccttgacatttagaaacactatgtcccaagagctccaagtttccaagtacatatatgtccatataggctcttggctttctcacaactgaaggaatacattacatttcatcccggccgcaagggacccgggtactctttctatgtgacatttaagtagttttcatgagcactgatgaaataatgaaccactcattaagaccaagatggcaatccctacagtcaccaaggctgtgtgattctgcaggagtgtggagtgtttatcagataactcaatttattgtttagtaagtgatttaaggtattgttggtatgcagtttctaatggactgaaaactgccaggcatcatgctaagggcattgtatcttaattttttaaatttatttttattgtgacagggtcttactatggagctctggctggcctagatctcaatatgtagaccaggagggcctcaaactcacagagatgtatccacctgcctctgtctactgatttgtgagagtaaaggcatgcactaccatatctgatccatttttatttgtctatttattttgagactgggtctcatgtagcacaggctggatcccaattggggccaatttcatgccctggcctcaggctcccaagtaattatattatagggtctagcaccatctttggctggtgcttttcatttgccaccttgactaatcatcatcataactgttatggtggaagttccacccaagccccgccccccatctccctccaaaccctgctgcatctcagaaagcccatcagataatggcccctcccccagagatgctcaagatcactcccacagggtatttaaattgtcccccggagaacagacttttcctgtctccctttccctgtatcctctctgggggactggaaggccatccaggagctctgtatccattaaacgtaggtttttttctaatttgatttgatttggtctgatttggattgttgcattggcagagaggcttatccaggtgtagaaacttttcaataacctgtgatggctgggaatgcttcagcaaggacaggtaactcacattcctctcaaaggctgctcttacccattcttctcctgatgactcagcaaagcctgctgataaattctaggtgcttttgaatctgtcatggaagcatcccaaggaggatctgcccatggctgagtcagatctgcctgcttcacagaaagactggtgattttctgcgagaaagacgctgtaccacaggtttatcactaactagtttagggagtgatgcctgcagcatcagctgggcagcatcatcaggcagtgggtatttgcatccagagggttcctacactccagagctttctcaggaaaatctccacagggaccagcagctgctgtcaaaacccagtcagagccccaaaggacacacacggacacacacggacacacacggacacacacggacacacacacacacacacacacacacacacacacacacagcatttactttttaaggacaagaaacaatatccttaggggtctctcccagtagtttttactagaagtcatgcatacattttctattccaacatacctgtaggcatgaccttgtgttattttctgaattttctaatgggattttatttatagctgtaaagaaacaaagaaaggaggtggggaagaaggaagagccataaggaaggaagggaaccaacgagaagacatgatctgtgtcattcccggctggagactcctacacacaaggagggcgaaagtgcagcaggccagggccaggccgaggttctgtttgtttgctttctgggaaggacgaggcaggaggagaaacacttcacagaggttcagtgattttctctcccttgggttggacccaagaatatttttattccactgtttactcaaaatgtcctctttctcaatgaggaattctcacttttgtttttagccccttgtgagatcctccctccctccttctctctctctctgtctctctctgtctctctctctctctccccctctctctctctctccctctttccctccccccttctctccagctctgaagtcctgcaccagcttaggagatgcaaatagcccagcgcttccagatgtgaggagacacttttgaataaaacccagcacacattcatgtctctttggaatgcaaaagtattgaaataggtctataaaaaaatctccagtttccctcaaagaggtcaagagctccattttctatccagctgtcattgtgttactgggtgagtgcacctaggcagccgagagtcaccccccaatgagggcacataaattccatattctccccattccccacaaacctatgcgagtgtgcaaacgaacatgattcttactactagacagcacctgacgcctagacccccatttcatcgcacagttttgctccagatgtgaaggctgagtgcctgggctttcattatcaaccaggggattgtgctatgtatggctgtgtctttcagcgtgtgcatgtatgtgcccttgtgtgcaggcctatgcctgagcatgcagaggccagacattgacgtcggttgttatcctctatctttctctgcctttttttttttttttttttttttgagtctcttatttaatctggagctgggtgattctgctagacagactggcctggcaagtttggggtgggggtgtgttcctggttccacctctgaacacttggattacttatgagcatagccaaatgcccagattttcacatgggtactaggaaccaaacatgggttcataggcttactcagaaagccctttaacaagtgattctttagactttttccaccaacaggacacaaggcaggccaggaggacttttctcttctgagtcaatctccatgcaaagggtaagacacccacatacatgtgccataggaggcatgttctcataaacggacaaatatgaaggttgcaatgtccagttgggtggcagtacataccaccaattgacatggaagcagcagcagcctggagcctgccagctgagccttcctgtgtggggagatgctgctcagcttcatcccagctgaaattcatttttcaaaagaaattagacagaggtactgttgttatagcaacagtcagagtcatttaggcacacagtttcttttccacaacctcactgacttctgcgggcagtatttcatttatgcaaggggagtggctaaggctgagcctgcacggaccctttattagcctttaagatatgaaagcctgagtcctctatggccaatctaaagccccatgacaattttatgtgttccagagggtgagcagggaaggccagcaaaaaccctctgaatccagtatttccatctcctgggttaggaactgaatgtgtcagggatgaatttcctggcttatccaaagactggcagccccgaggaggaatttccaagagcatggtaatgcagtcagtgaactgggaagtgacttcattatttcagttctataggactttggggcatagacttcctaatgtgatagcccacaccaaccactgaaaacaatactctacccccaaacgatcttgttctgaggaaaatgtgcatctcttaaggaatcttcatgtcaaaggacttcccagaaaagtgccaccagggctatacaagggtggtaaaagcctgagcctattgctcatggccaatgttacagaacaactgtgtctcccaccacacaccaatccgtatatctaagtcccagccaccagaaactcagctgtgattatattggagtcagagcctttataaggctattaagacaaaataaggttttttaggatgttggtgactgtgtgcccttacaggaagaaattagggcacacacagaaaggacttgtggggacacagataaagaagcacctgccagcccaagtgagatggctgtcttagtccacttgcacaattgcagcaaaatgccagcctggataacttataaaaagcaatttatttgtcacaatcttgaatgtttggaagtgcaagatcaagagactggaaaggtcagggtccagtgagccccactcctctggaacagtgtccaagtctggtgagccctgttcctatggaatgacatcatctagatctccagcagaaaagtaaaagagaaaaacttgttcgctttagccttttagtctatgccaacccgcacagagtgacttactcaactccagagaccccactgttaagcattaccacatggggattcagttcagcactgaattccaggagacattcagaccacagcaagggcccagaagaaatcaaccttgctcataccttgagttggacttcaaagcctctagaactatgagggggtacatttctgatgcttacatagtctagtatattatactttgccataagagccttggtggacaagactaacaatttgattcaagcctatccctgtcctctcagctaggtcaagctcttaattactaccacaaaagaccatcttgcacagccttgtccaggctttggtttaattgaccggtaggcacgggttctgcatctgacctcaacaactttcaggatggagacaacagggaagcaggcaaaaggcaacagtgtagtagtttgtgtgtctcttggtctatggaggaaaggctcctaagatttgaggagttcgtggtcatggagcaactgttcaggcagtgggaacacatctttgttcagaaaagaaagaagcacatttgtgagcaagacctcaagcacttttgtctgtctttagccacagtgttcagagtgcaaacgtgggtaagagagcctagagaaagaagcaggggccacagggatcatgaagagctgacctgtgtcagggagtgtggtccagaagacactagggaaaaatcactaacttgtgatgttagtttctgatttgataatgataaaaatatacaataagtgaccaaagatgaaaccttcacagtgatccatactgtcttgctagggctcccatatcaagatagctacagtgtaatgtggagtgttaccccaaaggcccatatgttaaaggcctgttccccagcctgggtcagtattaggaggcagagggaccatcaccaggtaaagctgatctagaggaagtatttgttttctgccccacagccagcatgaagtaaaagcttcctcttctacacatttctacatggtgtcttatgtcaccacagacccaaacagtggcaccaagtgaccatgggctgaaaacaccatccaaaatcaatccttcatcattctgaatggatttttctcaggtgtctgccatatgacagaatgctgatcaagacaggctaaaacaaatctaaacttcaccgttctggcagctggatgtttgagttcaaagggttcttgaactctctgtagaatacagagggctacattttccctctgtcctcacatggtctctcctctgccataccacagcttttgtgtctgtgtgtccagtttctcttcttatgaaaacaggggtcatatgtgtaaggagtgcccaccttacaggctttgctgtaatttaaatggccctatctccaaacacggtcaatctcttaggacttcagcctctgaatttgagagaggcatgattcagctcatacagaatccaataccatttttgcacagcttattagagaaatgtctaaaggtactctcaagttataaatcaacaggatatggagttgacctaaagaaaacaattgacaattactgctttacccgaatttaacaatgctttattttaaaagtgtctgtttgcctgcattcattacttttctcactgctctgacaaaatttatggcacaaaaacaagttaagggggctggagggatggaacatctggctaagacacccactaccaagcctgaagacctgggtttgagtcctggaacacatacagtagagtgagagtaaccagcggcccagagtggcctctgaccttcacaatgtgagttgtggcacatgggagtgtacacacatacacaaataatagcaaaattattattatattataaaagtgcttccgattcacttgttaacatcctaactcctgacaagccctcagacagacagaggtgggtctgctgcagttcaagaggccctgaagagattgccttgttccctgagaacaagtaaatgttccttcacagtgacacctgacctcagagggatacaacagagagaaaactgaagcagagaaaggatgggttccccactccagcccagtatcccacagtaaatcacagggctcacaataggtttgtcaccttcctgcccagactgtggtgcactgtcaatgtcctgtaaaactgtagagccaagctaagcatgccagtgattttatctctaacctagccaacaagacattatttatgctgtttccattagaatgctacagtcaagtttgcatagtacttcctataactacctactagtgctcagttatggctctcataaaactccccagggacagatttttttccatctcactctcacttcagaagttagaaaaaatttaacaacagatgatgattttagagatatttttgaagttgtttgaatgggaaagaaagtaggtttttttttttaaagccacaatgaatattttgccaccttttgtccaatctagcaccataaatcaaatgaactgatcataaagccactaggcaaggcgatgtaatagatttcactggcgactgcccacactgccagactgaactaaatgaggtctgcattcacgtggttatcagtgtttaaaaataccccgagtgtagagtgtacacaacacaaaatgtcaggaacttgaaaagcaaaaatatgcatgtggtgttttccaaatctctctatagcccagcaactaaacaaacttaattatgtgaccaagcagcagctatttaacctctccagacctctgcttcctccgttataaagtgaaagagttgtggtatgtggtctctgagaattgttccagctctgagagtctctcttcaggccctggattcagatcaatagcttacattcacaaccaccctggaaggcaccgttaactcaaacgcacacttgaacttggcaggttcttactcactgagatctttgtggcataaagcaagcagccattgctcatctgcaaaggtttttttagtatattgggaagaaaaattatacttgagacttaattacaagtatcttcaaaaatccggcaagtaaacgaagtgtgtaaattacatgattaatttaaaagtagattattttcttcccctgatggcacacctggtatcaggtgctgagctgggtacagaggatatgaaagctgcacaggactcagatgttgaaggacttgcagcctgctgctagctcttacttagctccccagtgttgaacagctcctgccatgggtcatactagtctgacacagccagcactgttgcattggctggcagccacagcaacacaactgtttgtggttcctctccattgaacggtttttaataaatgcctttaagtgacacgaagagcctgaacatatcaggtttaggtaattagataccaggccaggttataagaagatgtcaagggcctaagatgtggctcagtgtggaatacagcaagtacaaggttcagggtttgatccctagtacttcagttagaaaaaataattaatcaagccagatcagtggcatatactacctacaatcccagcattctggaggctgaggtagcaatacaaattagaggctagcctgaactacacaatgagaccctgtctgaaacaaacaaacaaacaacaagcaagcaagcaagcaagcaaacaaacaaaccatatctgtagttatttctaggcattgtgtagtaacacctagctaagtttaaactctgataatattgcctctagctgtaacttggcaaagggccaacctgatatttctcccttcctacaaagagcttaccctgtaaaaggatcggtctaataaagacgataagggaaatgcttaacctacttaagacagaaacgagcctagaagactcaaggactcaagagactcagatttaaataaacaattgatacacacattctaaattcttctcatatattagagtagttccccaagggtgtttatttactaacagtttgaattgctcttgatacttctaaaatatatcacactcgatatatatttaccacgatacttcaattccaatttttctcaattcaggaagctttttccccaaattagtttgaattagggagcgtctattgtattcataaactcttcatctaaatggcagaaatggcgacgataacatccgtcttgggtttgctggaagtctgcagtttgacttccagtctgagactggggaagaatgaacatgagctgattaatggccattactgatttctcgcagctgtaacttatcggaatatgtatactctaatactgtacccatggtaattatctcattactatgaagtgtcacagaaacgcattatgcgaagtgagcgttgaatcacagttagcaatttcttttggatatgaagcctgaggagctttgtcacagctttgattggctgccatgcacccaggctggagtcccttggcagctctgtcacctggctccctttgtgaaacttttctgcacctcagtctctaatttgaaaatgggaagatttgtgtgtgaccagagagatggccgaaaagctagctgctcatctccaacaaaagcactgaggtaatactcagcctgcacagttgtcactctgactgcatcaatatttaatatagaatgagcaaggtcacataatattaagcagacatattcccccaacattgctaaaccaaagacatgacagttctggaaatgtggcttgggtggaagagtgcttatcttgtatgcatgaggccctggattggatacccagcacctcctaaagcaggcatggtataattcctacactcaagaggatcggaagttcaaggtcatccttagcaacagagtgagttcaaggccaggctgggttgcatgaaactctgtctaaaacacaaacaaaatgaaaacacaaacaaaatgaaaacccaaataaatggcaaacaaagcaggaccataaagtcatccatgcactggcacaagaaagccaaaactgatgataggccttgttctgtacatcatagtgtttgagcagggtggcaggtaaaaaacagttttctctcacttcagaagatgtggccccagaaaggagctggtgagtacttgattgtcacccatcaaacatataaggctgcctaaccaaagtaggcacatcatgggaaatggacaccattgcttagatgagagaagtcagcaaagacaagcaatgtatcaatgacagaccaaaggaaaacaccaggactgaggagatggcacagttggtaaaatgtttgacttacaagcatgagaattcaagtccaatacatcaggacacataaacaaagtcagctgtggtggtatgtacttggaaccccattaggggaagcagagatagggattcctggggtctctagccagactgcttccctatttgccagtcccagtgggggaaccttgaaaccctgcatttccatcatttgggaaatgattagacatgcagtttgtcagctattcccacactttctgaatccctaacctaactctccagatgttctcttagaagcagaactcattgtaaagagttatatgagaagatgacatgttttccatctgtcctgatgcctccatcagagatacttgtggtcacctgagctttttaaattctattaaattgccaggatgcacttggggaggcagaggcaggaggatctcagtgagtttgaggccagcctggtgtacatagtgagttccaggactgccagagtcacatagtgagactctgtcccccaaaaaacaaaacaaaacaaaagaaccaaacaaaaacaacaaaacaatttaattataaaaaagctccacatgcctagcatgaccacactgggcaacaaagctttagaacttgccagtggatcagtaaagggaaacagacggttctgattagagatcagagttgtgactcttgcatataagaaacctgcttggaaaagccagaagggcaaaagtcaccatgtatgtcatgaggtaaagtaaaggctttttcaggaaggcaattatgggtatacaggacaaaaaaggtcaacgggaaggagaggctggtgtgaacaaaagtacattagggttgggcaatccaggaggcctaccggaggtgtcttatgtataatccacttggaacaatactagcaacataaatttgtatatgtgtgtgtatgtcacgtgtatgcatacctgcagaggccagaagaggactccagaccccctggatctggagttataggtggttatgagccacctgacaacgggtttggtaacctgggtcctctggacccagcaaggattcttaaccactgagccacccctccaggattcttccatcttgcaatgccaaaagttcaagtccatagtcagctccccattctgccccaaccccagcctttaacatctggcctctatgatttagctgcactagctactgactagctagctaacagtaaatttgtctttcatgagtggaatattttactcattataatgtccttaaggttcatagatgtgatatcagaatttctttcctttttaaaactaatatttcacagtatgatgctttaaggtaaatgtttgcattttcctgcaatgttcctatgttgaaatcctaagctcctgggtgagaggcataagaaacgtggctttggggaggtcatatgggttctatttcatgagtaagattagtgccctgataaaggagaccccagagagcaccaccattccctctggcacgtgggacacggaaagaagacaattatctgattgaagacaggttctccctgggcggtgagtctacttgcactttgagttttgaacttgctagcttctaaaatcctgagaaatgcatttccattgtttatatgccaccagactgtggtattctgttatagtagcacgcgtggaccaaaacggattgcaaaggtctcactctgcttctccatttatctacggatggacatttgaccctttccctggggtcaacagagctgataacgaacacaggggaacaaatacccaaccaagaccccactttcattctttcaggtgaacactgagcagtgggattgctgggacatatggtaattctatttttaactttttttgagaaactgacataccgttttcctttgcaaatgtgccattgtgcatcccatggaggtctttgtttttgagataataaagaacagcacatcaaagctatcagaaagaacgattaaaagacaaatgtgggggagagggtctttggaaagggaaggaacagcacggcttgcagcttccattttctcagtgaccttggttcaaggtcatcactcccggaagcaagccataccatagaggaggagaacatgggagcttgccctacagcattggtccatcacaaggcaacaacacttcctgaaggttgacaacagacacagatccactgctgggggtgagctcctatcccataatacctcagaacatggctttttaaaaaaacgtggtctctgcagatgaaatcagttaggatgaagtcacaccggagtagaatgagccccaagccattacagcttgttcatcttagaagcaagtggtcatgtaaacacaagtgacacacaagtgaaacacaatgctacaggacagcagagtcagcaactgcaggatacagttacaagtcaagcgtgctagagtccactggcaaactccaggaggacaggaaggaatccatgactcttacaaaggagtcttacagggcgcttggccctggtcagtgcccggctttcccaacacccaggactgtgaggaaacacatttttagggttttctaacccacactgtgcaccttgttatggaagctccaggaattcatcaagccatggagcacaagtctgcagttggccaaggtcatcccatgtgaaggccaaaaagagcatttgcaaattactgttcgtctcacttatgagtaatatgttccccgacctccgtgataatctaggcagtaagtcaacataatacatactttgaattgcagtccttactgaaaggttttccttatgcccattccaggcagaacgggggcatgcacagaaacacactaaattctctgcttctaagaaccaatgaacagaaatctcagcacccaaagcatgcaagctgaggctatctatcaacagctgtcctgtttagatgctctgggtcttatttcacacacacccctctgaactataatcacaagtaggcctgactattgttccacctgtaaatgtcaaaaatctccctgattttcaaagttctatatatgtctgcttttgtgtactttgttctttatcccaagccccaataaggttttgttgttgtttggatactggatgtaacccaggcctcacctacgctaagtacatgcttttccatcctaagcactccaggaatatttgttgaaaagcagtcatatagttgttttctgatgtccacacttgtgtttcttggaaaaaactcagagataaagcaataattacggatggatgaagccatttaggaaaggctgctaggaaccaactcctggccagccctctgaggtaaatgtgcaatgctgatgagagctacggggtcaaggggccttgtggggtcagcattttcattgacttcagagtcagatgagggctgaagtccttcccaaggcctagcaggtgcggcctggatgcatggccccgctgctgctgatatagaagcagtgtagattatttggttaaacagcacaaccttgaacactggccaagtcaaagcacaaatccataacaaagtctttctcctgcagtccatttgctagccgccttctaaacaccactctagcttttgtaaaaattacctctattctagtgaaagacgaggcactacaaagtgccattgcagaaaaacaaaacaaacaacaacaaagctccgctcttccccccaaaaaacctctggacacaagaaaacaacagcaacaacaaaatgagtaacacattccttctctccctcccacatccccctcatatttaaaaaaaaaaagtatttagattttggcttttcatgaaagaaatttcttaaaagtatcagtgttcccaaattccaaagtaatttcacaaccataaagaaacgagggagggaatggtttcggcaaggccttcaaaacaatcaccctatgcttctatgtggagtatctttataaatgataaagggctttgcaaaaattaacccaccccttcaatggaaatgcccggaacattatttatgcactggggcctgtgtgagacacagggatgaagagatgagtaaggttgaatcacctgaaagaacttgttacagagggaagcaggtaatagtgttattcactgtaatgttcccaggcttccagtgcctgtgattttaattcataaggaaccatattgtgtgaggggggatagggagagtgagggaagaaggtagggtaagggagaggggaacgaccacagtaaatctcataaaggtggcagatcgctccggatactgctgccatctgagccgaggtctcttctgaactaagggcaaggaaagaggagacagcagaatgcctaacagaaccaaagctcagcgatcacaggacgcaacatgagggaaattcacagtggattggatgaggaaattatagatgggaccaaaatcaattaaaaaggaaaatgaaacaagctggaatgaagtcaaaagcatcctttcctccagaactgcccctgagtatcagctgcagagagacacggtttcacagacaaagagatccaagcctggcactaataccacaatttgcacatattttgggttcaattgagctgagccaatatgaataccaaactcaggtttacagatgtgactacaggcttgctttaaaccacaggctgagaagcaactacacatgtaataaatctgaaatcatccaatgaccttcagtcaactgggaggcttatatttaccccaaataagcatcagccttccctattacaaagatatgcaaatgactcccagactcccatgttgcagaatcattctgggtagttgatgactctggtctcaactgtcgaggagcaaggggaaggtttgagagagtgatcaggaaaacactacagctgtcagttggcaaaagcaatgcgttaacacagcctgcattaactgctaccggaatgtcagcattcaggaagaggggaaaaactcctctttggaaacagactctttttgcaaaattttctgagttaattaagccagttttcatattagcaaagagagatggccatgtctagtcaacatgcagtgactcagagagtgacaaggttagtgggcctgtgtctatttttaaatgttaatttcggatagtctcacagagcttgcataggcagtaagtgtctttcccattattatgttctactccagtacatattcaagggttagaccccaaatgttcctcccttccaaccattactgatggagatcaagggactgatagattcccacaaagaacgcttcatctcataggggtatatgtctatgccccaagtaccttgtcaagctggagtctaaatagcattggggtattctttgatctcccacatcaagggataaggcaccttgaatggagcatggttttaacttggataaatcctaacctcttcatcttaaatacatcatgtgtgttggggtggggggcaggctggtgagacagggaggagatgggtacagaattcctttggaatcaaactttggtgaacccctgaagtacggctgacagcaggtcagaaccaaactagccgtaactcagatgctcagcaatttgggctcttttcaagttatcatcagtcaatattttacaagagagacagagagaaagaacgaatatatgaattttgcatatacttggcaaagtaaagaacttttactcccacaccaatttctgaggtaagttaataagcatcatttattcaaataaggagcctggaactgagatagactaaataaactacccaaggtcacagagctagctctattgagttgagatttgaattccaaggtccatgcttcccatcataggcctctctacttgagagtggaatgaatttctcagtccccagtgaaagcatggctcctaagagagagcagaagtggagaacagcctgcctctgagcagcactccctcccaggacacaggaggaagagctatatataagtggattccctgtcaggatggacagttccgtcaggtgttcatatgacaattctacagttgtttcatttgcagaggtctaactaactgtacactggccactaatccagctagcccaatttcaaagagaatgatactgtacttggcaaactactcacgcaggccactgtggtgatggatcaggcagcactttctagggacatcactgtagagtcaccaacagaatcacacacttcccaggaattccaatcctctcaccagcatctggaaagctgtcacctttctagctcaccttagcctcaacccttaaaacccttaaaagtagacacaggccaaccaacacctcattgtcatcactgccaaaatccacactatgctggtcctaccttcacactgctatgccacgttctcttgttggtacctttaaatttcattaggctcttttcatggtttggagtgtatgtataaaggaggggacaacctcaggtaccctcgaccttgctttctgagataggccctgctggcctgactcaccactagccaaggctgactgtctagtgagtcccaggcatctgcagtttcagcactggaattataaatgtgtgctatcatgccttgcttttttttgtgttggttccagagactgaactcaggttctcatgcttttgagtcaaacaccttaccaactgagcattctttccaggctgaggtttggatcttaagtgtctcccaaagtcccaagtgcaaaaggcttgtttagcctgcctgtggcactactggaacctgaggaaatggggcttaatgggaagaagttaggaccctgggctgttgagactctggcccccacctctcctcttcctatttctcatatgatgagcagtttgtctgcagcatgcacgatgcaatgctgtaccatgccatcaaagcccggaacctcaggaccagggaaccatggactgaaacctccataagctgttctcctttgaggggacttttctaagttacgctatcatgatgcaagatgctgactaaatgagactgggctgatgtggccggtggtggtggaggcacagtgaggtcacagaaacaaaccacccaccaacacagcttatagatgtcactttcctccctggctagtagctcgactataaccttcaacattttccagagtgttctgaacaccctgtggatattctgccatagacactgagataataatgcagatgtaaagttttgagtgacacaatcagaattataaaatattggcacaggtgatttcttaaaatgaaggtttatacaaaaaaaatggacttcaggaactctgaaaactctgaaaagttgtatgtagagttttgctggtggtcttagaaagatggctcattggttaagagttttatgggtgtatttttttttcagaaagcaatccaaaactttcatcagattcttagtgtggctggtgagtctctgaaagtttcaaaacaagtctcctagagttagcaggaacaaacaagatttgctgggtacaactgtaaagttctgtggttaagtcaagaattgtctcagcaactttggtttccttcaagtcaactctcttgtaattgtaggttgcattaatgaatgcatgttctctcaatccagggagacaaatgaatgtgtgttctaccacggtggcttctgtgaggctgagctctgtatcaggagccatgaaaagccacccagggaacaatcacatgatggagaactgaaggagtctagggtattaaacctgagaaagagaagagggtatggttggttcctccttaaacagttgatgatccctaataggaaaagaacagggtttaacctgtgcaggtccagaatataaagtaagatcaggttgcctgtcagtggagaaaggatccatccccacaaggggaacttggaaacaaaacaacaacaaaagccctattagggagattcggccaccttctagggctaatgagcatcccgtctcttaacttttcctaccaagtttacacattcacctgccagggatttgcagaggttttcggggtttttttgtttgtttgttttgttttttattggtggaaggtaggagaaatgacctctacaattgcttcttaagctatgatccatctattaagttttcatatctcttattaacaattttagtcaaagatttgcaaatattttccaattgtggaatacttaaggcagatccctctaaaaagagaaaaatgactaagtgttgagttttccatattttgttaaaatgagatatacgtgggtgtggtcagtgtgcatgcctcccacttgtcgctcctctgagtttccattgtcttttctgaggtgaccctcctatcaaccacagttattgcactattcacctcaattcccaccctctccggtctaccctctacaataaccatcaagaaaaatatagaactgggcatggtggcacatacctttaatcccagcactagggaagcagagataggtggatctctgtgagttcaaggccagtctggtctctatagtgagtctcaggacagccagggaaacacagagaaacctgtctctaaaacaaaacaaaacaaaaaccaccctttcaaaagagagagagatagaaaaaaaagaatcagatcatgcctttctgcctaaatttccacagatttttttggttttcttgaagccaaatttgtcacatggcttagaagatgtcaggtgccctagtatctccaaactcatttggccccaccctccctataacattgcactcttgggaagatgacctctccttggctctccctacctctgcagttccctccatgtgttgaggagctggttcagctttccccaggaaggaagttgccctgttcaccccaattcactccctacctttctctaccacttcagtttcatcttgattgtaccacttgtcacaatttataatcatcttgctttgaattcctcccccttggaccatcctcttcctcataggagtgcagactcagtggcaacgaccttgtctgcttgactttcttctacatttgagtctcaggcagccagcatctgagtggtgtccaggaagtatttgggaatgaatgaatgaatgaatgaatgaatgaatgaatgagtaatctgtggatcagtgttttgggggtgtgtgtaaatgtgacttgtgttctcctaagtctgaagcatgaatatttactcagtcttcatccttatgaaagtgctatacatatcgcaagcccaagagaattttggaatgacccctaagaagctccttcaccaaacagaaattctaagatcagaaagaactctttcactggagaggggggggggagacactgacaacacctctggtttcctcctctggtttttccagagggtaaaatcctaaagggtcccgatttgaagatagtttgtcttttttccccccttgagggctttcataaaatattctggcagtaaggaacaagagattctgggacgggtgactgaggaggtgggagagactacttctctggatagctttaaaaatagagcagccatctgggatggtttagatacgcctctctgaaggcgggggaactggaggggaatgaaggatctaagtaccatctcatcttggattttctgatatttcattttggagttttattcatggcaaaagcctgagaggagctagaaattcactttttcttttcaaccaaacattaaatcccattttattttgagcggcaattctgctgtctcactagcccccattcttcagaagggcaatttggatgtcatgcattttttgtctcgtaggaagtttggatgaaagttaactttcactctctttcctagagacgcagcacaggagttaggatgggaggtgtgtttagatgttgggaactgatggctggggatgtgtaaatctctacttggtttttggccatgccagtggaaaggatagagcagacagaatctatacctaatggactgcctagcatcttgtgagctgtgctacatcccaaacctggacctgttgcaggaggctaagccctggaagccttgtttcattgtaactactgggtcttcctttcatttgtttgttgttggtttgatgaaattaatctcagtaaagtcaatatgcaaacaagtatattttctgacataaagccatttcctgaccttgttcccattattcttgcttattgcatcaaaacttcattgtcaaaagcttaatgtattgtaagacatagaaggtcatattttagcatttttaccatagagaccacactggggaaaaaaggggccttgtgaaatttgtttctcagcagtatttgcatgccctaactgctttttaaaaatccaaataaacttgattgtgcttatcaaatacattaattttaaaatgctcattacaggcacttttgtacataacaaactaacaaccagtgtgagccaagttatttatccccacaaaggaacacaaacagcttacaatgatgacattaacttttttgtctttttgaaagttaatgaataatccatattttagcagaaaattaacttaaaaagctggaacaatggctcagccgttaagagtattctctgcacttgtagaggacaagacctcagtttctagtacccatgtcagatggctcataattgccagctcccagggctctgacatcctcttctgacctcctagggtacctgcacacatatgtccgtatgcattcacatagatatacatttattaatgtaacattaataaataaatctttaaaaaaatcattgccttaaagcaagtccttcagggttttcacaaaccataattggaaacggatcttatcatgtcacatgatgtcaatcacacacctacatttatttcttcatctcctgattgttcttaggtcaagggttgagtgtctacctatgtgctcctctgtgcattgtgctagaaccagaacttcaatatcagagagtctaaggcagaaacaaagattccttgtgctggttattttctttgttttactcctttttttttttcctttatttttttgtcaatttgacacaagctggagtcaccttgaaggagggaacttcaactgagaaaatgcctccatcagactggcttgtaggcaagctaggggtatttgcttgattactgattgatggcaccaccactatgggtggtgccatccctggacaggttttattagaagaaggctgagcaagccagtaagcagggtttccctatggcctccgtttcagttcctgccttgagttcctgccctgacatcccttcatgatggactggaagaggtagataagattttcaaaagttttcccaagttgcttttggtcatggtgtttatcccagagatagaaagcaaactaggacactccagaccctaacactaaccctggaatgtaattcagttggtaaagcagttgtcaaacatgtctgagactctgtgttccttccgtagccttgcataaaccaggcatggtggtacatggtggaatcccagcactggggaggtggaggcatctttgggtacaaagcgagttctagtctactctgaaaccccatctcaaaacaaacaaagcaagtaagcaaacaaatgaaacctttcaaaaaacgaaaggcagaagtgaatagtctaaaagaatattaatgaaatgaatgactttaaggtgttttctgtcaaaatcgacagactgtttgttacactggaacatcttgttacacaatggcctcttgttaagggatggaggatgaggatatgtccacatggacatttaacagcagaatggaaggtcttcagggaccttgccctttgagatgcatggctccaacttcccatccctaaggctccagtcactgggggtgagtgctgggcaggagctgagctatctctggggtgggatacttaccccctcggtgagactggactgatttggacccagccatgtcagagcagaaaacaatgaagacaaaagcagaccttctgcctgctgtagaatcttctttgtctccacttacccaactgaggcaactgagaacacagctctcccactttctctggatgaaccctgatgctccctttcttctcccttttaatccagtttgcctctcatttctttctgaccatcaggagttcagcatacccccccccacacacacacagagtttccaggcttcaggatggcccggattgaggctggctgcaatgtgttgatttcaccagctccctctccccctccactctggctggcacactggaagctggccactttgtgtatttacaaaccacagttctctgtctgcctccctcccccaagcggcttgctgctgttactcctgtggggttttcctcacagccctccctcacgaatttaacaccaccactcccttggtgcaaaacaagcgtggggagcttgttggggcttgcaaaaagcaggggtgggggctgctttcctcgggtccgttcattgccaccgccaatgttaacagcaatctgtggggagatggcaattctaacataatgagatattaatgagttttgcacgtgtccctagccacaacacacttctagtcccctcccctttcaccttctcttctagaaaaccacagagaatgggctccatccttgacagcaggaattctatgtttctccttggggctcatcctgactggctccaataggggcctagccaccctgctcacctcaagccatcagcactacagaacaccaaatgggctggcatcgccttgtttcctggcctaatggatgcttgtttaaacaccggagctgtttgcattgctgcggctcactgcctgttaaacacagtcctctgaaaccctatgccaatccaataaaggtatcagcagttcagtgtggggaggcaattactatacagtcccaagtgtgccttctaagctctaggaaggaaaatgtgatcgaacaactaaaaggaaaatctgattcggctcagcatcacgtggaggacacaaggcttaactgcagccaggtctgcagagggcagagggaaatcaatcggctagcaagcaagcacacattgttaggcaagcactaagccagccggttagtaacactgtcccctgcgcttgccagaggcactgccagtccaagccttccgctccctttggcctgctagctcgctttgtcatcccaagggctacacttacttatattttaatgacaaactgtcatttttctgaacaccctgtatcttctctctcacctttaattccttaagcactcacataaaaatggcttttcttgtgcaagatcattaccatatcaaaggagtcagagagggagtaaaaatgatagaggggtaatacacacaggcaggcaggcagaagaagacaagcacgcttcagagaggcctcaggcccctcacctcgaactaatgatagcagtcaataaggcaatggatctgtgttctgcctcagctaaggctgaagtcaggggaattagacaccaggtttacgtgatttctctcccaagaagaagttttgggaaaatgaattctttcctgtgttacgaagttctgagcacagtgggaatgggttgctttcccctctgttccatttaaaaagctgctccaaaatggccctcctttctctaggaagagtgagaaacagcaatgcatgtgtctggcaacactggggaacgctatccacaatgctcactggggcgccatccatttcctaggaatctggccaaatccctgtctattccccaaggttcctggcacaggggacagagacatgatggagctgaagccttgtagtcagcatttgccaggcagctcctgcacatgggtgcgggggcggggtggggggggagctatgcctataacgggctccatgagcagcatggatttcccgtcatccctgttgtctcagtgctgggagcatggagggagctgggcccatgatggcactggcagtgttcagccgcactcagaatagcattcaatcctgcaggcttatggggctggcacactgacttcccagaatatcagccatgtaccttcactagctactgtttcttctgtgctggccttggacaaaactccagtcccatcccccagtttccagaagggtggtggtcacaggcagtaaagttccaccagacagacagcatgactctactgccactctggaagaagcatcagactctgtcactttctcttgtcactcaacagctatgacaactaattaaaaatggtcatcttcttgggggctggagagatggctcagaggttaagagcaccggctgctcttccagaggtcctgagttcaattcccagcaaccacggtggctcacaaccattcgttatgagatctggtgtcctcttctgatgtgcagatatacatggaagcagaatgttgtatacataataaataaaatctttaaaaaaaatgctcatcttcgacacctgtatctgtaaaccaccaatacatgttcttcatgatttcctgacttaacattcacagaacaccctctttattttaggcctggaaatataggtatggtgtacatgctgaaactacaaaaaaattatgatggatgtatttcttgtcctacctatggggaagagaaatgttctacttaaagagttctctctctctctctctctctctctctctcacacacacacacacacacacacatacacatcatcatcatcatcatcatctcaatattttatttaaatactttccttatttttgagattaaaatatgaatatattaaaatataatcatttccccttccctccaaagtctcccatgtacccctcttgttttctttcaaattcatagcctctgttttctttaattgttgttacacacacacacacacacacacacacacacacacacacacacattcctaaatacatgaacacaaccttctcagttgatacaatgttagttgtatatacatatccatgttttcagggctgaccatttggtatccttctcttgggaagactgtttctcccacttcagcagtcattggttgtctatagtttttgtctggagttgaggactcatggacattcattcctccatccacttttagcatgtccactgttatcctccttgtccagcttatgtttggccagtcatactggtgggactttatggatgtagcttttgatatttctaggagacacaatctcacagcaaactccctgatcctctggctctcacaatctttccacccctcttcctaaatgatgcctgagcctcacacgcaggagttgtgttgtagaggtatccactggaactgggctccacaactccgcattttgattagtggtggttttctgtagtgatctctgtctgttgcaaaaaaaggcttccttggtgaggggtgaagattacacttatatgtttagaccctggagaaggatccatcttaatattttaaagggcaacttacatgtgcatgtgcatgtgcgggcgtgcgtgcctgtgtgtgtgtgtttatgtatacatatatgtatatatatgctaagtttaaaacattaccatgtttatacacacacacacccttcctttttaataaattactcaaactaaactttaaaagcttctaagcctctgtgacaagaccttgctgcacccattctgttacttgcttggtttctctgcaggtagataattaactttttctcataacttactggtcataagttactggccttgttattggtgttatgcctgctgtttctttgtctaagggggaaaaggctagctatttgattaacagctacctttcttttttgtatgtatgcatgtattgtttttgcacaacaaccaatttcccctccctcttctcatcccagcctctccccccccccccccaccccccccccccccccccacacacactccatttctcttcagaacaggacaggcctcccatggacatcagccagccatggtatatcaagttgtagtgagactaggcacctcctctcctattaatgctgcttgaggcaacccagtaggaagaaagagtccccaaagcaggcaacagagtcaaagatagtccctgttctcactgttaggagtcccataagaagaccaagctacacaattgtgaaatatatgcacaggacttagaccagtcccatatagactccctgattgttggttcagtctctgtgaactcctgtaagcccaggttagtagtttttgtgtgttttcttgtggtgtccttgacccctctggctcctacaatcattcctcccttctgtaggattccccgagctctgcctaacgtttggctgtgggtctctgcatctgttttcatcaattgctgggaccattggtctaggcaccaatctatgagtatagcagaatatcattaggaatcacttcattgccttttttttttctatcatgtttgattctaccctaggtctctaggctatccagcctctgggtcctggctatccaggcagtgtccaggtgagctccctcttgtgcatgacatgggtctctagctggaccagtcattagttggccactcccacaatttctgtgccacctttaccccagcacatcttgtaggcaggacaaattgtaggtcaaaggtttttgtggttgggttggtgtcccaatctctccactggaagtcttgcctggttaagggagatggccagttcaggcttggtatccccctttgctaggagtcttagctgggtcaccctcatagattcccgagagtttccattgcactagctacctttcttaagaagagaactttgcaaaagatggtgaaacaatgtttttgtgagacttgctcttgaccctgttctgggacagtacttagctgtatttccaggatctggagtcagcagtggtgccagaactgatcctcaataatgtgtaatgctcctacctccactcagcagaataaacatgcttttatttctttctccagtgtttggtgcattgccttaaaaaaaaaaaaaagcagactccaaacttctttaaactgttttcttttctctcaaaccagagatagaaactcataacatctctgctcctataatgtcatcctactctcgagatagcaggtgagctgtaataaatcacaggaagaaatctactccacagctagagaagcatggtaaaaggaactgcttgggacccagggtgatgctgtggtgtaaatcctagcactgaaaggctgggacaggaggatcatggacttgaggccatcctgggctacctagtatgaatctgtctcaaaaaacaaaaaacacctgcaagcaagaaaacaaaccaaacagagagagtgattctgagatgttaaagcagaggcagtcacagaaggatatgtgacacactcctgtgaggctgaattttcaatgtgtgtaaagaactactttaaatatacagaatcatctctggaatccttaaatcttcacttctcatttacataaagatttctatttttctcatttgtcacatgttttttatttattttgagacatggtctctctctatgaagcctaaacttgctgtgtatctcaagctggcctcaacatcaagttcctcctgtctgtttctgctttccaagtgctgagattacatatgtgcaccactatgtcgggttcacacatgaggtttccctgtgtgcactctgaaatgtgtcattttgagttgagacttggtacctgtgatggttaatcttctgtgtcaatttgatgggatttagaacctggagggaagtctgacttcaggtatgtctatgagggtgttttggaatacccaccctaaacatgggtgacatcatcccaaggtctggggtcccagaatgaatgaaaaaggagaaagtacatggatggctatcattcatctctctcttctcttcactgtgaatgcaatgtgaccggatgtctcatgctcagctgccatgtcttctctgttatggtggctgtgagccaaaataaactgttccttctaaagttgcttttgtcaggtatttagtgacagcaattagaaaaataacatttgctggttggcctgtctagctaaatcagtgaatctatcttcaggtgcagagagagagagagagagagagagagagagagagagagagagatctgtctcagaaaacatgatgcatcatgattgacagtgacctctgatattgacctctattcccacaagtgcccggtgctcacctacacatacatcagcacacacatgcacccaaaatacaggtaaaaatgtaaaaggtgagttttgggattacactaaaagcataacttacgccatgggccctttgtaaagcattaaaggaatcaccttttctttaaccatcttcagaattaggtcagtcttgtgaaaatggggaggggaggaaagatctttgaatccttgcatttttaataaaataaagtggccgaaagaagggaaaaagcattactcctaaatccatgaaaattaaaaaaaaatcatgaagaatggtaagaatgagccacatgctgccccttcattctcgctatggatgaacatctaattttaggtacttgtctggttcagatggacaagatatactctacttttctgtatacttgaacattttcaaaatgaaaaaactctcttcaaaagtatgatggctatggaaaagaagatgcctaagggtggaggaagccatacatcacagtccagtccattaagatggagagccctgagcagccaatctgaaagttgcaatgtgaggagaagaggagcacgatgcatagaagatgggccatggtccaacccagaaggcatcacaggatgccagggaggcctaagacgacagcgctcagctggttaagtcctgatctcagaagaggactagcagaaccagtttcacttgaaaaacaaaacagccactgacagtgtaagaaatatggttttttatcaagcccacagaaaggacttctttcataggggctcggctctacatctcgaagtgagtgggaacacaggatagaagacaaaggaaaggatactaagtgagaaggataaagacaaaatgtgagtgcttggctttcttagaaggtagattgggtcttctttggttaaagaaatacactattaattacctgtagttcctcttcaaaacaattttgtaaattgtaccttttttttactaacaaaaaaaatgtgcaaaacagcccaaaagctctttttgtccttcaggcaagtttctctaatgccatcttacataaccatggtccaattttcaggaacaggagattaactttcacacatattattaattaatctatagaccttaatagaattctactctactttccatcattttctgtcgtgggtgccctactcaggattctcccacagtgccttattgattttattctccccagtctcttcctgcctgcagaaattccccagtctcagtgggctggtgcagtattcttttcacatgtggaaggagcttttgcatttttagaaaggccactgtaaagtgatgttgcatccccctcggtgtatcacattgaaggatgcgtgatgccaatgtgccttttgctttgatgcttctcaagccttgggctaaatggtcgtgcactggtaaccctgctataaagtcaccgtcctttccttttgtggccaatcatatcttcaggaaggtgtgttgagactgtttgtgtccgatttctccttacaccactgtccacttgttgtgtgtgcatcttggttcttatgatgtttcatgcctcatggagaacctgtttcttgtgatgctagttattattttgagttctacttaggaaagagttgatccttcctcctttgtaaaattatttatatcagcatgcatgctgagtatttatttgctcttatggtttacaactcaatgctgccattttttccctttggtagggaaaggggggctgggattggacccagggtctcatataaacaaggatggcaaagccagcccttgggttttgagacagggtcttctatatatgtcaccgttgcctcaaagtcactatgcacctgcctcatcctcttaatgctaagattataggtgtgtgccaccatactcacacagaagcactaaatttccagtagggttgaaaactactaaaaagcaaacatttgtagatggttatacaatgtaatttactcatggtagtgatcagccactgctactgagttatcgcttagtgctctcttctgggacacttggtagacagcatttgactaggaattgtccacattttatccattatcactcaacacctattaaaacacccatgaagcttgagccagtaagtagttttagaacatctaggttagcaccaagcattgcaacaactttattaatgtagatgcaattgtttgtcttaggggacagctaaaactgaaatacacttagtgtccgtacaaccatcaacagcatgttactcagtgtctcatttacaggcaatggctagactgcttggagaatattcatttttcaaattcaagaagcaaccaagagttgactgctatgtcgcaggccacgtttatgatgttattattgggcatacaagcaaaatgtgggccgaggacatacctcaggtggtacagtgattgtctagcatgcactaagacctaggttagattcccagtactatacaccacagtcctagtgctcaggaggtggagacagaaggatccagagtgagatcatcctccactatatggtgagtttgagaccagcctggaatacatgagattcttacacacacacacacacacagagagagagagagagagagagagagcgcaaagggctctgtttttctttgcattcagccatgctgacaggcaataggaaaggcacatgtgtgggccaagagatagtagtttttttgtttttgtttgtttgtttgtttgtttgttttgttttgttttgtttttcgagacagggtttctctgtgtagctttggagcctatcctggcactcgctctggagaccaggctggcctcgaactcacagagatccacctgcctctgcctcccaagtgctgggattaaagtcgtgcgctaccaacacccagcaatagtttttatatattaggatggataactttggagacatagacctgttgggaaatccagcatggatggacagccctgcccagtcagggaacccagacagggacaggctggatccacaaatgtcctccctgtccttcatataggtgagcaagcttcaagccttatttcagacaaagtgtcccttgctacccaaggctctctccaagtgaagctcctgaaatggttctaacaacagaattttttttccaccaaaatcagatcattgcaatcgtcagcaaagaaaatgacatgtaattgaattatgctcttcaggatatgaaagtaccacgtggaagatggaggctggctactctttttcttcaggggagtccaaagggccacagtggagaacaggtctccacccacaaaaagaaaacctttgggatcagcaaagttgttcactgtcagaatcattcccaggcagattgtgaagatgaacttctatggcgaactcatagagagactgaggaaggctgtccccatctcagcagcaccaagacatgctgaggctgggaaataaccctgcctagggacagctgagcagctgtgttgtccgggaaggagccccctagttaagaagttgccctactaggaatcacacttgaaagttagggaagcagggtcggcaggatggagggcaaacctcacgtgaagcacactgatgggacagttaggagcaaagctaccaatggctgaagatacatcttcactgcactgtcctcatcgctgcagcaagacactcgtcccagccccctagtggccactgtgtgtaaagaggaagagtccccccttccttccttccttccttccttccttccttccttccttccttccttccttcctcccttccttccttctttccttcctnnnnnnnnnnnnnnnnnncccccccccccccccccccccccccccccctctctccctctctccctctctctctctctctctctctctctctctctctctctctctctcattttttgagacaaatttctctatgttgccttggctctcctgtgtagatcaacaggcctccaactcaagagatccgcctgtctctatctcccgagtgtcagtattaaaggtgtacaacaccacctcccggagcacctagtggatagtcttgctttcttcacaagtttttctttgtgtccttggggtgcatatgtatgtgggtgcacatacatatggaggccagaggtcaacctgagtggataccttcctcagtcacttctctatcttaattatttagcttaaaacatttttacttattattactgtgtggtggtggtggtggtggtggtggtggtggtggtggtgtgtgtgtgtgtgtgtgtgtgtgtgtgtgtgtgtgtgtgcatgtgcgcacatatgtgccatggtgcacatgtggaattcagtggacacctgtagaccaggttctcttcttccatctgcatgtagatctggaggttgaactcaggtcatccagcctgcatctctacccaactgagccatcttatactcctaccacagggtccctcagtgactctagaactcatgactgccagccccagggatcctcctgtctgtacctctctagtgtagggattacagccaagtaccacctagcctcactatgtggattctggagatccaaacattcttgtggaccaagcactttacccaccaagccaccgtccgagcccctcacacactctctctcttgtgtagctggggaatgatgtgaccctagatctttgtttattaatcacattttagtgtgctgacttgttagactaccatgttatcaactgaatcgtcgatgattttctttgcttctggtcatgaaactgaaggttctattactttctcagtaggccagtaggcagtgtgaattgtgagtggtaatatatctacagtatcatgttcaatttcacaaaaaaaggcagaaaatatggaggagagtgaggagaaaggtgggtcccaccttcttttatctccttcggtgagtgaggtcctggagctgtgtcctcaattctaacacagactctccaaggtcaacaggacacaattaagaatcttaatgatggggctggagagatggctcagaggttaaggacactaactattcttccagaggtcctgagttcagttcccagcaaccacatggtggctcacaaccatctgtaatgagatatagtgtcctcttctgttgtgtaggcatacatggaggcagaatgttgtaagcataaaaaataaatctttaaaaaaaatcttattggtgccagaagagctttaaactaagctggagtactaggtgccatgtgtccttgccactgtgcagtggggctcctttctttttggtgtctgtgccctgctcccttggctatctcttctaagctctcactgggtgagagatgggtcacccatctccttccactgaaactatcactcgcttttcttcccagtgtggactgcctagaacagcaagtgcatatcaaacgcttttgtgtcctttgttcttataatctaacaggcattttacgcttcaacatgatgcctgatgctcttgaacgtcctaagtccctctgtcagttttctacatccaggttcctgaacacttactgagtcaatgaaacatctatcctttctcaaaggaacagcagctccttcggcctatccttactgcgtctaagcacctggccatgctcccaccagtctctcccagcatgcctattgctgcaatagccttctggagggtgagaccactagcgaaaatgtcctgatttgcatactagtttaaatagtggttctgcctgctcttctttgtctacatttagatgggaaagacactcattcgtctctcttggaagtttttaattgtgtatgtgtgtgtagtgtacaacttgtaagaactggttttctaccatgtaggtctcaaggattgaactcaagctgtcagaccaggaaatacacatctttactccctaagccttttggcaggcccattcttctctcatcacggggtgctaatctagctttcttctgttctcacattttgactatttggtgtatatattagttttccactggtttatgaatttttgttagcttgatgtgcttgctcacgcgcacacacacacacacacacacacacacacacacacacatttctcactaatttgcactattagaaaatggcggtatgttataatatgagaaacaatgagagcgtactttaagagaaatgaagtcctattgatctcaggaccaggcaagctaaggttagctcaatgttgcttagttaacaggtacttggagccagttaagtgcttaataactagataaggcttatttgtaattagcatattgattgttgacatgtgagtgcttctaaagtgctggaggggagctgaaaatggcttgtcaggctttgtttcaaatagcctcttacaggccatttatttcaataaaatcaacactgttttctagccatggtcattgctgaacaaggaaacatccaccaaagtttccaagtaagtatagttaaataatgatccttgttcctagtacaatgttaccaaagacccccttaaaggagttcatctgactgaccagccattgaaagatgtgatgctcaaggacagagtctggttcagtcagtgaagagaatagcccccatacactcatgcatttgaatgcttggtcctcactgggtggaactttttgggaagaactaggaggtgtggccttgttgaaggaggtatgtcactgggctttgagggtttcaaaagctcatgttattcccagttatctctgcctcctccttggggataaggatataagctctcagctaatgctccagcactatgcatgcctgcctgttgccaagctgcccagcatgatggaatggactctgaccctcagagactgtaaggtctctttcttctataagttgtataggtcatggtttctctttaaggctacagaaaagtgctaagtaactaaaacagtcagctttgacccaaaggaaagaagtctttgcccataactggtggaatgtggttattctcttaagatggcaccatggcaggttgggtaggagtcaacactgctgaaggacagtgggaaaccaaacgatggcaaaggcctgtggtctcactgaagcaaaagtgcttgggagagcagtttgctcttcggcttctgaaatgtattggaaacagagactcagatgtaagtttcactgacagtagaacttacaggtcactgaagacccaagggcaggtgggtgagtcctaagtgccaacacctaaggaccttactgtgaggaaccagagatgatgaaacagaaagaacaaagaagggaagactacagaagagaaagggagaggaaacaagaagggggaaaggacagaggaagatggggtggatggaggcacgataggacagaggataaggcaactgtgactgaccctgaggaggatgcagtttgaccctggagactccctttttggccttttctactctggctcagcttataatcctccttcagagtgaccctctctgtccttggagctgagctaagctgagcatgtccttgctactgcttaggaacctcctggtgtactctaaccatccttctaaaaagataaggcaggtgtgcagggctgtgcatgtggcaggatagagacaccacatgcaacactgcgaaatctgtctgccaagacggacaaacctcctgaaatgcttctagactttgagacagaacacaaaagtccccagcctgccaggatccccaaggccctacatccttacagtgaagaaagctgtcagtcatggactgccttgacccgatgccagtgacagcacgagacgcatcacactcctgtaaagttctctgtcaggacagctctccttgctgcatatttatgtaatccaattggccaatcaaacttcaaggctaatgaatgattactgtaacagacagctcttgaccagcactgcctttccactttccgaggtcagcctagagctgtgtctgcaaacaggatcagcagggaggaggaaacctggggaggacatgctcatgtgtgagcaagtgtgcagtgagtgtgtgaacatgtgcgtgctagtgtgcatatggaaatgtgtgtgagtacataagcctgagcatattggaaaattgtgttagttgtcatctatgtgtaccaatgtatgagtagatttgaacacatgctaattgtgtactgggcaaacagatatgccatgtttatatgctaatgtatgcctgggtatgtactcatgagtgtatcagaatgtgtgtgaatgtgtgtctgtgtggcttgagtgtatctgagtacagtgagtatatatgaatatgtatgtgagtgtgtaaatatatacggctaagtgtatgaatatatgtgactatatgtgaatgggtgaacatgactgtgtctgtttgaggggaagggacaagagcaaattaaaaggcacagcctgggaaggttgtgagactgtcttccctcagctggagatccaggctcctgtgcaggaaaagagcgagcctttttctgaatgttacagagctttgctacccatcagagagcagaagctgttgtctccaaatggccttcatccttctcccaagaggagagccaggaagactgccactcatatgccaatactttctacacacaccactggtcaaaaaggagccatggatgccctccaccctgactcaaaagtatgcccagcttggagacctcagtttccacaggggaagaatctcaggggttggaaaaccagagcagagcatttcccctaaatgtcagggaaatactctgggccacgactgttgttttttcaaacctgtttgctccccctccactctgtacctacacagaaagcaagactctctgactgcagcgagaaaataaagcccaaggcacacagtaattttctgcttgttgaatcttgtgcctggtttgtttcaataaagccaggtttctgtggcatcacctggccaatctttagagcaggcacttctgagagagagtggagtggtgtttagcacaagatctctgctttgccagctactcaatgtcatgggcaacatactgctgtcagcatccactcaattagaaggtattaatcatctctttactgctgtactctggtactgtcaccccctccctcagagagacactgtgtcagccgacttctgcaatgcagtcatccgcgtggcaaccacaaaaccacatctttttatttatttatttttctcggactgatattctattaatccttagaagtttattagttctgactcataacagtccatcagctataagtgcaataaatgatgcttggaaattaatacccgcatttcggcaaaggaggtttttacatattaaattatccttaaggttataaataaataacatgtgaaatagatttaagcaataaacatatatttggcaaacaatcttcagtaagtttaatattctgcaagctagagctattttggcaatatctttttaataggctctccactccccgccttgcttttcttccctggtaaaatcataaatccatcatatcaaatattggagccgttcctttctcaggaaaactagggcttcttgtaatgcttcttctaaatgcttcatcttccccatattgtgttttattatttattttttgacttttgttcttgttgagtgacttagggcttttgttcttaatttaaatttttaaaagttttatttttacacgttctgttatttggtgttttcctagctttcttcgagtatgtttggcaaataaaactgtatatatttaaggtatgaagcatgatgtttgatccatgtgcacatttcaaaatgatcaccacaatcaagttactaaacatatcgatagcttcacacacttgccctttgtgtgtgtggtgagagcccttgagatccactcttggggactggagagctagctcagaggtaagtgttcggctcttctgagggacctgagtttgtttctctgcatatacaatggttgcctcacaacttcctgtaactccaattcattggggatctgaccttctagcctctgagggcacccacactcaagtacacacatacacacacacacacacacacacacacacacacacaggagagaaagacagacagatatacagagagaggctgagagacaaaaagactaagttattaaaaataaaattttaaaaaatccactgtcttgtcagtttttaagtataagtacaattgactatacttaccatgttatacattagattttcagaatttacttatcttgtaagctgaaagtttatactgtttgacacctccctattttcccagcactagctcctggaaatgactattctactgtctgctcctgtaagtgcacatttttaaattccctgtgtaagtgagatcatgaatcatgaagtgtttgtctttctgtgtctagtttattttgctctcatcattgtcctccagctttgtctgtattattgcaaaaaaaaaatgctgaatcgtgtgtgtgtgtgtgtgtgtgtgtgtgtgtgtgtgtgtgtgtgtgtgtgtgtgtgtgtgcgctacttcacttagtagatgattagactgataccacttcttgaccattgtgagcagggcttcgataaaccaaggagggacagacatctctttgagatactgactttgtatcctttggatatacattccaaagtaggattgctacattgtgtcatagctccgtttttaatttctttgagaaccctccacatggttatccataatggctgtactaatctacattcccatcaatgtcacttaaaaaaatctaattcagaaaaatgtctgagatatgttcccacctcctcttctttttctcctatccatcaatgaaaccacttcatcggcttttagaaagggaatcttacttagattttgagtttttaaaatactgaaaacattagaaagttgtattggggggcggggaggctggctcaggagccaggaggtttgtttgtttgtttgctatattatgaaaggagggagagaacagtttctacagatatcaaagaattacatcacagttttatccaaaataaatcagaaaaaacctgtttattatgcttttgtttatcctatgagaacaagaaaggcacagtatatagtattgtttgtcaaagctatatttcttattatattaattctctaaaagattcatccaaaagttttatagtgatattctttttttcagtactgaattaaatctgtataattttatcacatttagcccctcatgaaaatgcaattatcaaacccttgtttcatataactaaatactttattcattattaaccccactcacagacttaatgtacaaaaaggaaacgccacaagattcatgtcagtggcaatttaaagtgaattagggttaacgatgaaggtctgatctactctagtctgatataaataaataacacacaggcaatagacttaagtgataaacatatactcaagtcatgagatccatcaaggggcctttctattgcttaacatcacaggcaaccaaagctgggattcagattttcacccacacctccgcttttgtctttggtcccatcttaatgtgtcagtgccttctgtgcacagacatgctctctacttacagctgcagagagctgggtccataaattacatcacaactgcctgtctgcacacaaatcccaaactcagaaatgtcacacgtcacacagatcaagttgcatggctgtccgatctctatccctgctggatgatggggctggagagatgagagctagtttagatactgcaaacctagagttctgtgtttctcctagtggcagcatgcatgtatgtgctcatatccctaccatgcctggtaacaatagggctaagtgtagccccagcatcaaggctgaccaaatacaatgacgtgtccttaagaaatgacagcaaacattagagctccctttagttttgggtaagggattactgcagatctggggcctcagtagcaagaaattgtctaacgagtgggttgagtctaatgaccacatatacagtatcgttattggcttgcagcaaaggacactaaattacagtcacaatgtgatttgctcaggtcacacagactcatatcagggtctactttgcactagaaatgcttctgacactaattcaagtcaggctaccagaacagaatactcaaacaatcaggaaatataatggtgttctaatacatgcattcatattggattagccagggatatgtgtacacacttagattactaacactcttggtaaacaagggcaaagcctgtctccaaactaagggatttccatatatagacattcatatgtattcaccataaaatagtggatttccttttgtttcaagggctccccaatggctcaagacaaaaacataaatcaaaaacgaactcatctttttcttgaaaaaaaaaaaaaacaagatatatactatacacattatgtgaaaacaataagactaaatttgatggtctgtattatccacagtgttgagccaatctatcaacatgtttagatatataaatccaataaataccataatctctaagtaactcactggcttaccaaactgggtggaatcatttcactggtctcttgttggtgccctatcttggatgaagagacagttaattgttcaaattttgttctacccaggaaacgtcaacaacacaattataaattgctggatgacaaatacccctgatatctctgagtaaggcaacatatagggctctgtgtgtgtgtgtgtgtgtgtgtgtgtgtgtgtgtgtgtgtgtgtgtgtgtgtaagagagaggggagctttattacaattttgtatgtgtggtatgtggcgggggttggggttggggtgagtgtgccatggaattcatgtggaggtcagagaacaactttgtggagccagtcctttcctttccttctcccttaaggtggttcccaggaatgaactcaggttgtcaagcttgcagaagcgcccttacctgctaagccatcttgcctcccctcaacaggtatttttggagtgaagtaaagatctatctggcaaaaggtatgctagtattctgattccccagtctctacacacttctctgctgcaatggttgggtggtttgtagcatccttacagtcacctgcccctctctactacgacatggctccttctccccattctttccttagtttcacttgccgagagtagctccacttgggttgctgccactttctttctccatatgcatgccaccttatgtgtgtgtggcgtctgagttacacctaaagctttactagaatggttagagtgggccctctctcctcgccaactttgtgacttcaaacatggcacttgctctaagtattcttcctcacctatacagagggtactaattcagttctgtgatgactgcagagacaggaaactcaccgggtctgcagaaggcactcaataaatactgtcagatattgtttatttcagaccagggtgccaaggggatcccagggtttccgaaagctgcgtaagttatcttagaatccttatacatattttcaagacttggcctccttttggggacccacttgcttttccctgggaacactagatttctggatgctttcttcagtagccatctacttatcccccctcacacaccacttctcactaagagcacagtgcaggtcagattttatctcactctgcatcaatacacagagagactatggaagatgctgctgtcaggactgagtgtgatggcacatatctgtaactccagcccttagaaggctgaggcggacggatttttgagttcaaagccagcctgagtcacacagggagtccctatctttaacaacaacaacaaaaatgtattaccaggaattggttcaattcctagactttgttattaatgatattgttctgcgatctatgttaaatatagatcatgggtgatgctgacgaattggctggctctcacatttgggttagttcattttatgctcacaccattataaattacagtgttctccacccctactatgtagatttggtttaggatttcattatgatgactgatactctcccgttttcataaaaaacatgctggctttttaattttgctttctatttctaggttagctgtacattattgacaacttaggctgtccagattataggatttggcaatatgttatatttagaatacatttgaaagttcttttcagagaagatgatttttttttcctagtcttagttgctatgtatgtgttagaccttggtcttctcacataattatgaagattttgcaaaacgacccactgacctatgaatgtgtatgattgtaattctctaaaataaagtcatggacaggatggggcaggaagagacaggctgaggcttaggtacaaatcctccaatagtacttagcgtgtttgctaaatgttctccccatgtgttgggctgtagctgaagcctcgtacacaactgatcctaggacagcagctgatcatcagaattcgttttgttgctatagtagtactgagctgccggggaggattctgggagcaaagaggccagacatcatctgtgtacacttgcctgtatgggtgtgaatgtatggtgtgtgtgtgtgtgcttttagaggggttgatacatgctaaactctctctctctctctctctctctctctctctctctctctctgtgtgtgtgtgtgtgtgtgtgtgtgtgtgtgtgtgtgtgtgtgtgtgtttagaggggctgatacatgctaaaccctgttaggagctgtgaatctcagtccctagaccttttggtttagtactatatataactgaatgaatgacccaatattcttcatgttagaaacctttaatgctgaaacaacctagagatttcactatattcactgttggtcaagcactatgagatgtggaaagccaataaccatgctatctatgtataggacctgttctgaaggctgctgaggacagggatggggctcagcagtttcccattcttggctctcctgctgacatgccatggcctggaacttttctaatcactaagttctaggattaacctagacatagcactgtccaaaagaatcagagcagtcatcttgtccatgtcattaccatgtggccatggtctaaagtcactgctccccaccaaccttaggcttttagttaaattgctcaccagaaaaattatttgaaacaattcccaacatatgatttcattattgtttttgttaccaaagtatgtcatcattgtacagtcctccactataaacttcagaaaactcaagaatatagttttccatgtaaagaaactctacattaaatgtgtaaactatatagacacaggcaacattaggaaatggaaccgtcatttggtcattttcatctccaaagctaaataaagcaggtattggtgaaataacaaagagacaaaagattttcagctttttaggttaatttaggcaagctttgtttgggatggggtgggggtggggagactgtgctgaaaaataatgactgaaactcaaaacaacagatacatcactgcaaaagtaaatgtttacatatgcatatttgcatttcagacctttttcagtaaggacatgtaaaagtacatgattttttagcaaatgtataaatcagcatttattttatttctagatgagaaatatgagttgaaaaaaatgcaaaagaatgtctcaccacaggtttaaaacaaacaacaaaaagcttcctaaatgaaaaactaagttgcacaatggtgttttgaagagtgtctctctgctaactgtgatcacaagacttcacagggctgagagctgcttctcttgtagagagaagggcaaaataatcatggtgttacctacatgtgtgaaagaaggtacttctggagacaggcagggtcagcaggaaggaatcaagaagagatcctgcccttatggaatgggcagaggctggaaaaggaaaagattcaggctttggaagtagagagaagcgaagctgtaatcggagccctgggaggccaccagccaagggaggcaggccctgtgaggctgctggcggattaaagcgataagcctgcggtagcattcctggaattctaggtggtgaccagctctgcttgctagggactgcatgtgcaggatcattctgtctaaaaccgaaatgttaagaacaagggtagattttgcttttaaaacatttgtttttatagtatgtgtgtgggtattttgtctgcatgtgtatctgtataccatgtgcataccagctacccaaggaggccaggaaagagcatcagaccctctggaactagagtaacaatgattgtgagctgccatgtgggtgctgggaattgaacctgggtcctcaggaagagcagccattgttcttaactgcagaaacatctctctagcccaagagctgaattcttttcctgaatctctcaacttagattcagtaactgcacacaatgaagacattcttatgcaggtgacagattcggacaatcttttggttatccattgcagaaaacatgggatatgacttggtgtggttgtaagtacagagtcatttttcaaaagacgtttccactttccctacctttcagtgcccagtactgaaacagtttctaggagattgtgctttggggttcccctactctcctcgccttttggtgtatgcatgccagcaaacccggactcaggtggtttctctttgttttgttcttttgaggcagggtctcctgacctggaactcacttatttgcctttggccaggtaagccccagagggccctctgtctctgcatcctggtgttacaggcaggccagtttgcttgctttggaaatgtggattctgggagtggaatttagttctgcttgcaagcactttacctcctgggctatctctctagccctaagacttactcttaactctaaggttttattttgatgttaggggctgctgactgcttggtgtcaattcctctttttaaatagcggtgcattcatcaacactagaagctaactacagccaaggcagcatgtcccacagcactctgtagtctttctacacatcacttaaccaaagatacttaaatgtcaacaaaccctccaactaattttcagcgaagttcatagacttcactgattttaaacagcccctcagaagacatatttaataaacatttgtctaattcatactttcccacaattgataaaagaactgattgagactgtagttctcccaagttctggcttaaccagcacaggttcctctttctgcctgtgtaaaatgtcataggaaaccatgaatccaaccaggagtttttagtcactatgtgaaccagatgggaaaggacgaaggtgctgcctgggagcaaacagccttctcagggccccagggcaccactcctaatagatgtgtgtgcagctcacatcccagccctgatcagctacatcccatttcagtactaggtatctttgaatggaaacatgttgagtttctccacatggcatgatgggagaatcagaatgggaaacattaataaaccttacacacactttttccccacaaagcatgagctggaaacagttatctttctttgttccaccttgatttctttggagttagccattcaagacagacagtactgaaaatatgcctcatgtaaggtgtggtaaattcttacgtgcagaagctaacacatctatatctatatcgataataaaaattgtttttgaaagcaaagggtttattaattatctcaacacaccatctaggctgattctttcagacgcagggaatgtgggctttagcaaattttcacggttgataggaaggactcaaggccagacccgaatacttttcagtctgtgtaatgagcctggtgatccgagtcatctcaatgcagtaacttctcagaagctaaacatacaggggtgtgtaagttcacaaaagcaactcctgaagactcatgtggtaactatcccacatatagctgctggctctgggactagcataatgaataataactgattgtttctctatttggtaagtgtatagtaagtatatgcgcacgtgtgtgcagctatgtgtgctcaagcatatgtggggaagtcagaagatgacaccctgcgccatcattgtccatcaaactgccttgagacatggtctctcactgaactaggagcaaagctggtggatagtcatcccagcaatccgttatccctcacccccaccaccaaactcatgacatactcagctctttccacaggttttgaagatttgaacttgggtcctcaagcttgctcagcaagagctcttacccattgaaccatttctccagcccctaattagtgatgttttaaaaatataggtttttactctggaaaaaaatatttccaaaagaattagtacattatttaagcaaaatcaaaatgaaagccttctacacatcctagatggcattctaggttctatattccatcaactcctgatctgatgttccaaaagggaaatgaaaatggcacacaaacttctccagacattgatatgtacatctctctctctctctctctccctctctctctctctctctctctctcacacacacacacacacacacataactctcagccacactcagaaactttctcacacactttctcacacacactctcactcatatatacacactcttgcatacacactaactcacacaaacacactctctgacacacatactcagaaactcacttactcaactctctctcttaacacacacacacacacacacacacacacacacacacacactttacaaaagaaaattttcaacacactataattcagttcatttcctgagggaaagctctacgttttattctaaatatagaggaggcctctgtcgtgttcagcctcttgtattggtttgtttttaacattagtcatgaatatggcagtggctcttttgcataaaaatcatcatttctgaagatacatacataggaggtgtggaaatggggcacatatacgccccacacacacataccttggaatagattttcttaaaatctttggtccatttgtggctgccttggctttctgaatccctaaaccaacttcttttaaatggtctgtctcattgctttccaggtcatgcagtatagtttgctacacagcccacttactagacttccacattctataaggctgcctccctctccccagtgatgatgcttttaagacaagctatacacaccaggatgtcctgctctgtgcagtactgaagtattgtcatgaaaacaacaaattcccaggcatgttggcttagcctcagtgtcatttaatagaagtagcagaacctcatcttgccaaccacctagaggtctctagtaggaagtagggctaattttaatatatgaggctaaaagatgctccttacaaagtagcttaaaatgtttggcatttcgtattcctgctatttgagaccctgtaactgctacttaccaggaacaaattaatctaagctttagccccctcaaatacagaattataattatgctgcatttcattggattattttgaagattaaaggtgattatgcatgcatttatgtgtatatataaatacacaaacacatcctatagtgcctggcatgtagaaaaactcaaagctaactattaatattttagggataggatttttatcacaatagacactactagaaaattccccaactatttaaaagatcaatgagatgcacaggaggcaaacacactcctgatcagcctttctcctctagcccatatccttcacttgaccagtgagaacaattgatgggccttaacagaaaacatttcggctttcaattaactgcttggaaaagcactaaaaactgtattcaactgctctcgggcaattagaccatgaccattgccacatctgctatttgctcatcaggaagctgcttccaagacatttaacattcataggtatattagctcattattaataccctagaaactccccatggcacggttaactacggtgcaggatttggtatataagaaggctccatcctggctcccattcatctaagaggattatgaatggagtctccctaacgttataaactgatcttaaacatgtaaggaattatagtaaagctctgaggtataaaagtttttccagaaactgcttttccaccatcacaactctctacttatattttatttcattgtcatagcaaatgcttacacagaactgtgtagaaaacactttgatgcaatgaatctgcacaagatcatacaagggagaaactatgcctgccaccctttgtatgtgtgaggaggctgaggcactagatagataatgcaatagcagagtcacagctcagacttggagacaggtggtagcatcttggggataaacttttacatagggctcccactttgtgtatctgatgccattctgcaagtccccaggtagggactgaaatccattcctctcggcccttatcagagggtgccattatcaggattgagttcctactgtttcaggtctccctgtacttgtcttctgacatcaaggtagaataaaaaaaaaaaagaccatttccaatgaatacccattatatcagagattatgccacacgtgtcacaagaaagccagccagtctgtcactgagacagactggtccattacacaacctttatacccaagacatttccaatgtttgacctatgtgaattttactaaaatgttccactttcaatgtacaaatttatatttgtaaattgtttgataaaatgtatcatacgatagcctaaaaatatcaattcaaaatcaccttgattactgactggggagatagtctcctgaattcttcagggagggctcatcttttatatcaacctggccagtctacagagcccagtagttggggccaatactaatttaatcttgtcatagttgtatgtctataatcatagcagctaggagactaacaggggactatatagcaagtttgaggccagcctgagtgaagtctgaaaacctatttccaaaaacaaaaccaaacaaatgaagacaaagcaacatccaaaaattaacatcctaaatatcaactaaaacaaaacaaaacaaaaatcttctaatgcaggtgttgtgaaagttattttctagacattatcaacatttacatcagcatctgtcatgcccattcttttggccctgcaatacaaccatttcatctgcaaaatttaggcttgcaaacttcgtttgtaataagtctacaattttgtgtcaggctgcctccatagccatttttggctctgtgcagcctgaggttagagttagaccagaaaggcaatgattttccataatgtaagtgggtctcatccatgaattgaaggcgtttggagcaaagattgatatttgcaaaagaaataatattctgccttaagccggtatcacagaaaaacctcagagcttctggcctttggaagactttggagtcaagactgtaacatccatgcttatcagaactgcccaccagcctgctctacaggctttgaacttagtaacatccccacactaccattaatgaaccaattccttttaaaaatatctttcatcctgtccaaccctccatctttccccagctcatgcaaagtgggtagtttccaaagagcataaatagaactaccttctaatgctctttaaaaatgaaccctactttaaattgtttttatttttatttcatgtgcatgggtatttcacctgccatgtatttctatcacctgagtgtagtaacaaggaggccagaagagggagtcagactccttggaacaggagttataggcagctgggggctgccctgtgggtgctgagaattgaagctgggttctctgtaggatcagccggtgttcttgactgctgagtcatgtctccagccccagctctggtttttgtaggtacttacaagtgtttggcaggttgtgaacagagctactctggggtctatcatcttctgttcaacagtactgagacaaagcaactgtattctttctggagagagagaactattggctctgtgtttctggacgactataaggaccccagcatctttctgtcattacctctcatgttggtggctgaagcagggaggcgtacagattccacctccatcatgatttcccagttgttcctgtgggggaagatgtagtggctacttcctgtgacaattcaaaagcaatgatctatctctctagaactatttgttagtctcttcctgctcccagggctcatggcaatagatttgaatccccatgccctctgggaacgactgtggtttgatggctacaaagacacaagttctggtctgtggatgtacccaaacagggctcctgggaccacaattgcactgttcaagagtgtttagcccagtcctgttctgcttacattgtggccttctgtgttttctggggcagccagaaggacatgaaggggcagttcagctgacagatggcattttgataaccttttccttccaatatgaagagaactacgtcacttccttgatggctcctgtcttccatctgtatcctggtttgattgttacactctcattttccttgctagcaaggatcacaggtcccagaggtaagccccagtaggggagtacttgtttccttaagagaagcctcctcctttccttccctccccttctctccagcctatgctaagtacaagtctagtggcttgtaaagggtcagctgggaggctggggaccagggacaggtcacagcaggagaatccaccaaggcacagagctcctttccttgtggctggctgtaaacactgaagagtgtttatcatccacagttctgaatgtgccaacatggagaacagaggccacagcaagtatggaagcagtggggacgagaaaacagaagcagacattccagggtgtgtgtgggtgcatgtgcctccatccttttctctgcactgatggccccagggaggcagcagaacagggaactcactgttttccccccatcttcttccttttatcaaaccactccatccccacctttctatttcaggggctgaagtaggcagagttgtggaggagggagccattccctcctgaacttcaggtttcccttccagctgctcctgcatttgtgggggaggaaaggctagggctgccttgattctagcagttgatgaatgcctctcaggtcaatgtttactttaacaagagttcttttactgctgatctctctctctccctccctccctccctccctccnnnnnnnnnnaggaaggggggcatgaaaactgaagcttggaaaggatgactgtaatgtgtttatagaggttgacaggcaggctgggctcagagcatgtcagtgtccctctgctctgggtacctctgggtttaactgaagaaaagtcatttagttagaggacgttcaagaaatgatcaggttagggtgcagagacagctcagcagggaagtagaaccatgcttcaaaacacacacacacacacacacacacacacacacacacacacacacacacacacacacacacacacagagagagagagagagagagagagagnnnnnnnnnnnnnnnnnnnnnnnnnnnnnnnnnnnnnnnnnnnnnnnnnnnaatgaataggtggggggggggctggccagccggccagcctatagcatcagtaagttccaggtctttacaggccttgctaaaaagaaagcaggtgatcataataaatgacagccatggttgttctctgactttcacgtgtatactatgtgcaccccaccacaggagcgcatacatgcatgtgcccctcctccaggccagcgttctgcctacagacaccatcatagccctggggcacactaacctcacacgtttctcccatgttccaagaagaaataaaacccctcttgctgcaacaagaaggaaagcaaatccatttaagaacagtgaccatcagaaatggtcactaaaaaaagacttgtgcacccttccagcgactctgtggagtgcagactggtggatggtggtccaccgaagagattacctttcacagagcccctgtatccaaaacctttttttttttccttcaagaatgtgggcagaaagggtgcatgccacctccaggattggcacacaaagacctccaacaagactcccctcagatcctctagaccctctttgttcccaaacatcagctggaagccccaaatcccaagattccctccgccaccccccaggagctgctagaaaaggagctgtgttgccgtgaaatgcccaaatttcatggttgcatgagagaaaaataaactgatacaataaaacactggggttttagtgtttctctgtaacaaaagttattttaactgtgcaagatcaatacacagtttcagaagaaaatgatcaattagaccgagtgacacagaccttaagcatgatatgcttgtgttgtattttctttaaagcatatgcctacaaatacatttatagtcttgggacgttgctggcagaagcacaagaggacccttggttgcctagagggaaagaaactgaaaaatgggaaggacaggatatggtttgtatacaagtgtgcatgtgtgttagtgtatataagcatgttgagaaacacatgtataggcacatatgtgtaggttgacagacacctatggacatcacttctcaggtgatggtcccccccctttcttttcttttctttctttctttctttttttttggagaaaggccaatgtctgtcactggcctggaactcattaagtggagcctggccatggagccctagggaggaagttgtctcttctccccagtgctgggattatagccacacaccatcgccaagcttatttaatgtgggtttccagattcaactcaagttctggtacttgtacagtgaccactttatggattgggctatcccctgtcccccaatactgttgttaaccttgtgaatttgttctgtgagcatgtattacttactcataaattacatgcagaaaacacaaattttgagagaacccggtttgcattgagagaattcttgcagacattgttggtccccggggtctcttttaaaagccaatggtacagagtgttgacttttaaaaatacataaaactgtacttttctggaaaactcaagggagtcagcacagctgtgggacaagtgctctcatccttccaggggctctgtctagtgctgacaggaggccccccacctgattatccctaaatgtgagtccatgtgttcacaagtagatctttcagaaaagggagctctaagctggagagatggctcagcaagtaaaggttcttctcaccaagtctaacaacctaattccatcacttagacccacatggtgaagaagactgactcccacagctatctgttatagcctatatttgcgcgcacacacacacacacacacacacacacacacacacacacaattaataaatggatgtgattgatttttttaagtaaaagagactccatagacctctttcttcctaagagtcctgatttgaaggcaaagcccaggaaaacatcctgttaccagtgtctgggaagagccctcttctcattagaactgagtaccacaggctcccagaaacactgctttttcctaacattttaaacactggatagagatgagagattgacctctaaaacccaagtgtgtttggggacaattcttggaaagatgggtggatgtctcagcacaaagataccatgtgcaagtagcgacatgatcacatttactattataagctggtgcactttggattgggactttatgttttgaaatccattttatcaaaaagactaaattttaaaaagaaagacaggggttggaacataccagtgtttccatggaaagcttcaagaaggattcctgatgcattgctaagtatttggtagcgagttcacatgggtgggaacctccattcaccatagctgttcccagaatcacacaaggaataagttacaaggcaagtgccacaggtaggctcagtggctggaacaatggcatcttaacacagggacagacaagaatggcagataccccatgggtgatcacttttcagaccaggggtggctgtggagatgcacttcacaagagaagtggcttgagaagtctagggtggccaacgagttgcacccttatctctgaaaacactaacaccatttggccaaatgctattcaaatcctgcccctctctgtaaatgaaacaagtgcttcatataattttctctaaatcaattttccaaacacacagaggggaactatagaggtctgacttacttggaaataacacaattagctactaaagacttaggatgacttgccaagttcccaggacccccaggacactgtgtggaattggtggagcctggatgaaggaagtgacatagctgcagggcatgcccttgaagggaacactcagacccagcccagtcctctttctcttcgctcatttggtccccaaacagaaagaaggcatcctctgccacataacttttttgttctcctggcagagtctcatcctctgttgggcagctggtctaccacatacttctgccataatgcgttgtgctaccataggcctagaacaacatgaccatgaccatggactaaatgctctgaagccatgagccagaaccaacctttcctctcaactagttatttgtctcaggtgctttgtcacagtgatgggaagatgactgacacagggcaggaggaggagaaagttagtatcacatatagtttaaggtacctatttcatggcaaccatacttttgtagacacacacacacacacacacacacacacacacacacacacacacacaaaagatgtctacaaaaatttcctgccttaaactccagtaggaagaaacaagctaaaatatttaaagccctacacacactgaaataataatacaatgatggtttactggtggtgatgcaagctatggagaaaaccaacatgtttctctattgctgtgatgaaacaccatgaccaaggaagcatttaatttggcgctcacatcccagaaggttggagtccatcaccaccatggcagggagcatggcagcatgcaggcaggagccataggctgagagcttgcaacttggtccataaagacaaggtataatagagtcaactaggaatggcctggacttttgaaacctcaaagcttacccccaaagatatattcttccaacaaggccacacctcctaatcctttccaaagagttccaccaactgtggactaagcattcaaatatatgagcccatggaaatcattctcattcaaagtaccacacacattctagagttggtttcactttaaagcagattggtaaaggctgtactaagaaggtgactgattagtgaaggggagaggtgcgctggacaaatgctcagcacagtgccaccaggaagtgcaaagaccctgtggtaggtaggaggcaagggtgggagtgtgagtgagttagagatgggggaggacacagggtgttatgtgggggcatcacactgtgtacagcctttgagttatggggagggcctggttattctcgagtgaagtgagaagcagatgaaacaccatgctacaattcatgggcagtgagtggggacagagaagaaggacagaggtaggaagactgtagtgtgattctaacaatgttgaggcaagccctggtaagtgcatggcatggaatggccatttttgctactgtctgaagttagagctgaagagacttggtgactcagacacagaatgtgagagaatggtgaaaaggatgcccccatatctgaggaaggaagcttaaaggggtggtatggctaaatagcaagtcggagctcggggacaagaaggactttctggctgagggaacacagggaaaagatgtagcactaacatgtggctgcgtgtgaccatgccctccccacagaccctgagggttttctgaggctgggggcatggtgaacagacattgaagaggctgggctggagccagaaagatggcctggggaaggctctgtgtagcacacagtggcatggagacagagtgagtgagggatggggagccatgaggcctaagtgagagaaccaaggggaggcgtgggtgaggatggacttccctgtcagagccatccttctgggcacactacagggaccttgtgaagagaatggatgagaacagagtgtggcaggcccacaagagatgcttggcgagtttctcaaatatcttaaaagtgaaccctgatatttcctattgaaaatctttaagattattgttagattctcatttatttgtttgcttgtttgttgtttgaaacagggtctctctattatgtagctctgtctgtcctggaactccctatgtagatgaggctggcctgaaacatacagagatcctcctgcctctgcctcccaagtgctgggattgaagttgtgcacccacacccagcaattgttagtatttttaaatctaaatactcgtctgtaaaagcattcaacttaaatcataaattttctgtctatcttttgggggagacaaggatttttaggagcacaggccacagaattgaggttaacatgatctattgcatttctccccatcccctcctttctgatggccatctcccacaaatttgtaaattcactcccccactctccttcccaggcacacagcatgccatttgctgttcttatcatgaagctgcctgattccaaatagcttacccatgttaccctgtatatggggaggcatcccaggctcctgtgaaagtagctaactgggaaatacatcgccaactttggccaatggggagcagagaaagagcagatctgggggttctcagcactcacttctctgcaaagctggaactcacacaggacatggcagatggagcttctgctgtcctggagccctgagtgaacaggcagaggacaccactgatctcccgaagacctgctttggaaatgtggatgctgttgtttaaagccagcggaagggaggtgactgcatgtttcctgatgaataaaaagcaatcggttcattatctcttccagttggaacactgaacctgccatctgtacaactttagagatgtcgcctaatccatctgagctccgtctcgtcccctgtcaaatgggccaatgatgtctgacctgtctaacatctcaggacatgtaaggatgcaatgagatctcctggaagtggctgtgatctcaaatcacagctgcagatgtaaaatattcattctattgttatgtgtggagactcaaattgtggctgtagatggttaactcttgctctgttgctggatggaaggttatttaaattgcttcctcgttcactcagtcattagaactcatcaggttggagttggagagatggtttagtggttaagagcactgactgctcttccagaggaccctggttcaattcccagcacccacatggcagctcacaactgtaactccagttcttgtggaccaatatccatggcaaaaaaatttaaaaatgcacattaaaaaaaagaacttattgcctcatggttctacaaaagccatgtgacacattcaagtgatggaccacttggagaatcgtgtttcttttaaaatgccagggctagaagaatggttttggagcctcacccccgaccatttacctttggcatagaaagtaaagggaaatcgaggcccagaatggaaggcttggcactgaatgcttccctcctcctgaggcttgtcagtaaagagagggaggaatagaggggccgagacattccagcctctacccttatgcagaccaaagcaacacacattcagaagggtgcaacaaacctattcagatgtcactccaggaaaaacggataaggaagagatggtttccatccacaggacatatggaaggcaggcaggaaaaggcctgtgcattccacactctgcttctaactcagaagaagggctccctgacccattgagcagctggcagcacaacacagacggatttgtccctgggacattttcatccacctgtttagataagcagacattacagctgaccctttttccaggtactgactaaatgtcaagtacttgacattttatgtatcaaggagctgaaacacagcaaggctatgtaatcgcctgaggtcacccagctggaatgaagagagagagagtcagtcattctagtcccaaactattcaccactgtttctaaggaggggacagaaacaagaaagtgggaagcaaccctactacatgctctgaagtggggtttagatacaccaccttgctgtgttcttaggttctacaatgagcagtagcctcaccctgtttcacaggtacattaacagactcagagaggctgattaatgtgtccaaagtcacaaagccaaaaagtaacaatgggacctagaagtcacatgctttccattcggggatgaggattggggtttgatccctaggacccatgaaagacagtcatggtacatgcttgaactccttctgctgagtcagacagatagatgggtccctataggacttgttcctatagagtcagtctagcccacttgtcaagtcccatgtcaatgacttcttttgactctgtctcaaaacaaaaaccatagggagggtgcaggaggaatgacagctgaggttcatttctggtttctacatgcatgtacacatatgtatatacccacacagatacgcatgcctccctacccaaaagttgacagatccagcctgaatgctagacacagtggagagttttatagctaaaaagtaggtaacacactggaagacaaatgtcacgcaatttcaattttatgtgtaacttagaaatgatgaacttatggaaacagagagcagaattgtggctattaggcttcattgtgggtcttttaacaatggggaaacgattggtttaaggatataaacctgcagttggacaagagtcatggactctgtgatgtcttgaggtctactgagagcatgataaatatggttgataacaatatgctatattttaaaagttgtgagatagtatactttaagtgttctcaaaacaaaaacgatgaatatgtgtgatataacatgttaattggtttaatttagccatgccattgtgaacatactgtattctgtatcataattgtacatgactttatttatgagctaaataaatgaatggaaaaaaaataggtaagccttttggggagaaaacaaaatgcattcaggaaagagggaaagatatcaggaaaatttctgtgctctctgcaaaaaccttgtgaacttagccagatgggcattcttgttgtctgtcttcctatcctctcacaccgcatcatataatcacacacttccacatttcttaaacttaagaatcaccgaataatctccagtgttttttttttttttccaacatttgctaatccacagctagaatgttcccccaacctgaagctagagaggagccatgcaattatgacacaggagccagacaatctcattaacatatccgtgactgacacagcggatcattaattaggcattccaagcataagtatatatgtataaattagcatctattcaccatttaaactgtaagtgatttttcatatctgaatattaactatgttggaaaattactaagtttttctgagtgaattccacaaacaatacccacccctgatatcaagaacaaaatgcagagaagagattctatgaacggaactggactgggagagaaccaaatgacgtcactgctcctcatctactgggaccttcctggctctgcttcctgtttcgtgtacttgcaattattctctgtgccaggagctacaagtgaccctttaactgtggtcagccctcaggtataaagttgttgcaaacattctggagatgccctgcctatgtctatagattgtcattgttcacttgctctttctacacgtttattgtgtgtgagctgtggatagtggaggaagtgagtacacagaaatattgtaagttggacctttgagaacttggttgtctatttggcggggaagctgagaacacatgtggacagtgaccgctgtctaagttcaagagcacctcagaggaggaacagaccctgctggcagtgggagaggcctgaggaatggctgtgaaagaggtggcacttccagttgggtggttggcgtggatctggccaagtttgggtatgtaaagtatcatgtagttgggaaagcacagcaaagccaaggtctcacattatatctagtctccaactgtgtgacttctgaagccaatagagccctccaagtttcaacactgctgacaaacttatcccttcagggtttgaaaactaccagccccaggataacaataacagtatgctatcatccttcccacgtgtgacaaggacagtacctacactaaacagcttatgtgggtacctactttccttgtggtagtcttggattcatgctagcagactcattgttccacactgaattttcttgtgaccagtggcacacattgaggatgtggctgtcctcaatgacggctggacttagcagctgagtccatcctgcacaggaagagcttactagtttgtgtggagactgcaccctacatcctgggcttaccaccctttcggttctactgaagcatctctttctctggtcataccaatgcattttagcccagtctcttcttttaagtaggcagcctggaaacaggctagacctgagaacttctccagttctgacatctatgtataaaaatcactcatagatccagactcctgaagagtcaggagcaatgggccttttcttgtcagtctatgacatatcagactgagcaaaatttgggagcagaaactcctaggcccttagttcttgagatgccctggagtggactgaagaccatctccttttctctggacactgttatgacagaggtcacagctgctagccatgtcggatggatagcaagtgcattcccagaataacaaccaaggctctcctaggtaggggttggagtcttccccactttggaaattggcagtttctgaggccttgacggaaacaaacagcttgccaacaaatggcgtaatctaggagaacaccagctattactgaggaaagaaccatctagaatcaggctgcttatttcttctatgctctcagctaaataaatatcgatctcctacttgtgaggtcaattcatgtgtagcaatacaaacgttccattttagtgggatgagaagtatctctgtccatgaatactcatgatttaagcagtacagtgattcttgatgtctggactactgtggggaataacaattagttaattggaaagctgttcattaagatggtgctctgtactcgaccctgtgcctgacatgcagcagacacaaacagcttagacagcagaggatgccatttggttaaagagacccaggggggtccaaggccatgttagtcctaggaattcagaggaaaacaaatcaagagggatccaaggtcatttcaaggagcttgtttggagagaagattcggacttaggtctcacagataaagaggatttaaatgaccctcatgatagagacaaagcacaaatattagaaaatgcacagaggaaaggaatctgaattaggtaacctgaataaaaatgtcttaaattcaattattcatagaaataatatgcacatcttgtcctgtactctgctgacatggactagttttaagaggtaattgggtgggccagggatgtagcttggttggcagagtgtttgggtagcatgaaggaagccctgggttagactcttagcaccacacaaatcctccggtatggtggttcatgcctaaaatctcagcacttgggataaatcaggagagtcaggagttcaaggtcatccctagccacatggcaattttgagagtagcctgagctgctgagtagcctaggggacgaggagggatatcagttttagtttcagttcctgttcctatcccattactatcatttaaaaatggacaaagctttccccacggtggcctctgacaaaaaaataaaataaattaaaaaaataaaagaggccctggatttttatgcctgagttcctctgttgtactaagggctgcctggtaaggctgcacacaaagagatcttctgaggccaacctatggagacacgttccaatttaggctgtggaatgaaaattacagggcagacacagaggcaagtttaaaattaggacaaacttcactttgggcttcttaagtctcaaagagttagtagatgaggcaaagaaaaatggaaggaaaaaaatctgtaagaacttgaaaagcaaaatcccccaacctctcttcttttctacagtccccagcattcctgagctttcggaacacttggtaagcagtggaaagggctttttcagtccctctgctgcttcatgggggacactactcaaggcaccaccaatgaggagagcctggagatacagaggtctggaaaatcctggcttggaaggaataagaatggcagtgaggtagaccttacctagcccaagcccgttctctcccttaagtcctaatactcagtgcaggttggtgatggtggcttggttctatgtgtagacacagtcatcagtcaatctcaaggcagaggcagatgacagtcttgccaggcacatgaagccttctgcaggagcgctgaaatcacaagtcctgttccccagagagtctggggtgcgagggtaactaataggactcctctggacacttgcagctaatgagcaaccactgtcctccctacagggatgggttctcaggaatgactcaaatgacccaggaaaccaaactgcactttctctttgctccttcagtctcacttgttcctccaagctgggacagaatcacctacacttcgtttctcttgagaccactttgatttgggtgctgccgttgtaaaaggtcataatgaaacccattattttgcatgctaagaaagatgttttaaaatgattgttcttcacctatccccaactaaaagttgcaactttaaggaaatcaacaatccccaaactgaattatttctactattgcatgaaaagatgtttgtcacctgacactgcgtttttaggaagctctagggactgcagacacaaaccccaatagtcaatattcagttagattatcctgaagggactacaagagtctgaatgggaaggagccagtcacatgccaccctttttgcaaagccccacaatgggtctgtcacgcctccctccccccaccccacccccgtcttccaaaatcagttccaaaatcactccctgaggagaactgcctcagaagagtatgtttccagatgcacattcccaagagctaggaataaataaaacatggggaatggtagctttcatgtgtgattcccagtgacagcctgaagcccaggtgccaggctggttgcaggagtacccacatgttctgtctgtctgtctgtctatcagagctttaagtgaacaggaagaggaacaagtctacaagtggagggtattacactcctaaacaccttcaccccgtaagtcaagaagtcaagagtttcaccagaggaatttactcatgggagctgggcatgttaagcctccatcattttagtccagcgtggtgttaataagcagagtcattctctcagggcacctcttcaacaggtgttgcctttcggatccacaactcactttgtcagagtgatttcagcactgcttggagcacaacgaattccgaaacttgatcccattgaaatatttagtgcctgctgatatgttcaaacaaattctccagatcttgattatgttctggcaattaaagctattaagtcagtagacagacagcgggttatttcattgctggttgaaaaagccagcgttctcccccccccccacacctcttatgtgacagaactgtaattagccttaatcaaatactatttgtgctctgtgcagtaacgttgcttccttagccaggaaacactgccaatctaggaaaaggagaaatatgaccctggtcagaaagcaagaaagataggcatggggtgtctgggaacgttttgttctatcttttctatgttcttgtaaatctaaggatgttgtacaataaaaaatttaatttaaaaacgccgcagggtgcagggtcagtagtgtagctcagtggtagaacttgtggcttaacatatgtagggcactcggttctactctgtgagtgtgtgtgtgtgtgtgtgtgtgtgtgtgtgtgtgtgtgtgtgtttaacagggtctcatgaagcctatctaggctggcctggaactcattatgcagctgaggctgaactctgaagtatgagggttacacaagtgtgctaccacatcagcaaaataataaatgcatttttaagttttaagttatttaattaaaagtataaaagaggtgagaataaaggaaggagaaaggaatgctgcttagtataactttgacgtttagagctaacatgtcaaagacagccttggaaatcattcagaaaatatggtcacttctgaggttcactgtcttgccacattggggacactcaaatgcttcatagtcctcactgcaaataagtttgtaaatgactggaaggaaggacaatgccccaaacagagctgattctttcacatggatcccaacttctagttcatttctctgtgtaagctaaacatcccgtttatttaaatatctccagaaggaggagtttgtcttggagaacgatgctgatgaacaggtgaggggagggagtggcggtgcttttaaaatcttactgtgcacacaaatcacctagggatctagtgaaagggtgtacatctagcgcagccttcaaggtttgtctgctgcaaaggcctagttgacattgaagctgggccattctttgagtaccaatactgctaggaccagacatcacagaagtacagacagacagaagaccttaaatagtttgtctaaaaggttgacagtgagaaatctggccaagtctgccaaccaagagatacacacttgtattttcttcagctaataattgctggtatcaaattttcaaaacatggtagtaaaaaaagcaatatgttatgaggcagactgtctgtgagctcagagcatcccaatgatagcagaaactctattcttgcccaaagtgccccagctgcaatagggagcaagcagggacaatttgaaaagcagcagtatgaccttcgttattattttgtctatttgtctcttcacacctcaaacagttttgtatttgtggaacattatctattggaactggggttttgttttttaaacattcctagaaaaagaatcccaggggtttccttccaatatgttttagtctggctttgtaaactatggtatcagctgatgctgtttatgagatcaaactgctaacattggaaggatgggaacacattaatctgccattttctacatctttgagttgcatgtggggtatgggggtgtgttacactgtttatccttcctctaagactgacagtcttcccaacattgtggtcattggtgattcaaatctatcatgtgaccatgactcatcactacagtcagaaaccagacagtaactttgagcctgacctacaaagctggcatttgctttgttttgagattagttgaggatggggagctcatcagttggaatattcctattcaccactatgtcatagcctggaaagatggcagagggacaagaaccagcgacactaggagattaaggatgactcttactctcccccagaagaactatatcattgtaggagatgatcatatgtaagttccagagaaagctgaaagaagatgggggaccatcctgtcatatggttgatacttagccgacaaagatgaatcacctcgctccatccaacatggcaagaccaggtgatttgtgacttcgaacaccaggaaacaatccttgcaagtcatcgacatgactgtggttgctgcctcaaataccacattgctagttctccttgcccgggtttttaagccttggaacccggttataaaatggcaagcaatggtttttctgcttagattcttgtacatcttaataaatgcaacagacttgggctttgaaaaaacagcaagtcctggcgtgtagctgttgtcaatttgagggtaggaattcctccaccacagtttatttcaagtccaaacctggctggccttactgaacacagaatgggaaagaaacatatatagtgacaaactgaacaggatggtattgttacaaagtaatagcaactgcctacaaggaaggaagaagcattggcttttgtttgtgtgggagtttgtgtgttgttccctaggaagcatccatgtatttctgacacagggtctctcactaggtcctagggctacccaatgaggtgaagctgacaagcccttgagccccagggatccaccaggtctctccctcccagtactgggataagttttacagtcttttgtctggttccaggggcttacacacctcatgcttatatagcaagcacttgctcaactgagccctctccagagcagcaacagtgtcttaataattaagttcataacaatttaggagggtaaaagcattttaagttcaggatagcatgcctctttttaaatattttcattttgttgatgaaaagtagaagcctgtaagcccgtaagcccttctgtttttatacactcatcttaaatgacaacctcgcatgtataaccagcacagaatcttataaagtaagccatttgaatcataatgagataaacacacagcaagaatttttctacatgagcttgagcattgaactttctacctaggtgctttgctcatcacagtgtgtcctggtgtgaaccctaaggctccagtcaatcaaccccagtggtctcagaatccacagagagggctaaggcatcaccccattacttactgttccctacaagtgcctctgatggcagcttaccacctttatgtcttgcctatatctcagctgatttgctttgaatagaaaaaaagtgatcttagggcagagaagatggatcaatcaggaaagcacttgccatgggagcatgggagacaggattttgacctcagcactttcatgaaaacagccagtcatagtggctcacacttaaaatcccaggactaggaaggaggaatccaagggctggccattggtgtgggaatccatttcaaaagaagggggacagctcctgaagatggagacccaagattatccactgggacacacacacacacacacacacacacacacacacacaccatacacacacacacatacacacacacaccacatatacacacacatgtacacacatacacgcatacacatacacacatgcataccacacaccacacataacatacacaccacacacatatacacacaggcaagcacacacatgccccacaatgatttcatataaaaggacactagaatgggaatttatgtaagattctaaggttggtatatttttctacagctattgaatataatactgacctcttacccctttacttaatttcactctacctttgtttctcctatgtttccctgcttattaatggagaggaacttttaagagtctaaacactaagggactagagctcacaggcaggggaagggagaacccagtgatgtatttaatttgaagaaaaacaactgcatcatgactgtactcatgtctctcccccacaagccaaagccacacaaacaaaaagctaccaccactcagccagtacctccaacacaaatgacccagttaacatgcaaaaatactgcttgaaacacaatgaaaggacaccactccaaactgttgcttcacatcaggccctaattgcttgtccttgctggatcggcctttgaaccttcacaattttgtgtaccatcataatcctgtgtagctataaattcttcacaggtggcactatcttctaacgtcttcctaagttttgaacttgtcattttcactgaggatgatggcctttctgataaatgcctaagagtataagacatagactgtgcagcagcccctccctcaactttgcccaggtgcaggacaccagaaacacttgagcatttttggtgttagaatgatggtggaagtcagcccaccgaggcagaacgggcagaatgtgcacctgcttttgcctttctcaggatgcatttaaattccccagcttcatcaccaggtgtcagggttattaataggatggttgatggctcgggttgctgaatcttctagacacaggaatggtgcccaccatccctagtgtttcataccaatgcccggcattactgcctaatctgcagctcagccacagacagcagatgtcttacttatttttagtctgtctgtctatctatctatctatctatctatctatctatctatctatctatccatccatccaaccatccatccatccatctatttattcggtgtggttgggggagagggaggtaacacgcccatggaggtcagagacaacattcttaagttggtttcctctttccaccatgtggattttcagaatggaactcaggtcctcaggcctggcaccctttacctactgagcaattttactgacctgtttggttgtttttaattttaactttagtgtgtgtgtgtgtgtgtgtgtgtgtgtgtgtgtgtgtgtgtgtgtgtgtgtgtttgtgtgtgttcacacacagattggctcagtaagtactttacccattgagccatttccccagccctgtttggttttactttacagtgaagtatggcagctttattttcactaaattaatatataggtagttctgtttttaggattttttccctttttctacaagagttttactctaagtcaaagtctcttgctttttcaggctttaaaaacataactacatggtgctgggtagatggctcattggttaagagcattagctactcttccagaggtcctgagttgattcccagcaactacatggtgacctataaccatctctagtgcgatctaatgccctcttctggcataaagacatacatgctgatcgagcactcacataatgaaataaataagtcttaacaacagcaacaaaccagacatacatataggagagataaattattcataatactggatcttctggaatgatcacagtaagaccccaggttctcacagctcctggacatatgccgaagtcacacccagagatttaaaaagagccatggataataatgatctatttgagacatagatatagatacaatataaccgtgggtggacacctgtggatatagtccaataaattcaaagtattttaaccattacagataaatttaataaacttaagctcaaagtaacagcaaaaaaaaccccactaatatcaagatggaacaaatgataaaactgcattaatcacaaaaaaacgacagctcttcccagatattatgggttcgtcaccattcagtaaaaaaggggagaaagcgacagttgcaggtgtttagtgtccctggaaaaagattatagcacagtctgtggtctgtcactgtctgcctcttcccgggggcctgtcctgtgggtggcatttaagaaacaggagaaggaagaagattgaaaatcatgataacaacaaaatataaccttagctggtcttggtctgagcctgtaatcctagtctccacaggatgctgaagcaaggggaccaaggtcaagttctgtctgcattagagtgagctgaaggccagactgagcaacttggtgagaacctgtcttaaaataaaaggtaaaaataaaaagtggctcgttggtagcatgtgcaggccccagatttgttccccagtactgaaaatcctactaataaaacaaaaatagagcctgactctatatccctgaaatgtagaagatatgaaaaacaaaagcaataagccctctgtgtgtctagtatgtgtgaacctgtatgagtgcgagcatgcacacgccaagttgctcacataggagtctggggacaaccttggagttaatcctggcaatccactttttttgaggctgggtctcttattgttcgctgctgcgtttgtcaggctagctggtcagaactgccacaattcaccctttgtgccccatctcacctaaggaatgctgggattacaccacgtgctactgcgtatggcatttggggattctgggaatctaaacccaggtgctcctaataatgcagcatgttatccacctcgccttctctcctcagcccctgaggatatgtatgcctttgagaaaataatggaaaaagtcaagtcggctttctttttaagaaacacacatacgcaatttttcatgcagacatttttctcaaaggagttcctccatctcgaaggttgtgagctacatcaggcaatgagagacagagcatcctaccagatccaaagagttcctgaaggcctttaacagtgaaatcacttagcaaaacacagatgcaagccaattacaaaatcacagtgtcttcaagattggctgcaggctggcactggcttgaagctggctatcccatccacctgaggggaggggaaggggacttgacttccatcattcctgggctacattcagacctcactcttttccatacttgtgtctaaatttaccccattcccaagagaaacacacagcatcacatgagttttgagtcacttttggggtatccatctgtatgaacccatggagctgaggtacaggagatggctgaatgagcaaagtgcttgttgtacagccggaggacccaagtttgaatccccagagcctatataaagctgggcatgtagtgcacttttgtaatcccagtgtgtctatggagagatgggaggagacaggagaacccatagaagctcactggccaggttcctggcaaccaatgaagcagagagcctgtgtcaaagtggacctatacccgaggttgtcttttgacctccgcaaatgcacacaccatcgtataaactcacacttctggcccggcggtggtggcgcacgcctttagtcacagcactcgggaggcagaggcagggggatgtctgtgagttcgagatcagcctggtctacaagagctagttccaggacagcctccaaagccacagagaaaccttgtttcaaaaaacaaaacaaacaaacaaaaaaacaaaaaaccccacacttccgaccccacatacacacagagagatatccaaacctggttcaggtcaacaccactgtggatgaaacctaaattacagctactttatctcaacaccggtttgtccttgaggcaagaaggctctgaatcaagtaccataaactgagcttctgagcagccgacagcaagaccagcacagagcctaagccagtggaacacattcaagtgactgtgaactggattagacagaaacataaaaggaaaacagagcatgatggcatattcctgttatcctgtgttgggaggcagagggaagaagctggtgaagtccaaggtctgcttgagctgtgttgtgagttgagttcaaggtcagattgaataacagctgaaagaaaagactgagagtagagagttcagtggtagagtgctcgcctggcactcaggaagccctagtttcagtcatgaatacacagagaggaaagctgtaaagaggcaaagaaaggagtagtgggggaggaaagagaaagaaccaggtacctggatgctcacagagagggtgagaaaaacccagtaatagagtggggctggtagaacaagccaatgggaagtctcttgtgatgttcctgaggctgacagcttagaccatgataaacaagggcctgaatacacaggaagaagccatgtgagtgtagaggagggaagacttaccccttccgcccactcccaaccttccagaacctgccagaaaatgctagaacaatcagatgcttgaataagcgcctcccataggtaggcagatgtgtgtgtgtgtgtgtgtgtgtgtgtgtgagagagagagagagagagggaaggagagaatgtgtgtgttaaaatactgaagcctgaaccagtaattcctcttttttactctgggctcccctttagtctccccacatttttgcatcagggtgctatacttcgaaaaatgaacacacacacaatcttctttcagcattcttttgtcaagggtctttataagcatgagggatttctacattccataatttataacaaacttttcatctgggcattaaaacgaaggcctctggaaagctccctgacgacgcttcatctggcaatggtaccatatttctgtagcagaacttgaaacacagactttatgttaatacgctttaatctttacttcttacatttcaacttaaccttcctcaaaggaaatggcttccagaatcctcttcaagtattcatatggtctattgtggacactacagaaaacactctccatgtaacatccatttcctgactccttcctcagccttcagcctccagcagaggtgggaatcaggacaatactagccattctgtaccactggctcacagagatgtactcccaaggcaagcagatgttggagggatgcatacaggggatggactggaatgtctgatcttgaagtaagcaaaaagaaatcaagtttgtgaacttgatatcatcctcagaccgaggatgacatccaaaaggatttgatgcagagttttaaaataaatattgttacacttttatttatttattctgcgtgtgtatgtggggaacatgccacagtgcccacatggagtcaattttctcctggtaccgtgtgggacccagaggttgaactgaggtccccggattagaaactcttttaccctctgagcatctcaaagacccaagatcttttttttattaatcatctgagagaagaatgatggattaagagagatagagttccctgcaaatatatgagggcatttacaaacaccaaccatagtggtagcagaatacatttattatcagagaaactacaaatggatattgcaaaatatatagagaatccaccattaagttgaagtgggagaatctgagcaggcttcatgggagaaatggcatttaagataggctttgaatgaatgaattaggttttagtagatggagaatgagcaagaaagaaatgtttgaataattagaaggtaggagagtggatggatgtggagagtagctaccgcatgggagactcatagcagtaaggactctgggctgattgtgcagtctgtgaagagccacgtggtgcttctgaacatggaccagagtagcagggcagttgggaggatgcttaaattcaggaacttcacatgattttcttttcttcagataagaggctaaggtccatcaggaacctctgagcccagctaactggagacagagctggggatgttctctgactcctacgtaactccgacatataacttcattacagaaaattccgctgatccactaggtctcttttccatcacaagcaccttctgacctgggccttcctaactccatctccagaggctcagctattgctcggccattccactcctttagctttccagatgtggacaggaaatctcccagatcacagatgagcaaacaaaaagtctagcccattggcttattattattgttaatcagataccacctgactcaggctttgcaagctttgtagagctggacatgagctctacattttaggaacctaggagctggtttcccaatgcctgcatatatcagtgttcctttagagttctcagaagcagccacctcagactgggtaccttctgagctttctcctcgcattagtggcgcttcccacagagctgtgtctatgaacccacaccagttcactgggtctctctccatcagcaaccccagtgaccgtaaactaaacggcaagtgccctaagatgctcctcaccttaagtgagcagattccacttctaacacgtcaacgggccctcctattcttagaagcacagtgagcattttgtttgatggtgtcagtaatggtttgactatagcaaaaatactgagtgaacttcggggttcacgaatctcccaaattaaaaaacaaaacaaaaaaaacacaacaacaacaatgacacatggcaagagtggtggttcctgcctgaaattccagtactcagaaggctgaggctgaaggatcactctgagttcaaggacgcgttaggttagagcgaaaccctacctaaccacgctcccacaaaatagtgcagtgacgtgtaatatacctcctgtttcacaatagcataaatatgaatgagtgtgcgagcctcttcagccctgttagatatgagaggcttgtactcttgaaaccatttttttttctcatttctacacagcaacttcagtctaaacctagcctgtctgaacctttaatgtgccccatgttttcttttgttgtggttaagaacactttttcccttcttgcttagctttttttcccttctgtctccagaactagaacttggctttctttgtggacgcccatttctgatgaagatagcatgtctttatcacaccatgaaaatgacctcaccctgggatgggtaagtaacataatgacttgggtggtggggtaattggcagtgggcttggctcattcacttggtaactcatgccagcttgtaaatctaaaatccaaatttctccattggaaaagctgcaaatttctttccatcccggacacttgaggttttttgtttgtctggttgtttttatggtttgcatgtatgtgctagaatgtgttggtgcacaggtatgaacatgtgtgcagaggccagcagtcaacctcgggtgttgttccttaggaggcacctgcattgtttttttaggcagaagctctcactggcttggaactcaacaagcgcttaagatagctggccagtaaactccagggatctgtctgtcccttcttccccagtcctgggatgacaagtatgtataaccatgcctggttttggtggcgggggggggggtcttaaatattcttattgtattttatctatttattcatttgttgtatgttgaggggttggtgggttggtgttgggggccatagtatatacaccagaggtcagaggtcagaagagtccattctctcctagtactatgtgggacaaagggatcaaactcaagctgtcaggcttggtggaagatgccctttacccattgagctacctcagcagcctgtttttggtgtcttcaaatacacaaaatactacatctgaaaacaacaaagatccattcaggaataaaacaaaaaaaaatccttcgcttgaaagccacactgataacatactaaggtttatgacaaaatgatgtccagtccattgctcaaaaggcttatggaattcaccacagaaatggccatcagaacaagtgtacagagcgcttgagaaagcagttctagcagctccaaagctacactttgttcctgccattggtctgttcatggtcccatggtcattgcatttgaccccttctgctttttccttgcccataaaactcatttagcacagtaaacaatgtgctaaaatgagagaactttgggggaagatgcagtgttctatatcataattgtggcagttgttacagaaatacattcattatctgaactttatagaatttttgcactaaaaaattagtgagttttgtctgagggtcaataatatctgaatgaagaaacatgaaatctgaagaaaatttccaaagtcatattgtatcctaagtatgaaaatacacatgcaaagcttttgacactcataaaggggagttttggatttagacatagatgtaccacaaaatgtgagagacttcctagaatatataatccaaatataagatatttcattttatctttcagataaaaacactatctggattgtctttcagccagactgtgtctgatgagttcatggacccttttctatttcggtctggatttgtgaccactagtattcatctgttacatgactaattggagtaagaggctagtgtgtagccataagtcaagctacttggctcatctgggtattttgccctttttaaaacagctgtaatcacaccatggtcagctaagtgagctggcttagtcatcaggccagacactgggtcactaacactggacctgaagagtgaatgtgttctcaaacaagcaggatttctccaacaagtcatttcaaacctcaggagctttgcttggctgcaggacatgcatagccagggcaaacggaattcactttccatactcttgtctgtggctttggtcgttataggagtcaagctcaaaacagtgcttagtttattggcaaagattaaaacagtgtctgggtggatctacactgtaaaggttccagataataccttcgtgtcttggaccagaaacttttggaagtctgttttgttaagcaagtatccctgggcctcagcatcactgttacttagagctgcactgtcaggtctgagcttatcagggcattaattagatctccagaaagggtggggtgtggacagcaacatccatgaacaatccaagttcatgcctgaagttaaaactactaattttccaaagaaacagctgaaaggaggcaattctgccatgagagcctttgcttatgggcaaagaatggaaggaaaaaaatcacttgctttcaatccaaactgctttgacaaatcctgctgaagcaccatgaacaacaacaaaataggtatatcatacagaaatatagaattacctctgtatcattttattggggtaaggggactagaaaagcacaactttttcattctttcacctaaccataattacaagcaaattcctcaaacccaaagtcaattcacatagaagtattttgcacggctttctgcatccagaatattgtgagttcaagatgttgttgacggattaaaagcctatcatgttcttttgaaaacaaactaaccaaaaattcaatttacttttacatttaattgaacttaataagtatctgttacttacataccattttaactataatcacagggattctgacaaatataagacatggcttcatctcttcatggccttctaatttcactgagaaagactataaacacattaaactagctgagcaactatgagcaatatcctagacctgactcagttttccgacttgtaaaatgaaagagtcaaaatagatgattcctgaatcctcccaggcttgcacaaatttttaaaactctgtgtgtgtgtgtgtgtgtgtgtgtgtgtgtgcgtgcgcgcgcgcgcgcgcgcgtgcacgcacacgcatgctcgagcactatatgaccaaaggacaatgctgggtgtcagtcttccacttccaccttgtttgagacagtctcctgtgcaccactgcatggggcaggctagctgtcctgtgaactttggggaatcctgtctctacctcccatgttgctgtaggaatgctgggatgacaaacatgtactactgtgtctgtctctgagtggcttctggggatcagaacacagatcctcacacttgtatggcaagcactttacctactggtccatctcttcagtccctacaaagcttttatctaatatttgcatgccctgcttaggaagcaatgtaacagtgtaaccattaagctcaaatatatcattaaaataatcaatacaacaagaagtctgaactgagagaaatcagccccaggatgtgacaaaggatacttggaaaagcagaaactttagcttggacttgtgggtagaatttggaggagcaatgggaggggccatccttcccttggaatgtagaagacttgctcagcaggactgaaatggttcttgagcaggaccaggaaaatcaagtttgtaattgcctctgggaatgaaagggtcacatgttgtcaagtggtggctttaaggaagggaaggcactcaatgacttgatgacacaatccttgtaccctataattcaggtcactcttctcaggccgtccagctgtatctcacctctcttagataaagactatgcccttgcaaggctctatatcaccttctccaactgtcccacacactctcatctgtctcttgcttttctccataccactcccctcagtccgatcctcagatacaaggcacacttaatggatttacacctgctttgttgaagtttggctactgaatttggctatgccttcctatacttgctcagaggtcactttcccagtctatttatttgcagtactagaagcagaatccagtctcatccatgctaggcgtgtgctctacgagcagcaccatatttaaaattgcagcccacactcatacacacacacacacacacacacacacacacacacacacacacacacgtttcaacatgctttatttttatttaatgtctaatcatattccttcatactctataatctatttgttttgtaaaatgtctatctccagtgtttaagtgaaatgatccctcttagaaaacagtgcaagacagctgtagtagtttgaatagatatggcccctacagactcatgtgtttgaatgctggtcccacagggagtgcactattaggaggtgtggccatattggaataggtgtggcctttttggaggaagtgtgtcactctggggatgggctctgaggtctcaaatgctcaagctatgcacagtgtagcacactgttcacatcatgttgcctgtggatcaagatgtagaactctcaactccttctccagcaccatgtctgcttgcatgctgccttgcttcccaccacaaggataatggactaaacttctaaaactgtaacccagccccaattaaatgttttcctttataagagttgtggtggtcatggtgtctcttcacagcaatagagactctaactaagacaacagcaacagtcaagtctagatacataataaaaatagccaatacaacaagaggtctggtaagggagatagagggggagtggagtggggagagatttttctctgcttagaacagcatctggcagaatagaggcctggatttccacatccagtgaatcacatggatacataaacaaaagaaaggtctgaggtcaagcacacaggctgaagtatacgggggtggggctaccaagaatgcagagagcatgtgctcatgaaagctttcactgaagaaggtaacaaggagagctatgccttgctctgggtatccacatgaagcattggcaagcagaaggggctgcactaactcaccatccaggtatagaatgaagaaggttggccaggggaattaagataatgttcaggggtgagagaggaataaaagatgtgctggaaacaaacaacatatagttttataatcaagtgtcagtttgtacaacatcagttgtttgtgaacacatctgattgctgttttcttcctgctagcatttcagtatatggtagcaaggaagttacaggcatggaagtagaaagcacacagtttccttaaagcaattcagcatccagggcaagtggcctggaaaggtttgtacactctggtcctttccttctgcttgaaggagccagaggcaagtccaggaccaagtggccctgtttttctggttttcctcatttccattttattctcattctgtttcccttctgcagaacagtgatcaacatggatgacactcacgatcctaccactggcatttggtacaatgtcacagtagaaatgagaagggaagagtatctgtgacagtctttgctagttgaagaatctttttttactggtgtggaagtggaacccagagccttgtgcatgctggaaaagtgctctaccatcaagtcacacctgcagcgcaaaagatgactgactaaggctgatttctttttaaaaatgcttttattaatattcatattaattccttaaggcttctatacatgcatgcaatgtattttgatcctattcactgcataacatagatcacactctcatctgagctcctcccaggtccactcccacactccaacctttcccaactctgagttcaatctgcgctgtccatatactcatggtgatggggccagttactggagctgggctgatgtaccaagggccacactaaggctgatttactatgaatgtgtttcttaagaaatgatgaaaacatggcattttaactcccagtcatccagcatcacttggatccacatgtgttgtcttcatggggaaagcacatcttcccttattgactgtttacagaatcaaaagtactgtggatggtagggataaatacagaagctttgagagacggcctacacttctgcactttcattttagtattgtttctttaaaaagtttttcaagagccattttcttaattaacttttcttctatcttttttttctgccatttaagcatataccccagagtagtcctattgctcataggactcatcgggcaatgtctaaaggaagctatggaggagacaaagagggtcatacttttatttaatgggcagaggccacatgctatggtctgaatgcttgtgttctccctgtttagtcattggtaaaatctatcattgggagttgattagcttaggaggctggaatctcacaaatggggttatcaccctataacaagggaagagcctgccttgctccgcctccacgtgaagttattgttaagggatacacctgtgggatggaagcagcgtctcaacagataccggatgctaaccttgattttcaactttgacctccggaattggtagaagtaaatttctgatatttaaaagctacccagtttattgtattttattgtaactgctttggggaacaacactgggtgtaactgaatatacggtgatagaaagatcagctcctattacacagaggtctctaatttaaccagtcagtaatagtgaaagcaagcgaatttgccgcaaatcacccaatagtgagccccggattatgataaagtaacaaccttttttagtctaagtgtccttcacaaaagactaatgctaactaattaggaacatttagattagatcttcagatgcgcctgagagggtatttcatgctcttttctgttcctacacagaaaatctgcagaaatttagccatggaatcaggaaatagaaaagctgagaagggatataggttatggccagaaactctcaccttactgttggtcgaggaggaaattacccacagggcccacaactgcttagttgcagatctgggacctgaactcacctcaaccctcagtctgtgtttcttctacttgaatactcagcaggtgtgaaaaccgggggcccagtgaggtcacaaataagttcctgcaccaaagttcccctctgatgtcagtatctaagaaaactatggcaggggctggtttgtggcccatgtggctcaggagaggattcagtaccgattctgcctgcctgtcataggcccagctactgctagtggaggcctctcaaggaggcctatagagggagtgagaatggcctgaagggtggcaagtggccttttagtaccatttttctctgaatggaaagtcccagaagagagaagatccagaaataaaatactttaagactccctgagtggcacaggatggccactctgctcttactcctagacaccagcaccctgccacacccatcacgtgcttctcattaaatctgaaccacagaagaacaaaagaacaaagatggaacaccacttcaggctgtgtgttatcttctccctccagggcatgtgggagaatggactgtgggtctctttctggtcagcattcccagcccataccaatgattccctttggggtcctatggctggtggccctccagaaacctggcttattggccctcccctttccagctgccacctccaggcttctacaaaaaaacatctagagagttggaggcaggtatgctacttgtcatttctagatgtcctggaacaggcacacatccccttttgacttcaacaggtttaatgactaactacttatacgaaaactgacaacaaggaaagagacaggccttccttcccatgtgacattagtgaatcctattattggctatggtgtactactaggcatcttgcatgtgattagctgactatgagatgatgtctttgtgttacccataaagcttcccacagttcttcaaggaaggtaatttcgttcctattttaaaggcaaaagaactatggagtggaatgatttatgatcataaaggctgtaaataaaacttttaaaacattcttgccttatttatttttcagcatgttgtgaatcaagatagacataatgaggtagagagagtgggaactcccaacatatgatacttgggtgggaagaacacagcacagcctatgtaggatagaggtgaatgccaacctgccacaacttatgatcacctgggaagagaggtagggtgtgtgtgtgtgtgtgtgtgtgtgtgtgtgtgtgtgtgtatgtatgtgaaccacatgtgtgtctagtgcctgtggaggtcacaaggtgttgaagcccctggcactgagttacaagtgggtattagaaaccaaacatgagttctctggaagtgcagcaagtactcttaactgctgaggcatttctccagctccaaggaaagagtttttttgttttgtttgtttgtttgttttggggggggtggttttgagacagggtttctctgtgtagctttggagcctatcctggtactcactctggaaaccaggctggcctcgaattcacagagatccgcctgcctctgcctcccgagtgctgggattaaaggtgtgcaccaccaaagccaggaaatactggttttacgaagcaaaatgggatagatactcatgcctgaaaggtggaattgaaccactctgtcactaaacagctacaggtttgaagcttgcaccccagaccactgaggatcatctgagcccaacagaagagttttaattgagtagttgtctttattcagttggccagtatgtctggtgtgtgggagggattgtctcaatcattaattgctgtaggaagacctagcccattgtgggtgacaccattccctgggcaggggtcctgaactgtataggagaggagaaagatggctaagtagcagcaggtgggaagcatgggtgctttccctgctctcttcttagctatgcatgggatgtgacttgttccagccttgacttcctgaaatggtccactgtagcctggaactataacccaagtaaacctttcctccagttagttgtttttgggcaagatgttttaacacagcaacagaaataaaactagggcaccatgacaagtagtttcagggtaaaagttataaagttaacatagactgtcctataagcttgggcaagaggtttctcctgttacatcttctattagcacgctacatctgtcacagctaatggaccaccactgacacattattattaactgaactttacactgtattcagatgtccttcatttccctaggatcccatccaagacgccacactgtactgcatcactcagtcttgttaggctcctcttggcttggatggcttctccaagatggggcagctacttggagaagttttcatcacagctaaactggcattatggagggccacagaagcaaagtgtgtgtgtgtgtgtgtgtgtgtgtgtgtgtgtgtgtgtgtgtgtgtgtgcgcgtgcgcgcacgcgtgcgcgtgtgccatgtgtctcatctattgttctccaccttaagataaggtctctcacttgctatttttcagctagtctggtgaccagcaagccccagtgatgctattctttaatgctggggttacaggtatgcacagtgacatcctgggcttgttgtttttgttgatgttttgttttattttttgaaatagggtttctctgtgtaacagccctggcaatcctagaactcactttgtagatcagcctgtccttgaactcacagagatctgccagactctgccccccaagtgctgggattaaaggtatgcgccaccaccgcctggcaacatcctgttttttgtttgtttgttttgttttttaatgtgggttatgaggatcaaacttaggcactcttgcaattggcttatctccctaaccctttttccatctcttctgaggaagggctcatgatggcaatatcacttgtcactgctgaagagaaccttcacatctggctgaggtagaagtggctctgtttcctggctgtaaagtgactatttccctttcctcttaccctgtacccttcagaaggaagtcattcccatgtcccccaagtggggaattaagttccacctccatgacagtgaactatccacaaaaatgatttggaattcctctgtgtgggagatatgtctttctctccatttatttatgtgttccatcatttatttatatcagtatgaacttgtgaatgtttatcttatactttgagttattacctaaggctactttatttatttttgttcagtttgttctagctttggccaccgggagttcttttagttggctccttttaacataatgcctctgtgggggggggggggggggaaggagggggatggtgctcttccttaattcttcattacaagattccctcgggcttgttttctatatttcctggccctgctatacaatcagccatttcttcaagtatctttagctcctgtgagtcctggttgcaggtgtgtctgttgctgtggggtttcaattctaggagctctcagttgacaaagcaagggggcgtatttgtgtatggtaactggcacacacacacacacacacacacacacacacacacacacacacacacacacacgtacgtctatttctgtgtgtcactcatgatctgtactgatctaaacatcagatcatgttgacgttttaaactctaacccatgaccatgtgatcattagagtcttcactctttagttgttaatttttttaattattatttgtagatgtgtgtggttgtgttgggatctgtttacatgagtgtaaatgtccaaagaggccagtggtgtcagtttccatggggctagagttataggcagttgggacctgcctgaattgggtacagggaactgaattccagctctctgtaagaacagtacaggctcttaaccaccaaatctctccagttgcaagtcttccatcttgggcataactaaaaagggaaaaatctgcctcccattgtctaccatccacttatttaattgttcagttctagtctatgtatggttgtctcaggatgcttaatatctgcatgggtgctaaatttgagtgaagtgattaggtacacctgctttgcctttgggggtgtttcgttttgttactaaagtaggttctcactatgtaacccaactggcctcaaataaatgatccttctctcggccttggaagtgctgggattacagctgtgcatcaccatacccagatctgttttcagttttatggtgtccattcattaccagagtgagtcaggccagccccttcacctccaatcacttcaatcatttcatatatttgtgatagattttcttttgtcacaatctatgtgtcttctgacagtcatctgacctgctaaatattttcttaaatttgcgtacaggaaagcacacgtttgctataacacattttgtacaaatacggtgtcgtgtgtttaccattacagtattattcagaatagatgcaccacttacatcttctggacctcatctcttcaacccttctcatcccctaaacccctgtaatgactgatatttatatccctacagctttccttttatagaataccataaaaatagaatcatcaagtgcgtgggctttttcgatcagtttggatgctgtgatgtggaggtcacagccagtctgttggaagctgctgggggtaaataagctcagaaaagtgaccattagatctggtaacatggagggcattaagagaaggggagtgagaaagtgtgaaatactgtttggaaagtgaaaaggcacacacagcagggaaggaagcattagtgtgctgggccatggagcaacactagggaatctgctgtcaagaatctcatgagagaatggccagaggatggcaccggactttctatatgcgatgtgatttcttatatagacatgtataagcttgatgtctggggtggtggcataaacctttaatcccagcagaggcaggcagatctggtctacaaagtgaattctaggacagccatggctacacagagaaaccctgtgtgaaaaataaacaaacaaacaaataaataaataagcaaataaatacttaatttataaagtggacagagtgagaaactaacaatattatatcagtaacaattctaaaatgcaggcatgtgttgcatcaaaaagctatgtgaatgttggatctttctcaaaatatcttgtcatgggggtgggaagataggcggcaaagcacttgctgcatgaacctgagaatctgagtttgacacttagcacccatgttaacagcaacagggcaagtgcagtggaatgtgcttagcacgccagcactggggaaagtggatcttactgtacaaaatgaagagccactgttttccttgtcccgctaaggctcagagaacattaaggaaaatgagaaaagactgtaagaggcagaggcagtggaagacagcagcggaagagggttttttgggtatgacaaggaaaacacatgaacttacagcatctttttttaaaaggaattttaatttatttattttatgtacattggtgttttgccactggtgtcaggtcccctggaactcaagttacagacagttgtgagctgccatgtgggtgctggaaattgaacccaggtcatcttaaccactgagccagctcgacagcatctatgattgcacataagatcaagtaagtccagaatcccaacatgcaaagggtggggctcatgaagacccacctctagctgaggagctattggcagttgctggtggagggtgtggcctcctatagtttgcccatgctacagtggatgtggtcctacacccactatattctggcatctctgtttggactctgtagattataaagaaggaggaactgcagcaggagcacctgaagttgggaaagacatatggggaagaaggggtcttggaggagtggggggttgagggaatggatatggttgaaatatatcatgtacatggttgaaatcctcaaagaataaacaaatatgtgattaaaaaagagaggtgggagtgttgagaaattcttgatctaattaagttaagtaaaatgcactaggatcactgtgacaccagtcagaataacttggagacactcacatcagctatctgtcattctgagaaaaggctccaaatgaggaatgtgcatggataaggattagatatctgccctctgtcaacattgcttgtgcaggaaggtgcccaaagaaagcctcattcgcagcacaatgcacttacctggccgtgcttgccctagcctgcggagaattagctagaattctaccatgtgctctgggagcatttaaacaaacaagcaaaacactccaaaagaagcaacagagatctccaccgagaccctcagagcaatttctttaaataagtttgagaatgcaaagacttcgagagcgcctgtggaaatagcctggatctgtctgagatgattctccttcacactgttcacaaagttgctgcctctgctgccgccttcccaagttcactggccaaatcttcttccacgaacacagatcccttatcacacttacagaaggcaatgcctaggccaatggagtaaaacacacctgagcttctccctgcagcagctctcactgctcctggagatcaatcaggacaaagcagtcttctgcttctttccttcagacttggctcatccataggattatcaccaggcatcagagtgctaacacacctaacagtcatgtctctttgttttcttcctcccagtggatctcctcttcctcccagtggatctcctcttcttctttatagggctgagtattaaaggtttttttttttttttcttttttttttttaaagcacacaccagggacaggccagtttgcccagatccaaggataagcatcttggaagaagacagtatagctctcgagtatccacttctttttctaaattcttttaggcattatcactagattaagcacagacggtgttcacactgcacaaaactgattagttgtgattgttgttcattattctcccacttcttgtttctaaaaaatttgcattacaaacaaccctccaggttctcattccaatcaacttctcaagtcttccgattaatattcctaatataaccaccatgccgttcaactctttcctttgtaagtaacaaaaccaatgatgataccaaatcacaaatctccatgaaaagacaggccaaagaggttaactgcagggtgaacttgacattgcaaaagctagagctcccctgaactaacacagtcaccagagctggtggccctggttaacacgggaaacagcaaagacacagtaaattgtacacacaaagcagccatcggcaatttgcctggtggggtcggatagcatgtggctgataggtctcaggagatggggaacaaacagccatgatggattaagtgattgctattggctgtgtgctcgccctgaatatttcaccatggacagtaatcaattaccagagaccagtaatgataccaatcaaacgcacttagcacttctgcaccatcaaccctagggctgctgacctgccagctgaaaaaggctcagggctgctcaagaaatgatatgtgggctaaccatggaacagcttgtagacgggggaaggcaggcctctccgttcatgttaaaaagataaatggctaaattagccatttacctgctttacaggaaggtttattttaaagcaagcaatgttctctctccctcccagggggcacgaggggctagtttataaatattttggcaacatctgagtggccacaagatttttgccgacaaacagcctcaaaaaaatgactgaacagaagtcacagtgcagctgggaatcagctgtcccattgttccaaacactaccagtcactgtggagtggttgctatgttggcaattcgcatccttgcatcctcgggcagaaatgccaggccatgtctgtctgaggccagaattcctctgcctagaatctgttctttggagtgtccatgagacaatgagaaagaaaagcaggttgcccgtgtttctgacacgacaaaagacaagccagttctttggggggaatctggcatcttttctctcttccttctaggtggtctttatttacatgacaacagacctgagcaccaccggttggaacggacctgcaggttactgggttggcatactgcatggcatatttacaaggcctctgaagccactttgttcagttcgaatctctttccatgtagtggtggcttgtccaaggagtgccacttcagtgggcaggcacgggaactagcagtaaggggaattcatcaaaaccggcttgagaaaggtgttccacactgcattcctgacatttgctcctgctacattttagcaactgttccaagaaaaaagtctcatttttttgtaagctgcagagaccagaaacatctatatctatataaactccactaagctgccatttgcaagtcaactcactttctcaggtgacctgccttaaacatgaagaacataggaatagggaacagtaaaaaagaaagtgctgtggaataatcctcttgtacatggtgaagatttgtcactgtgattggtttaataaagaagctgactgtccaatagctgaacaggataaagttaggcagaaaaaccaaattgagaatgctgggaaggagaagggcagagtcaggagtggccagccagatgcagagggaacaggagatgaacatgccatgctaatacatggcagagtgtaaataaggaatatggattaacttaaaatgcaagagctagttagtaataagcttgagctactgaccaaacatttataatttatatcaagtctctgagtcagttatttgggaagtggctgcggctgccaggtatttgggagcagacagtcagggctgaaagctctgcctacaagaaagcttttaggagagtggaaatattctaaatattgatgtcctagtttgcttccctattgctgtgataaacactatgaccaaaagcaacatggggaggaaagggttatttcagcttctagtccatcatggcaagaagccaggtcaggagctcaaggcagacacccagaggtataactaaagcagaggtcaaggaagaatgttacttattgccttgatttccatgacttgttcatcctactttcttatataacctaggacccatatgccctgtgatggtaccacccacagtgggctagcccctagcacattaattattaatcaagaaaatgcccccttggacacggccagagaattatgtgatggaggccactcctaattgaggtttccagatctcaggtgactctagttttgtcgagtggacaaaactagcacaattggaatcatggtcacataggtgaatatattcaatacaaacatgcaagaatggtccatttattgtatataagttttaggtcaaaagagttaaaataaaaatgtgctaataagcaacctcaattgacacgcaaaatcattggattcagaagtgctaagaacatgtacttagcttgctcttgctatcattttcaggtgaaacacattccacgggtgcatgcttcaaatcaaagatagtgctacctgcctcaatctgttccttctcaggctgccccaggggcagcagagctaggtagagcattaccaaattgcaagtcacctccatccccagatctacaattctcagcaatgaacaaactctgtccatccaaggctctgaatggcacagagagcaggactcatgggtgagactataagcctcctgataccttcaaaggcactgcctccactgaaacactgctcttaacagcatgcataaccattgctatggggcaagttgcattcatgatgagaattcaagaaatcacaaggtacctggaacactggcaagataatcaggccctgcctagccccaccatcatttcaagatgaaatacaactgatggtttctgctgttgtctacctattgtggtaatcctatcatgcaattctgcacgaagatttttgcaaatggatgtgtctaacttctccattgagccatctccagtgtgggattctattagtcatggcttatgagtaacggtgcccacaggacttactgtgaaagccagcaacactgtctcattcttagtctactaacagaaccaggtgacacacgaacagcttcttcctggtatacagggtcatattctgactttctttcttcctagctgcctttgtagggctaatcttctagtcaggctactcttccaaaaggtcaatggcctgggttttagatgatgggatattagcagggaacacaaagatatgctaatcttactgccagaagcctggtgttctaataattttgtaagtttccaagggagggaagcaaccaatagaattatccagctatgagcctatgaaccacatcaagaaacaacgtggcatcataaccctaagggtgcagtggtggcacacataccttggtggtaaccaacagctctcttattggacttaagcccgtaagaccctcacaacaagaatgagactgtgtctggtattagaaacctagctaactactggtattagccagtgaagtcatggttattgaaaaaaaatctacaatcactactctactaaatcagcataatccctaacaataatctataaacgtttccacagtaaaatgtagctttcacccttcatcaaggaaacctcttttgcaacagattgagaccataacagaaactacaaccaatcaaaattcagagttgtggaattcccagtcccaatggatactgtataagacactcttgcatctattgctcagggaaaattgcacaagaggggtggaaagattgtaagagccaaaggatcagggagtttgctatgagattgtgtctcctcataatatcagatgttcatcagcacggctacccaaatgtgagctcaacaaggatgatactaatgggcacgccaaagtggatggagtaaaggctatgatgccttaattctataggtaaggattaaggtgaggaaggctgagaatgagagacttcccaaaaggaagagtacaactgatcatccagtgccaaatagtcagtgccaatgcaggaagtgttatacaaactaaacaggatacacacacacacacacacacacacacacacacacacacacaatccatgtaataacaattagaaaaaaagagtgggggagggtacatagaagggcttggaggtaggaaatgaagggataaatgttacaattaaattgtaatctaaatttttttaaataattttgttcatttggcccctgcctttagtgtcaataagaatttctttccagaataatttgaatactctatatgcaaaatatgtttaaagtcaattgacaggtaaaagaaaagagatcataactttgagaaaagggatagaatcagaagaaacctttaattcgttaaacgttactattttctgttttgatgcttacagaaagtcttccttccagttagtctgtcaactgagatctttgactagtgttaggacattgttgtttgttcactcagttctgtccactccaggttcatgcactctgaggctctatctgtaggtacatatgcatagatagctgatatctattcctgctacaatgatcctttcatctttcaatttgctccatctgcacaatttactgctggccagtggttggagagggactgtggccaaacacctcaagctgatgagacttccatacactgttgacggatctgcatgtggacggggaagtacaggccatttgcatctatatctcagcttttgttttccactagacctttccatatcccttcagaagatttgttttgctatgggataatgctcttgcacactgaaaagatttgtcactcgtattggtttaataaaacactgattggccagtagccaggcaggtagcataggtggggcaaccaaactaggagaattctgggaagaggaaaggcagagatgcagtcaccagtcagaagcataggaaacaagatgagaatgccttactgggaaaagatgccaagccacatgattaaacataggtaagaattatgggttaatttaagttgtaagagcttgctagtaataagcctgagcaataggtcacacagtttataattaataaaagtctctgtgtgtttatttaggactgaacagctgcagaactggtggaacagaaacttctgtctacagtacttagccagaggactgggcaagagtacatgggctgcttgggctctctttggtatcttttgtacatgtgggcagcctcatctaggaataagcatactcaagccatgactacaatatcaggatgctagagcaactgactgtacccacacactataaccaggatcctatgttcagggatcatgggcacaacctgatattccaaaccaagtgagcctcctgtgacagcagtagtaacctgtaactcttcctggtttatgccttctttatcccaagattcttcatgacaactgagttggacaagatgcaggttcagataagatttccttggattcctgtttttttggtagttcaatcaattctgaagtacaaacactccttggatagttggatgcctttagtttacaatgcactgatgtgttcacttcctacctcagatatgcttcattaaaggaaggactgttgttgacttacttctgtaactgggctagtctcacctcaggtattattttaaatgctgtgagcactacaatgaaacatggacatctggatcatctacaggctatcgagtatgatcttatcacaccaagtgttatgcacattctataagtcaaaattttatcttttgtgtgactagagccctcttgaaactgtaggtatttcttttatttgcagtgatggagatcatatatactaatcaaacactctacaagggagctacattcctaatctggattgttttcttgtatgaaaacaataataccatagataaaaatttaagtcaagacattcaggggctcacttccagatttgcaacaaatgattcacattacataggcatgaactattccacatatttttaggagctatgtcttagtttcctgttatacttaggatagttctgtttcatcaaccatttctaccagatctcacatgaatatgtaagaagtgtgtggtgtgtgtgtgtgtgtgtgtgtgtgtgtgtgtgtgtatgttactacactctcccatgaatgtgcatttgaaggtcagaggtcaatgtcaactgtctccctcagttgttcttcatcttatcattatgagtcagtgtctttcactgatcctggagctcacataagtaggctagcctggctggtatcagcctatcgcttcattccagtgtgaggtgacaggcacaaggcactgtgcccagcttttttgtgggtgatgaagatcagttcttcatgcttgtgcagcaaggactaagccatttctacagctactttaagaaacccctcctcttttaaataactcttgtaaacacaccaaaatgtctctaaaaacaaccaactgcatgttccattttggcaccatcttccttttggatgtcacaataggttttccaggtaatctcagacaagcatctgatagagacactgctgatattaaagaacaatgccatttgatcatacattccacctgtcacagtcatcttccaatggctctacgttgctataggcttgagatgacgtgctagaaacagcaaggaaagccaggaaatccatagtctctatttccctattcttggctaaaaacaatacagcactatggcaacagtcaactctgggatataaacagccttgcctacatcaactaaaagccaccctagctggtgaagcaaaaatcaataccagtcccttaaaggaacataaacctatttgcctgagatcatgtaacaaattggtacaacagccagtaaaatggccctgaatgctggccctttaatcactacatcccatgattcctctactgatatcaaaaccaaaccatagcagcagttacccaaacctttatcccctgatcccactcatgcttgagaattttcttgctagagcagaggaatggctcgtggaagagggcagagactggctcaatactccagctgtgttgatagcattctccatggagaaaggaagggttaagaaaagatttagccttctttttcgttaagttcaatgcaagtatgatcaaagagccggattgcagataaactgacaaaacctagattgattttgctgtttggcccagaatggaatggatgtgtgttaaaattgtgacacacgactccaattttctccatgagcagttggtttcagctaccatcagttctgaccatgttaaaacacattttcagagcttcttcccgataatgaaaccagtttgaaagttccaaattgttttcttatgggggatgttggcccatatatcctggtaactgttgtgggactcatggaaggatggggacagcatgcattgtaactccagtcaagggaaccacttaagggacaccttcaagaactccaggtcaggaaggagcacagaacaagtaaacattgcttaagtcggcacagagtggcatctaacgaacagttctcatggcctttggattatccctttacttaagaaataggtcaaaaatcacaggtgacatgggcccaagagagggatcactcagtgtttaagagcctttgctgctcttgtagaggactggagtttgcaccacgtcagacagttcacaatcacttgtaactgtagctccaggggatttgatacccttgtctggcttccacaggcaaccagacccatgtactcacgcctttaatctccgctctcttgaggcagaggcaggtggatctctgagtttgaggccagcctagtctacatagtgagttccaggacatccaggactgcataacagagagactgtgtcgcaaaaacaaaaaacaaccaaccaaacaaacaaacaaacaaaaacccataggcaaaggccagaggaacatccttcacctgtctgcacacacgtgcccactcacacatattggtttgtcaacagttatgttttacatattaactaattcaacagtgccccagtttatcaagatgatcctataaacaccataccaagcccttccccgtgtcctctaacttggtgaaatctatatatgcttcacaaaggtttatcactatttaatcacactcccagcctaaggtacagtgttaatctatgacatgagcatttttcttcttccttaaaactaacaaaaataactaaacaagcaaaaagcacaacacagcaaaacaagatccatacctgagtggccaagccatttccaaactaacagataagggtgactatcattcaaatgaacaccactatttttcctttgaatttttaaaaattaaatttatttattatttagtttttgagacatgtctcactgtgcagcccaggctggctccaaatttgggatatttctgtctcagcttcctgagagcttatattatcagctagacaaccactccaagttcatttatttttaattgacaaaattgagtagagttagaatgaacacagaatgcagtgttttctattatacatacattctgtatggctaagtgagcagattaatacatgaattacatcatgtttttatcattttatgtgtgtctatttgtgtgtacatgtgcacatgtgtgtgtacgggggtatggaaggctggaggataactgtggatgtcatcctcagaaatactctaacccatttgagacaagttctcccactggcctggagtgcatggattaggttaaattggctgttcagaaagcccatgggtctgtctccaccacctcagcactgggactggaagcatgcaccagcacactgtattttttatgagattgcagaaaaccaagctcaggtgctctgcttatgagacaagaactgaactttacctattgagtgttctccaccccatcctcattgtgtgtgtgtgtgtgtgtgtgtgtgtgtgtgtgtgtgtgtacgtgtgtgtgtaaacaacacttaaaagtctaccatcagagccagtgaaatggcttagtaggtgaaagggtttaacatgcaagcttgatgtgctaagttatccccagatcccacggtggaaagagagaacactgctgacctccacacacatgttgaggtacacatgagctttcatacacacacacacacacacacacacacacacacacacacacaaataacaacaacaacaacaacaataataattaaaataatttaaatctgctgtcaggttgttattaactacagccatcatgttgccacacagatctcctgagtttactcctctgcatgctttgaccgctgtaaccccagccctcagcaaccctcacgctactctctgaccctatgagttagttttcagattccacaagtaagtgagaccacgaaatatctggcttcctgtgtgtggcttattttaattcttttcctctacctggctggagtctgttctgtttaacttacacttacatctggaatagatataaaggcgaaaatgtatgtcagttgaggtctaaggtgagaaacttgcataggcacagtggcagaaaacatgaatcatggtttttaataagtcacagtgggaaagagttagatcagccaacttcttatcaaatttattttcatgatgtactcgtaaatattcataaaaataatgactttaaagtccatcagactataggctctaaaaactagacttcagacgggagagcctggactgactgtcattaattatgaagtggtggctagctgcctgacactgtgtccttgacttattgcccttaaggagcctccactccagggaagcacatcacaatcttcacataccatagaaaagccacacagcatagccacaagcatcatttgacttgttcattcaatgcacttaaactaacttggcagaagaggaatttgtgtgtattaaaattcacttcccaatgacagagcatcctctttaccaaggcttcccaggggttttttctcagccactcttgtcccctgagtcagcactagcaaatcccatgggaatggctcttgctagggctgcaagagtgaaaggcagagtcaaattctgattgggtctgtacttcaatttacctcctcaaaatttctctaggcaaactgacaagaccatgaaggattctagagttgcaaggaacgtggcaagggaatttaataagacttatgagctggcacagtaccaaggttgacctgctgtccccaggcccgctctgcctttgctgtgtcaccttaggctgaggacatttagaaatgatgttagcattgcttctttggggacactgatgagttaactcagggaaaattctggaaggaactgtagacagagttccagatatagcaaggagaagtatgtagaggaaaaattacaggacatgtctttatataaagatgaagaaccaagggactagagagatggctcaatggtttagagtacttgtggctcttgcagaggacctggattcaattcccagcatctacatggaggctcacagccatccacaaccccaatttcaggagatgacaccctctcctggcctcctcaggcaccatgaatataaatggtgcatatatagacattcaggcaaaacactcataaatacaaagtaaataaatttttaaagcgaaataagtgaacggtattaaggggaagcagaaacaagaactacccccttaattcagccaaggaactggtggcaagagggtaaatcttgagtggcttaaaagagctttggaaaagatcacgaccaatctcattggctttgtcacaaagttgacttagcaattctcttttcccaggcattacccattttaaactgggttactatcattctggaagtaacatctactgaaggagactaaagtactaatgcatgctcaaattcaaatctggactttgctggccgctgacactgtcctaggcaacatactgagcattcctctgatccagtttccaaacctggaagagtgtgagtctgggcttcttggtgggaacctgcccagagataccatttctatttgtaaagctctttaaattctcccaaggatggtttctgaaaaaaacagaaatggctttaagagccttatcaagccaacctttcacccctccctgttctcctcagaacatgcaagggaaccacttaaaaagcagtgtgagcactgggtaatggaagagagtgaggttggaaaaggactctacagaggaagccccccaccccaagccattaacactttgctttgcacaaaacagaatgtgtggtgtgtgcatgcgtgtgtttcccagtggcctccagcaatgcaccacacctggccatttaaattcaggagatctttgttgccacatttctacctttataaataaagacacagaagcaggagaacactggtggtttttgcaacacaccagaatttggggtacagtggtttttaacagcagtttctttacttaatatgactgcacttctgaagggctagttccacctccccatcacgccccctcccacacacacctctagtgtttagcactagaaaatgctacctcatgagcctgcccattgggatccacaaagggcacagtcagtgttaaaggcatccctgtagggtttattttacttcctgggagctcattaaaaccctacctttcgagtctttccttagccaaaatgatctcacagatctcttgaatcacaaaccactcagaaaggattagggggggggggagctggaagaagagaaagaaagaaaatgggattcacaggggctgagtgagactgtctccaggagtgtgtgagacacaagtcacccacggcagacaaagaacaccatgagactgggagggagacaatgacagctggagaggagcagggaaaggcagatcagaatacagagccagaggggctaggagggaaccctcaaaggctgcacccaaactcaatgttgcacccctgcatgagagagacagctctgactcccagcaactgcccaatattttctagtgataagatttccactagtttaaagaatagcagccccgctccgttctccccccatgtgtatggtatatgtgtgttcaataaaaataacaacaacaaagaaacaaaaccaaacttctccgtggctgtatttcccaactccagctgtattcccacctacagagaaccagcaaacagaatggaatggttttaggttctttaagaatttagaatctcctgtgcagtaaaacaaatgactaaggggaagaaagcacctgtctgaaggacaacatggaaaccagtgagtgtaggtgctaccctgcagaagccaggggctcctcagagctgtttatcctgcttaatttctcaaagacaatggaaggtgggagagacgctcacgcgagtgcacacacaatcacacacacacacacacacacacacacacacacacaccaggttaatacacttagggttcccaatcatccctgacagaacagaaattgagggtttgacaaataatttgtacaaaatctcccttaacctagaaaacactcaggggaggggcaaaaatctactcagaagaattgaggttttaaaagtaaaacataggaaaggggaaatcagatcatgctcagccgacacatcaggctgcaggagctaggggcagcacggggccagctcctggaaccacactgtttacaggaagaaaaaaaaaaaacaaaactatggagtggatggcagtgacatcaggaaaggggacttgctcttttaaataacaagaggtcggaaagatacttcactatggtcagacaacacattaatgaaacatcttttctacctggagaaatgcagagcaagtgagctgggaaaactgatctccacccacccttcagcctccctaaaagaggttagaaagggaaaacagacatagatcctggagatgaacttagataatgagcgccataaacattagtagagagatgggctcctatttcataggtctgaaagacaagtggactctgcatcggagtcaggttgaagtcaaatgcattggaagtttaattgttttcatgctctgcaaaaagaggggacacaagccctgtcactcatactcccagtcatctgccaaacacattgccctgtgatggaactcaagactgcctgagggaaacaatgcatcaggtaggtaaagactgtcccctgaccttgcattttaggctgtggacactcatcttttgcttaaaggttaccagagtatctgtgtagaggttttctagattgaagtggactggacggaataagttgactcttttattagaagaaatgagatactgaaaaataatcttctaccgtggcactcattctcaggcaccattggtgagcagaggggacaagggagagacttgcaacaggctacaagagtaaacatgaagtcatttggggacatttcaagacatccgaggcagagcagggggaaaggctgttggcatgttttctcattcagctgagctacttccactaacctcaaaaggtcaaacaattgctaactgagctaacaacgcaaatcagaattcgatattctgccaaattaaaacaacaaaacagataatgataatagtacatgatagcaatatcagctcctttcatggagcttgccctttgccaggcactgagagacccgcatctattaacatatttaatctttccaagagccccatgcacaagagactatcaacttagttacacctgagaaattaaatccttgataaagttggtggtaaagtggatgacccccagaagcccatgtgttaaggctcaggaagtggtagaacatttaagagatgcaactttggagaaagaaactaagccattgggagtatgcccttgacaccctaggaccctggtccttcttgggtctctctttcatttccaatcaccatgaggtgagaagtttttcttttaacatattttctccaacatgctatgctgccttgtcacaggcccatagacaatggggcctgaccatggactgaatcctttgaaactgtagagtgaaacctttcgtcttttattgatgattgccttgggtgttttgtcgaagtgaggaaaagctgacacaactgggataggggtaaggtatatctgaggtcacagatcctataacataaagtgttgtcctgaatggtattaggcaaacgttatatgaagaaaacgcaaagggacccttatctccattttgctcacaaggtgcttcagacactgatctgcacacagagaaaaataagacaccaaagagaccaggaataaagagggcacatgattaagtgtgaggagacacggctgcagataaaactctaccatcaacttgaagaaaataatctgtactcattagagagcagaaaatccaagtggaaataaaacaagaaaaaaataagctgattcttcttagaaatcatgatcattacagcttttgcttcctggtactcatctaatgccagttcctagttgttaaaataataagggtttgaaacacacagcaaagggagtataagaaatgttagtttatttcattatttcagggaaggtcatgtcagagatctagaaagaagaaatggccactggaaaatgagtttctggatctgttccttttggcttctcacccattttgcatgtggatatatgtgtttacataggtgtgtacatgtgtgtatgagcacttgttcacaaggaagccaggggacaccttccacgttgttcctcgggagtaatccaccttggtttgtgagacagggtctctcacagggacctggagtttgcctagtgagttgatttggctgtcaattgagagccacacatcctcctgtctctgcctccccagaactgggcttacaggcctgtgccactgtacctggatttttgcgtgggtggtgaggtcctcatgtttgtatggcaagcataaaaccgaggaagccatcacctcagcccccttttgcctgctttaaattgaactgtttggaactgaacaggatatatgatccagtgctattttaaagccatcaaatctggcagcctgggaacaaccggcttccatccacagttaagtgagagtcaggaaagccagctactagtcccacagagtcccagtcctgaccctgtaccccctgccccactctcctggagaagccatggtctttcatcccctgaaaccactgccctgttgtcacgataaagctgcctgcctttttaaaagcaagcttctgaggtcaccttaatccagtaagtcagtcatttatttggccttactgtcagagagaatttttcatcagtaagaaatggcattgttaggtggtactaagtcagtttataccgctgagaaaagagattccaaatgtctggggttaatatttgtgatatttacccagggcactctcaaaatcagaatattttaaaaatgtttctgtagggtgtttacaggttgatgacctttgtaaaggttgtcacgtgaggaccaaacattttctgaccaaacttttttttttttccttcaaataaagtaggttgattggaaacacattttacctcataccactctccgcactggtccctgcagggggagtgaagtcaagcaaagagcttaggagagaagaaaacacagaggacagatcttattcttttgtttctcccaagtccaaagcctgccttcctattgattttcagatgtgagtacacacagttcatcttctggataatccccatgtgccttactcccataaacaaatacaatttatgagatggaaaaaaagagatgaatctatatcgataaacaaccatcctctccccccactccagccacagtcattaacccagcaccctattgcactcctgtgataaagcccacattcctgtcaggcccactctgccagcatccacacaatgtaaatcttccggcatatttgcccacagcaaaatctctttacaaattaatttgacaggaaaggaaccgtgaaattgtccataaattatagtatgcatatctggcttaatattgagttctttcaatttttattttgttttgtatatatgtgcatgtgttcctacttgtgtgtgcacacaaacggtcatgtgcatgagaccagaggtctaaatcaggtgtcttctcaatcactccccatcttatttttgagacggggtctctcgctggacattgaagtcaccgattcagctacactggctggtcagtgagccattaaaatagtcgtatctcccagtgctgggattatagacacagccaccatgcctgactttttatgtggatggctgggtcctcatgccagcatggctctttgaccgagtcatctcccctcgccacgactctttaaatttctactagagtcattatttcctaaacactaacacctttcaggcagtgatttaacattagcatcacgttggagctcttaatatagtaccaagatagactcacaaaatacagcacacgtttgcattgtgtcccgaggtctgacaacagccgaagccaaggtgcctgtagtaccaattttggtcactagaagttcgggttactaaatgaaaatcgccagagagccacagaggagtcacatttggaagcagcaagccccaggatcccactgggcctcctgctgcggcaagtgtctgatgtctctgcagaaggagtcttgccttggctctccctgtgcatcccgctccccagccctctctgtgcctcccgcccctgagctcctgacccagtttctgtattctgcacacagttcagtgcacaaggtgttctcccagcctttgtcttgggccttgtattctcactagcaagagctaatttttcttgtcctcaattacccacactgaggagtgtttaagaattgttacatcagccgctttcctatttaactgcaacatgtacttataataagagaattttaaagtttttaaatatctaataggagagagagagagagagagagagagagagagagagagagaggggaatatatgcacaagggccagtgccctcagaagccagaggcatcaggcttgtctgcaactggtattaaaggcagttatgagctacttgacaggggtgctgggaactgaattcaggtcccctgaaagaacattcttaacgactgagccatctctctatcccaataactgcattttaaataccacttcactatgcagttctccccaagtcaaggaaagtattctcactaatctagttaccattttactcaggcaatatctaatgagtgcctactacttgtgtctagactactcaatgactccaagataaggaagtgactagaaagataaaaatcccagcccacacagagctgacatccagtactttccaagagtcacagaaactcagacagcgatgttaagtcacaagatactgtaaacttacactcaaggacggacttctctgctcactgcatcatctgatgggtcctgaggctgagggtaccagttcttgtgcaagcagctggacagcacagaagttatgcagctttgtattcaaagaaattgttttcagctaagacagagtggcagcagctattgctcttactggggcacgttttctaaacaagggatggagtcacgggaagcactgggctgtactctctgccatgcttgcttagataggaggtagttctagatcttggtgaaaagcgacttgttttgtgagattttaaagtacatctctggcactcggaaagggaacagatttaaattagatgttctgactgaggccactggaaatttgttctatgcacaagtatttatattttccatatggcatgcaagtgttttcctctcctttgcgtatgtgtgcacacctgtacatacaggtgggagcccacagaattgactccattccattctgacttaaggtcagagagtctttacctgcccttgctcttccaaggtgaaacaacaaggatgtcaggcctaagatgtgaatgcaacaggatacttggcccaaggtgctgtcgctacatgtcctgcctaaacaacagaatacttaactcgggatatagtttcttgatgttttgggtactgaagaggtaattactctgttccttgtatcattggaaaggaagtcttttgccttctccccctctttggattgggggtataaaagaattttgaacaataaatttgagcagattcaatattcactgaatgcccttccgaccctatctcttgtttcttgtttgcttctttcctcagtttgcactccccttctcaggtacaaacctggattatctggcggacccagacacacatgtatgcatgtgcatatgggtcagagaggggtgtccattgaatcatagtctctctgtcttatttttgaggtgatgtcttttattacctacagctcatggatttggttgtgttggggagccacaagtcccaaagcgtagcctgtttctgttccctagcactgtgtttgcagacatgcctaccccccacccccaggcttggctttgtcatgagttctggggaactaaactaggatcctcatgcttgcatagcaaatgtgttatcaactgagccatctccccagttccagggtgtttaccaaatgttagcattcatcccaagtaaatctgcaactctgagtgcttgtttgctaggagagtgagatctgctttttacttcattctctctccagggagcagatctattgaaaccacttgaaaatcagaactaaggatttaaaaaaattaaagagatactgtttattttcaagcacatcgcccactagaacgaagtcaataaacataactgttttcaagcatgtccctggaggtactttgttcactatgttcacacatccacaaccgtttcacaggatctgatcatgtcaggaaaaaccccgcagatcaataagaacaaaagaagtgtcaaaatattttgaaagggggggtgatacacctgatgaaaaaaatcaagatatttctaatttgaattaagggaaacacacaaaataatgatcccatttgacagtatatagaagacctaaagctaaacttagatgactttacaaagcaaagaaggaaaagggatattaaatagttttactacaagtttcttcacatacatacatgtatgtacatgtgtacacacacaccacacacacacacacacacacacagacacacacacacctatctccactgaattaatggctctactgaagtttattagtgtttaagatttgtctatttatgtgtaacctctacttgttcacagatgggcaagttactataaggtggaagatagcatagttaacaatttattctactattcaatctatcttgaacatcccacctctgaaaagagggcagaaaaatttctatgagaattatgatggaaatatcttccaacttaaagtatcaaaaattctgaattagcgagcatgttaatttctactctttattagagaagttgtgtaaatctcaaaggggaaagaggcctagagacgcttcaagccattacctattatttaatagctcttcaatcagatgaattttcttgccagccaaggatcttaaaatagcaagttttgaaaaacaattcttgtgagttttgcaaccaaaaaagaattactttggaaatagttcagaggagaaaggaagataaaagaatcagtgccctttagactcaaaggcaggttttgcttgtggaatccaagtcttactttccaggatgtagaaaagcagctggtcatagtgtgtgtgtgtgtgtgtgtgtgtgtgtgtgtgtgtgtgtgtgtgtgtgtgacaggttgtgtgtggtgacagccatccatacttgagagggcagtgagatgcatgcgaaacctggtcttgactcagctgccagcccatcagctctgtcttcctaccacacccttctcagttttactttcttctcttctatccaaatccatctcttagaacttcacagctacatttccaaagttcccacaaacccagccttctgtcctttcctgaacttcacctccagacaaatgttcctgaagtctatccgaggcattctgccactgctcttacagaggttcctttgtttaacaaagaacatccaacatgatctaatcaagcagtgaggttcccaggaactgggcctccaaatggcattttctagctttaggttctaacccttcctttctcctcagacccagtgatatgaacaccctggaaccatcccatagggggcactgacacaccactgacaattgagaaccatactgtcaattaactcaggtttctaccttcctgacattggtcaaaggtaaaccaaatctactccctcactgaaaagatgctatggatgaagggacctgtaccactatccacaaaaaatatcgcttctatcaatgattaatgtagctaaccatacccaattaagagtgatgaaaaacatctatacaataaaagacaagtcaaaactgttaaaatgccaggcagtgttcagagcacttaatagacactttatttgaacctgtggaaaggtatagctcttttcctggcagaaaatcatttttctactttactttccatctagaaaatatcagtcaaatatttgaaaagctaaatgtttagcatgccaggggcacccatgtgtcccaggcaccttcacccttgccatgctgcctatctatctatagcacaagcacacacactggcattcttttgcttccatgttcacatgtcatttcttccttggccatttgtaattctgactgtcctttaaggcttaaggctcaggtgactctctacctcaataatatcttccttcttcccaattagccataggctcccctctgtcctgtggattccccctatctctcacacaagaccattttgtttttcataaagaacaactgtctatctacctcatggcaaatcatattatagaggctttatgaattctccaaagtaactatgggtcttatttcacttttgcagataataagctgaggttaaacgaaatcagataacttgctcaaagccttacatcctcaggccctcccaaggaactgtgtacatacacaggggagacacaatggtccatacaatcttctatgaaaagaatggcaagggttgtacagggactggaagtagatgtactcatctaggcaggcagacacatgggtgtctggtgttcaaacccagggctgcattatttgagattctgagcacttatcaccatagaacttccgtcttacttccccatcctttagtgaagtttttgaaggcaagcacatactttgggcatctgggttcttcccaccctctgttctcaatcttgagacccttgtttgactttaaaacctgtgctgacactgttaacgatggtctcagacacctttcctttcccacacaagtgggtgcaaatggcattcaacctccagcttcccagggagcatttccggtttctataaggcttctacacatgtgtggacaaagtcattctctccagcgaaattccagaagtttcataatttggaactgccttctcatatgttctgctaaactggctttccaagttttaatgacaacttaacagtttttcccagtagctttctaaagggctcaacatctaacagtgttctgacttcctaacaccagcataacagtagagctaaaggctcgctatctatcagtgctctgacttcttagcaccatctaggacagtagagctatgccataagcacatttgttaagcaggttgacataaacatccaatgaaaactagaagagtagagtggaaatgacaaggaactatgaatgaactgacaatcagggctgccctaaagcctattgcagatatagtctacaagaacatggttcatcaaagcaggaatgtcagcaaagagttaggtacatgagtcacagtatgaaaccaagggtcaactaaatgttcaatgtggagagatttcataaatagcaatgtgtccaaacaatgcgaggcttcacagcaatcaggaactgttccctcaagaactagttataaggggacagagattgttagaagccagaagaaggactgctgcaaaagagtgttttctggacagggcatttcacacatgtgaactcagagtggtcactgcatgcacaggcctgcacctagtaagccagaatcccaacatgaatgattaaggaaccattgacgttgacggatgcttcggggaatgtcatttttctccatgagtatggcctctcatgttagcccatgttccagtgcatggccctgcacccatgtacatactgggaacaccagtagactcggtgggtcttttttaaaacagtgagtgaatgaagttagagggggtgtagtggtagagttatgggaggagttgggagagtggcgtggcgatggagttgacgaaaacacattataaaaatgtataaaattctcaaaaaccaagtttaagagggaacatttattgggtgtcacctactgacacatgcactccagaagacagtgctgggctgaaaatgtcaaacctacacagacaatgtaattcatttgactctttaaaatggaaaaattatagaaataggggaagtgcttgaggagtagcatgaagaatactagtggctgtggaaacggtctgtgttgatcagatccacattcagatcctggttctcagactgtgctgaagcttttcatcatgctggaaggaggacaactggaggtctacacacatcttacagttatgccaatggttctcacccttcctgatgctgcgactctttcatacagttcctcatgctgtggtcaccctcaaccatgacattattttgctgctacttcttaactacaattttgccaccgttgtgaatgtaaatatctgatatgtgacccccaaatgggtcatgacccacaggttgagaaatgctgactttattcaaatataacagttattaaaaagtaaatgaataatacaatagcactatttctttaagtcaagtgactttccattaaattcaagggggcttgtatagtcaatcgggggtatagatattccaagttcagttaatcttacagttttaatttgagaactgaacctgattctaactgaaagcttgaggatggctccctccaccagaagggcagtgtctgcaggtatatgtatcacataaaaacaggacagaaactaaacaaatgaatagcacccaatgaaaactgtaaaaccctttgcacaccaacattaaaatcgaaaatgaatgtgtgaatatagaaaaaggcacatatatgaactcagaggataacaaataagtcagacaaaatacagtttgtggcaatagtggggtaaattaatggtttagttaagaaaaaaaaaaaacctgtttctcttaatatactaatgttaccagacagaaagacgatggggaagacagcacggggcagttatttaagccggaattgctgattccaaataaggcactggtcaaaatactgtgtcaacttccccacaactcctttcttgcagataattctctgtaaaaaggaatatccaataatttgtctcaccaggcttaatttttctccaatcattcattaacatagccatgggaattgtttatagtttacaatctggtatggcttggaattgaggaacaaaggaagatgaactagaaatgattacttgctgcttatattttaatgatttgtgtgtgtgtgtgtgtgtgtgtgtgtgtgtgtgtgtgtgtacattgtgtgtactggttcaagaagtggccaaaatagggcatctggttccctggagctgagcaaaagcccattgtgaatgacctgatggggacagaaccacagttccctggagaagcagtcagtactatctctagctccatgattttattctctctctctctctctctctctctctctctctctctctcgaaaagcagccagtgcttttaactgctgatccatctctacagccctgatttcatttttaaacaaacaggctgaaaaatgaatggttccacaatgaatgtttttgtcacttttctgaatgtggagagtagtgtctacaagtcactacaaattacaaaacacatccctacaggctgcacgcacatgtatgcatcttttttttcagcttttcatgatcatcagtaactcagtaagaaccaacaatgaggtaaaaatgaaaaagacaaaagaacagaaaaacatcatttaaaaatagatgaagtctgtgctcttaacctctgagccatctctccagaagggaagttgggaggagaacaagaggactgagccaagggaggaatagaggagggcaagaaaggagatgccttgatagagagagacagtacaggtttttagagaggtctggcacaggagaaatgttaggggatccacagggatgaccccaactaagaatccattgatgcccttcccctataacgagattggtgtctaccttggttaccattcctagagtcttcatccagtagctgttcaaagcagaaacagacacccacagctaagcactgaaccatagtcctagaatccagttgtggagagagaggagggatgagcaaagtagccaagatggtgctgcagaaacccgcagaaacaattgacccaacctactgagaccatggagaccctagtcataaaactgcggaaacagcattggaccgaaccaagccctctgaatttggttgccagctaggaggccaagccagtctatgggacctctaacagtggagccagtctttaaccctagagcacaaatggactttgggagcccattccctatggagggatactattataatccagatacagcaagaaaggcctaggccctcccccaaatgacataacagactttgaaggtctctggtggagggcctcactatccctggggatgaggtgggggatgggttggggggattggtggggaacttgggaggatgggaaggagagggaatggggggtggatatgtaaatatgaatagtaattaaagaatttaaattttaaaaaagattaggtcctacatcttgggttaatgtatatatagcaaataaaaccccctgtcataattacaaaacataactagagaaataaagttggtcccttacaaaatgcaggggattgaatgttcaaaaaaaatagatgaagtcatatgaaacctctgcttaaattgctaatatatattaagttggtaactggagggttttttgtttgtttgttttgtttctttctcttccaaattgtttgaaactcaacccctaagccacttgggtctctgatgctttctgttgagcaatctcatttcacccttaggcctgtggagctggcctcagctcttctcagtagccagtgtccttctcaggcaccagctatgttttcttgatcttgaaattttctctcattcagtactttgaccaactacatcctaatggatcttcaataacactttgggtgagtatatgaaacttccaggtccctcagaaaactgtggaaagcatactttaaagacccacagttattttacctctttccttcactgtcatttcccacttgacactttgacaaccttttactgaagaagaggcctggcctatagcatgtgctcagtaaacatccaaagagagatttaaaaaagtgaatgaatgaatgaatgaatgaatgaacaggtagattcctatatttctgcttcaggtgagtgttatgtgtttagactggcaaacagcatagggaaagtcccagcagaggtcctgaatgcattttagattttgagtttcatcttttcattgtggtacaaatcaaggagcctaaggacctctccagaaaataatatgcagtctcagacatgtctcctgagagatactttttgtttctttgtttttttgttttttgtctttttgagacagagtttctctgtgtagctttggagcctatcctggcactcgctctggagaccaggctggcctcgaactcacagagatccacctgcctctgcctcccgagtgctgggattaaaggcttgtgccaccaatgcccagcgagagatactctttaagtaccaaaatccatcttggcagatgctccaaggcccataaacagacacacccggtaccttcagtattcagcaaccactgtcttattagggcacctagcacacattatctaaattacttgacctgcctgcttgatttacttgaggaagggtggaagccctagcaccttcaggggcttcttagaacctatacctacctaaaggtttccatctttttcatatggagattgcacaccttaaatcaccaattctaagcaaagaagcagtgtttccaagacaaagaacttaagacacaggatgcaggcttgcctcgtgtctcatttcagaaagaccatcccaccacacacagcagccctaagtctgtccgccttcgggcctttgtgggcttgtttggggcagacattgggaagtattaacaacagccatggcctgcactgtttattcagagttaagcattaacaaggctaagccctctaacctgccaccgtcttcctccaggaaagaagtgcctatgtaaatattctaatgcaaacaccccagctttcctaggggatgggaagaccagcagacagctaggaggacagaagggagctgtggctatttggaaagtactgcgccatggaacttgattccaggctgactttgcacacttggtcagcctggtgttacctagtagagaggcaatgaggcacatcgtcctggattcgttcatcatggcttcaaatagtctgatggttaggaaatggggcccggatcttttacagcatagatgggggaatcttgtcatggaattctctgttcagggcttgcctgtttaggttttggcatgggaacagctgttgccaagtgttggattctgttctgaggagacgggaatgctgacaatattaactcaagcacaaagaagggccaagagtttcattagagctccccttagatactgcttgctggacactgaaattgcaaaacttgccacaagacccaacgctgcagaagaagtcaaatacaaatacaaataaataagtaaatagagtcagattttctgtggaaattggcccactttcatgaatttacctaaattgatgcttgggtgaggtgacaagaaaagaaatccaaactcagccagttgcctgtggaacaagttgaaggtaagcacatgttctctcctccagatctgaggagagagaatgcgtaggtcaccttttcgctcttgaagcatccaagcaattacgcaaacatgcaagcgaacaccatggagaacagaagacagcttgtctcctgtacaacctgagatgtaaaaaccactacactgccacttgcctcccgctggacacctctgtgctgtttagggaggctgcccttggagttttacttgctttgaatcccaatttaaccattcctgatctgtgcgagctcagacaagctattctgacattttaaattgtgtgtatttcagaaaggagcacagatgactgaaacagtagaaattaactggggatgggatgggagagaaaagaatgctttgctggtgatgtaaccttagtaagaacaaatgccaatatttgttagggaggcaggggtcaggtgcctctgaagcactgtagccatccctgtacatccctgcaaggtcactactattattgtctcaggctataacatgagaaaactaagacctaagaaggaatcacatctaggtcttgaactgctgactggcaaaaccgtctacctatattccctacttcattttcccctttatttaaaaatatgacaacccaaggtaggggcaatggctcagtgtctaaggctcagtgaaggcaatggctcagtgaaagaaagaggtcctgagtttgaatcaccaacacctatataaaagttgggtgtggctaagcagatctggaatcccagcattgtgtctggtggacacagggtgatgatggctggggcttgctggccaccgctccagctccaggctcactgagagagcctgtatgaagagaatatgacagagaatgacagagcaggacacccaacatgctcctttggccttggaacatgcccgcacatacacacaagcacactgatacaaaccagcttcttctgtttaagtgttgatgtgcagtttgttagtgaacgggggagggagggagtgggggggggggggggagttttgatgggacaatatgggagtactgtgttttgagaacacagattctgtgtgccccagctaatatactggaacaagctgttcataaactgagggcttcttttatttccccttgcagtaagtaaaaagtgtgggagacaggaaaaattgtagggatggacagatgcccattcctgtggatatacaccctgggggtggggggggacaacaaagcaaggaatacccacgccagctttctaagtatactcccaaatagacatgagtgaatactaataacacagaaaatcaataggagacctcacaaggaacaatggattagtagggacatttgtggaggccagaatagaaggatggcaggaggcaccatcaggacagaaaagagacactcattgctggtttgtagggacccatctctttttgcctcggcccacaatagaaagagtttgtttagtcagttttcatctctccttcctggtcctcatgtgctacggtaaacttagtagaacaatgaacggctttaacttgggcagaggtcaggagggctgtgataaagagttctttctcctttagttcttcagttgttttctatctgtgagtaagggcaagaagatgtatttaataaaacagggtgtactgtgaccaaataaatctgagaaatgcttcctgcatccctctcttaagatagtgaagtctcaagctggagagatggctcagaggttaagagcactgactgctcttccagaggtcctgagttcaattcccagtaaccacatggtggctcacaaccacctgttatgagatctggtgcccacttctggtgtgcagatatacatggaagcagaatgttgtatacataataaataaaaaaaagaatgtttttttttttaaaaaaaaaaaaaaaagatagtgaagtctctgtcagggaaggcatccactcaacacataagccattgttcccagggcattttgatcatcttgtctattaatatacccatgcagagagactctaagaatactggaacaggtggagatatcaccaaactcttactttcctttcctaggtgacttgaagaagtgactgaactttctggacttgagtttcctgactgatctgaccacgcttgcgtttgcaggctacgctagcctcatggctcttcttcatctgtagctgggtctacagcacagaaaccggggtcaacagagtcactctacagcccatctcagaagtttctccagtcatcagagacaccgagacaatggatcctttacatgttcatccaggccttcatggcccagctgagcattaatgtcccaaaggctgctgagaacataagcagaggcagggaatgtgcagggaattgttaatacaagcttctacttgttctctgaaacatgttggcactcagacatggatttttgttgtatatttccatttaaatatgcaagcttaataaacattattcacccaaaacagagaaatgaaacaaagtcgtgtaactgattcttaggcgacattcttagatgttttcccttcaaatgtcaattctgacatttcaactgaaaaaaaaaaaaaactgattacaatctagaggattcttcccaatattaaagaaatatgtcttttattcaaatgtacaaaattttgacttcttatatttacttgtatgctattttgcttttaaacagggataaaattaaagggtatctgcccaagttgaagacagatttttttccattcttgtttttacagaaagaatatattaatggcataataatagcaataggaaatgctcaataaagaccctagtatatagccagcaagatggctcagtgaacaagagcttgcagccaagccttgatgacctaacacagaatcccaggacctactttttggaaggagagaggctacccctaggagttgtactgtagcatgtgtgcactccatgtatgcacacatatgtaaataaataaatgtaatttaaaaaatatcctagcttgtgatagagcctattctagtactgtacatgtgtgacccaattttagaaatgtgacaccccaggaacagagagaaaaagaagcctcacgaccaacactattaagtggggagactaagatttgaaaccaatgtcccatcctgaatcggttcaccggctttccaccggctttcttgtttactttgtgaaacaatgaaaccatggccatcaaaacacagagggctatgatttggaaagacacggactctgtaatacaactaaagttttgatctcctggctcctgctaagcaagagtagaggagaaggcctagcctgttagagaaacagatccctgagctgggccatctgccaggctcacctaggactgggaacctccacttgaagggctggaaagcaatgtgagagaagcacttgaaattctgaaaaattctcacagaagccaatacaagctaaattgactgtcttcaacctcgaatgccagtgcctcccactagttttcgaagacactgaaaggatacgtgtccacgggagaagggccaagggaacagaacagggattaaaaagacttccagaatataacaataaagatagactttgctggtatctcactggtaaatacaatttggcaactatatggggtcttagggtctttgcttatggattatgtaccagatgttgccaagatactattgctaatgggaatgtggttatatggcaaaaccccacttcaaaaaaactacgtattttatgtgtatggatgggtgtatgcctgggtgtaaacaaatgcgccaggtgcctgcaagagactctggaggccagaaaaggttgcaggatcacctggaagtggagatgactgccacaaggatgaatactgggaactgaaccgggctcctctgcaatagcagcaagctctcttaataaccaaggcatctctccagccccagaaatcaccttttagagaagcaacctgaaatgaacaaagggatgtggtgtggtgtccttctcgttttaattaaaaccagatagatggaacaagttgaggaaatctcagtaaccactgaatctgagtgatggcagttaggagggtgtatgtttgatgtttttgtgataaaatattttgataaacagggaagaatttcatcatgataaaaagaactatatggtagctaaagtggtttgaaaataaaatacttgagaaggagtcagatacgcacttgactactctcttctacaaaagcagaaaaggcagggagagttgactgtgagaacagggggtgaaggacccacagtaaaggtgctgaccttcagggcgattttaacaggattcactgtccattctcaatgaagatactagatgcaggagtctggtctccatgaccacctgatgtagtgagacttcattgctgaggtctctccatgtacatgtgcatgtgtgtctgtgtctctggggtcagctcttctgtattgtattatattgtttgttttccactcataaggtgacagccccataaagccatcaggcacacagttcctcttgatattcaagctgtgcttcctatacatgaatctttaggacagataatatccttcaataatcaggaattaggcaagatcaagcacgttcaaggtgagttgggcatagatgataattaggaattagatcttttttttccccaagaaaatggctcatagctaatcattacacttcccctaattgcctttatgggaggctctgcaaagcctatgtcaaaaacgcaaataaaagcatccagagccatgaataaatatcacacaaattcacagatcagactctacaaatactcagttttctagtgtctctcccacttcccatgtggacaactgttttgtttctaaagatgagctagttcattgcttataactacacttgagaataaattctgcccttgttatctgaattgaaatgtgattatttgcagctggagagatggctcagtggttaaaagaactggctggtcttcccaagagcccaggtccaatttgcctgcacccacatggcggctcacaaatatcagtaaccccagtcatagaggactcaacactacctatggaccaccttgggcagcaagcacttatgtggtcacacattcaggcaaaacatctattcacataaaacaaaaataaacaaatgtgatatttacctgttctgggtttattggggttttgggggatttggtttttttttgttttttgttttttgttttttgatacctattaatggcgggagattaccctgccaggtagaaatagtaaacttttcttgttgttcctattattaaatatcaggttgttgccatttgtttaatattattaaataaatgaccaatacatgcttctaaatgcactgctttcttcgatacttatgagcaattctaaggtattggtccttggatcattattcaaaaaacaaaatagaaaacggtatgtaatgtcaccttaacacaagaaagttttaggtccagagagagacccagtctcaaagtagtggtaaagagtgatagaagtgatctgggtggtggtggcagtggtgaagcacacctttagtcccagcatttgggaggcagaggagaggcagatgcctgagttcaaggccagcctggtctaaagagagagttccaggacagtcaaggctacacaagagaaaacttgtctccaaaacaatcaaatgatgatgatgatgatgatgatgatagagaggaagaccaccacacccgatgctctcttttagtctttgccacaaatgtacacacacacacacacacacacacacacacacacacacagataatgattataatgataacagtactaatataaaagacactgatgccactgaggagtgtggcccgggtgagttcagtgcaccaactctgttttctgtgactcacactttgctcctgacctgagatagaaatgtctttctatttcaggctttgtggaagccctcgaagccctccctgacgggacacccgtccagtcccctttgtggtttttgctccagatgttttcccttacagaataacaaaaggaccttgccatcatgactctgttatttggaattacacccccacctcagcccatagcagctgctgggcctcaaatacagtgccttctccatcttacctcagcaatagttagatgcttgcatgatctttcagctgaaactctcctttaaattcttaattaattaattagccagtgttgggatcaaacccagatcctcataaactctgagcaagcattggatcactaagctaccctgtcagctctgctgactctctgaaatctcaccacctatagtgcctgagactgagctgggcccaaagtcaagactgccatgttaatcagatcatgaacaccactcagttccggagcaggtaagctcccctatcatggtgcgtgcaaaccagctctgaaaaacacctctccacttagcttctacaaatttaatgaataggctgtttacatcctgtcccagataattaatgaagactgtaaaaagaaaaaaagaaaaagaaaaagaaagcaagactcgctgagcacagatccccacctccttgaagcctagtgtgctgctatttatcatggcactttcgttccttcaggcagttttcaatcaatctgacacattcgactcaatctgaattcatttctgggctacatttcatgagacctgctatcaattcttccattgatggctgggtgtacttggaaatgataatgcagccagtgtcctctttttgtctattgttttgtgatttttttaaagctcaaaaatcaattaatttagagcaaaaaacaaaaaggctatataaatcctgttgtccgtggctcatagctacaacgtcccactcactttaatatgtttcttctttccaattgttctattatttgtgtgcaacgtagtatcctaatttatttatgtagtgagcaaacactcattgaatacttagtgagggcaggtaccatgtctgggatagtttgatttagaaattaattattcaggggatcttctgtgaaatattacagagtagggtctctcctaaactgatacctgtgctacatattattgatactgagacacagaaggccggaagaggaagaaatctgtatggtctcttactggctggaatgctcaacaggttccccgggtaagaaatctggacaggatagctaatggaagcaaacagagaatctgtgctctgattgccttccagggctattctggacacgttagggttgagtgtgcaccctctctcacccctcacctctcactattcttcccgatttccacaggacatctgccctgttttgatgaactcattactacttgcattagactggctaacacatcatccccagatctggcctatttatttcttttgtttgtcatgatcacagttttcttcttcttccctctctcccttcttccctcccccttcctctttcctctcttaaatgaaaaaggtcttcattactgtttaattatccttatttatcttcttaaaaggccagttttaaaaagtagttcagaagctcagctattttgccatcaatagctcagtcatttgcacataatcattaagcttatctccctgtttgttaatgccaggccgcctttatttctgctgtcccctcctttctcttctttattatgtttgtattattaccctctgctccagtgatcatcataaatacttctgggctgcaactctggaacctttttgatgattcatatgttcctaggagagttctatagacagatttcatatctctctctctctctctctctctctctctctctctctctctctctgtcactctctctcccttcctccctctctcccctcccctctaccctgcccccacatctccatcttcttgtattgttgcacagttgtcattatcacttggtcattatctattttttccattgatatctggcctttgtggtgaaagctctggtgctgagtgaaacacctgctcaacttacaaggtgagaggagctgcagagagaggtcctggacaccgagcccctggacacggagcccttgactttcccctaggggaagaggcccaccttctcactaggaacaaactccactccactgaatagcacctttggcctcttccagtgacagccctcccattcatcaattatgcctcaaagtcagggagtggagggaagtggtaaataccctctcttctcagggtgacacactaatgtttgtactaagaagctggccacttctccttagaccctgttcctgtggttgatgcatttgcccctatcatttgtggtactgaatgaatccctctctgaagcacacaaataccactgctccccaacccccacaaaaaaaaaaacaaaaaaaacaaaacaaacaaacaaacaaaaaaaaaccagggtttctttgtgtagcagccttattgtcccggaactcaatctgtagaccaggctggccttgaactcagaaatctgcctgcctctgcctcccgagtgctgagattaaagattaaagacacctgtggtctgtatttttaaatagaaactatttggagaaaaagatacattttaaacagtccagtgaggatgatatcccaaactggggaaaagaactggttactgtattagtaataatattttgtgacacacccatctctccagtttaaagctgctttttaaaggcaaggagaaaatactctccatcattatggaaatgctatttttatgtcagcttaccaaataagcactttttcctactcaaacaggtgccaatttactgcatcctgcaaaattcacaccagataaagcagcctaagttttttgatcccacacgtgcagtctaacagaaaggctctctgtttgacggtctaagatgacggacacaaactaagctgacttttcccctcggctgcctgagcacgcatgtcacacattctcccctatgttcgcataggagtgggcacagcaatctttgcaggaagaaaccaggaaggcaaaaaggaaagccatgatcgggatcccgtcttctctttgcccatcctgacacccccagccctcatttccctataatcattttcttcagttctaacatagacccttccaatcccctccgccctcacttacaggtaattgtttttctcctttttgaatactgaactagccacaagacatggcagcaacttaaggaatcttcgagaagacagggatttaaatgatttaaaaatcacagctactgatggataaatgacgacgcacatggttttggataacaaatatcagctgaaggggctctaacaggctcaggcctggcaaagatggctctggcaggtcttgatttcctccctcattttctttgataaagactattagattgcattcctaaaggtagccagcaaggtctggtctcttatttgaccacttcctcctcctgagaatgaccaccaaggtccccatcctctgactcctgcctttgtcccttattccctgccctttgtccctctaaggtaaataaatctcctttgtgttgagaacttggtcttggggtgtcttgtgccaatgtccaggtccttttccccagctctggtaagggacctgtgctaaactgtccaactgacggggggtggggggagcctgtcttctctaggtggagactaacaccatgggaagccaaaactcagctttcaatagaaggacagaagaaaacggagccaggctcagaatagctactccaaagcatgtcattcttagcccatttacctcctccctatcctcccgtcccccctgcatttctccccattttgtctgtgtctcctgaaaaggaaagattcctttagctcatctcagcctgtgcttttctccatctctataagtattctactacccctcctgttcggctcaccatcctcatctcctagctcactgagaaccaaatgcaggcttctgaccgctgccagctaagtgcttgagggggagctgtgcgcttaccccctgccactgggccagcctcatctcggaagagacattttaaaccccagggatggtaaaaatcatcatcattattacctccctaggcaccgtggtgtcagcagagatggagaaactctaaaattacacaggttggtaatgccactccggcatacaagatcatctgaacatcgatgatctattggcagcaccagaatagatgaaccaacaaggaagtaacagcagggtgttctcatcctgggtctctgctgcaggttagtgggtaaaaataaataccttatcttcaaaatggccactagttaggacgatgtgggggggagacagatattgaggggcagaaatttaagcttaagtagattaacaacaaagaaaacttctctaggatttttctaatgcttgctcatctcatgatttaaatatttattcttcaaacgcagccagtgtgtccacatgaagtcagctgaacactggaccttgggctcccctccgagggtgaaagctgagattttgtgtgtataatattattagagaaaggataaatatttaaaaaggaaccagtaatttttccttatggactaccataagttctccatacacgctggggaagatggtgccatgttctaacaggacagacagacagccctgggagcttgacaagttttcctctgaaattttgttgtgttacattttgacttaaatcagcaatctgtcagtaaaggctttgccatgttgcttatacaaagatcttcagtgagtgacatttgttgaagtgggatttaatttaaatttgataacagccctatggtgacatggaaacttccatttccaccagggtcatcacaatatttggaaagggctatagtaccgtggtcacacactgccttcagatgcttctgtccacaaaggggctgctgaaaagtaggctttgggttttgttgtttaatggagatttttttccttatctctcaactgagtgtgatctctccattttatgaagatactcaaacttgtttttgaatatctttgcagccttgcccttgtccatgcttttcagtcttgactgaggcaacactgtcagtcagtgcatagtcttattctaccttggctggctggtcacaaatcttcaacagcaagtaccaaatatgtaaaaagcatcagaagcaaataatgaaacattgggccctatctgtatctagatgccttccacccttcctgaaccaaaagtacctttccaggtgtctcctccaggtgtacccctgttgagttagattggtggtttaagaaccacaggcttggaaatggtttcacatagaacttagttgttcctcttgttttcaaagaccaaggtggagctcaaagatggtatgtgccctctcaccacagtgacagacaggattgaaagtggctgcccccacctctttctgcagcactgacttgtccaagaatttactgaacctcaaagtagaggatcaaattcagagagaaagaaaacattagatttgaaaaagtcagtccttgccaggcatggtggccacacctttaatcgcagccctggggaggctgaggcaagtggatctctgtgagtttgagaccagagtgatctacatatcaagttccaggacattgagaactacatagagaccctgtcccctgtctcaaaaaaaaaatgttcttaaggaaagctaaatttgtaagtagttatagtcaagggggcatttaaaatagtcttatttctactatgttccttggaaaacctaagcagcctcaacattctgttctttaattatcaataatgttgttacctgaaaatcatcttaggatgtaaacactggagtgtcacattcacacagtcattgctggaaggggcaggtgagatgttagattctcgtgaaaggcttttggcagtataaattaacctgggagactttggcatcacttctaaatgttattctctgaaataggcataggtaaggatccacaaatagagtcagttttgattcttctacctttctaattgttgataaaattctattcaaagaatttatgtcatttctgtgttctagtctgcttctctgttgctgcgataaaaaagcaaaaccaaccaaacaaaacaacaaaacaagcaaaaaaccaacttaacaaaagtgacatggggaagaaagggtttgtttttgtgttgcagattagagccaatcattgagggaggctaaggcagaaactcaagactgggcttgaatcagagactctgtaggaacactgcttactggcttgctccctctggcttgctcaactgcctttcttgtatatctcaggacccaggggcagcacagctcatagtaggctgagctttcccacatcattcagatttcaagaaaatgccccatagacatgcccacaggccagtctgacagagagaggcaagccttcaattgaggttccctcttcccaagtgtgtcaacttgacactctgccattgagaaataacattcttagtgtttgtaaagaatgaaaacatgaattggctgtttacacaccccagggtcccttttggatcttatgctccagttgatttctctctctctctctctctctctctctctctctctctctctctctgggtaacagttacagaaaggaagaaacaacttgtttatttgtttgtatttttttctttcaggaaaaagcaagcttgagcagatgtttggatttgcatagagctttggaagaataaggctctaacaggttttctataaccaggggacctgaagatcctggttgagtatgttctatgaccttcactttaccaagagatggaaatgacagcaagggctttctcatgctcccgatagcagtgtccaattgaagtgacacaaacatgtgaaagttggctatagatgggagcttgtaattcatttccacacacaaaataaggaatgtgaagaggggagaacttctacacatgagctgacctctgagagaagctacagaagagctcagaaagacatgggatgaagaggcactgtccttgaaggggttgggctgaggaatgaggatcacatacagaaagacttaaatggccacattgatgcactttagttctctgacaacagtgccatcaatgtctgtctggtgctagatgctacatgaagcacaccacacagtgattaagagtgctgatagttaggaccagcaagatggcacagtaggtaaagacatctgatgccaacttgatgacccaagtccaacccctgggaccccagtagcagaaggacagaactgactctcacaagttgaactctgaccatcacaatgtgcactgtggcatgagatcaactcccagaaaatgtaattttaaaaaaatgtgccctgagctcagaatcagggcactgagatgctcaacgattctaaagtttactagctttttgatgaaggcagtcaaccttgatctcagtgtttgcagatgtaaagtgagaacagcagcaggacccacatggagaactgactcatttacaagtatatagtgggtaaatgttacaatacatcaaagtaccagtctaaaaagggaatgatgtctgtatttatcaatcaatgacctaagactcttcctattcttatttgaaaagttttatgaaatatattaacttatttgcctttggaaacaaacacaccagtctgaacataaataaattgtttgtgatgactaaccatcctgtgacatatcatcattgtacacaattcttacaagatggaccaacaatattaatattagtattaacaatcacaaagccagagagatggctcagtgggtgtcttacttagggtttctattgctatgaagaaacaccacggccatggcaactcttataaaggaaaacatttaactggggctggcttacagtttcagaggttttctctgttatccttgtggtgggaagcatggcaacacacaagcagacatggtgctggagaaggagctgagagttctacatcttgatccacaggcagtggaaggagtctgtgtcccaaattgggcatagcttgagcacagaagacctcaaaacccacatccaaagtgacacacttcctccaacaaggccatacctcctaatagtgccactccctgtgaccaagcattcaaacacatgagtctggggggggggcgttcctattcaaacctccatcgtgggtaaagcatctgccatgaaagtgtgaggaccttggttttgatcccctgaacccatgaaaagtcagacatgatggcatgtctgtaactccagttcccctttgcaagatgggcagtgtagacaagagaatccctgcaagttcatggtcaactagtctggcattttccatggctaataccatgaggtactgtctcaaacaatgtggaaggcaaagacagacacccaaggctgtcctctgtctccacacatatgctgttgtatgtgtatacttgcaagtgtgtacacacacacacacacacacacacacacacacacacannnnnnnnnnnnnnnnnnnnnnnnnnnnnnnnntaaagagagacaaagagagaacagagagagaatactagcaacaatgaccaggacaactaccacaaattcaaccacagtaatacctttgtgtagcacctatgttttcaaaaggctcctacaagccaagtggtggtggtgcaagcctttaatcccagcacttcagaggcagaggcaggtagatttccagcttggtctatatattgagttccaggacagccagagctatgtagagagaccctgtctcaaaaatccaaccaaccaaataagcaaaactgctcctacagaatccacaagaattctgtgatgtgagctaaccaaataccaggatggagacatgcctaggacccaggagtcctgtccagagtgtaacagctcatcaacaatctctcctgaaaatatgaactgaataataactatatactagactcccctaggaagccaattccttacaaatgggcatctgatgtgacatagtctggttgtgatttgactttgacagaaatgggatagattaagaactttaaacccttagcagttactgaggttttatgatcccatgttcacttatgtataaactcagctattcaataactgaacacatgtttgtctggctttggatttgaagaggagataattaaaaaggcattgctattatttaattgtatttccattcccagtaaacttatttccaagtcaactccagttcatgataagtaaccaaataacataaacatattggtgaaactaacacatgggtaaaagcgggcagagaagcatggacaacccttactggaaaacagttaccacatccaactcaaaaatgtgcttattacccaacaacatgagccaaagaatttctcagattaaaccctcaagtttaaccctcaagaaatgttcatggcccaaatacataaagccaacatagtctttctcagatctcatattggaaatcaggacccatgccttttcttgtttcattctgaaatcatacttaatactacatgtatgtggagataacgcatgttttttacctccaggtaatggatgtgaagtgctaccactaaagtgttataaaatactaaaatttaactcaaaattgctccctctgaggctgagggctaaagctgtactttgggtcttttacaaccctctatctactttttcatgggctgttcttgctgacaaactcatagataaacaaacggcccaggggagactataatgagatgaagtcatgccagaaatgaaacacatctgtgaaagaaaagattgtacaagaaagctaggattgagacacacatatttttctcaatagctcgtcactatatccttgccttattctactacagcctatttaaaaatgtggatgccagtacttctatgatgaatagggctcacatacctgtcagtcaaggtattaagaggcaaacacatgtaattatccagtgcacttgaggtatcctgtcatagtttgtgctgacatgagggcagggaaatcttccagttgcttataccacagccagtatcattgctttcccagtaccatttgcctcaggtagatatagcagttgatgtgaaagatggagtgggaggctttagtcacccaacaccaagaacatggtgttcctgaactttaccttcaatggaaggatgctccacacagagaatgaaagattacagggacttaaaaacccatccttcctgaaaaatgccaacacactgctgggccacactgagacctttggaagtcatacactagactggcagctctctcccaaatcctctgctgaaggactatagactggctgggcacctgcaacatcccacacagccccagggtctgtcctagagcagaaggagcaggggaaacaagagggaacagtgccctcttttccacttcagttgaaccaatgtgctctagcttggctgtttccattggaggtaacatgcctatcttctctctttcctccctccctccttttttccctccctccatccatccatatatccatccatccatccctttctatccccctcctttcctctatttaatagggtcccatgtagcccaagctaatgtcgaacttactacatagctcagcctaggccagccttgaattcctgatctatctgcctctacctcctaagtgtggattacaggcatgtacaccattactatgcccagcgccttttctgactatttaatagtcacacagacatttggatcgtgaggaaaatcctgctttttctctgctttctctcattacttatgaacaccttcaaggtgacaggggctcaagagactctggtgtatgctgtgataactacagttcctcatacttttcaaccctgctttccagtgtaaaacagacttgctccaacacagaagtccatactacactgataaccgccctgccacaggttccaaagtttcaggggataccactattggagctattgaaggagaagataccattattaatgttttttttatttagattatctcatatagccaaggctaacctcagatcagatatgtagctgaggatgaccttgaacctctgatctgcctgcctccacctcccaggaatgagccaccatgcatgcctagtgtatgcaatgttggggatagaattcggggcttcatgcatgctaagcaagcactccaccaaatgagctagaagacagcatattaattaccactttatcctctgctgttacggaacacaacctagtacataccaggaaaacaaggaacttagaaccctcagttttcatttctagaaaaaactcaaactgaggggtatttgtagggaagactgagtgatttctgaccctctagttttaaaaacttacagtgtgatcaagaaatacctcagattaggcttcaacataagttaacacattattgtatttccactctgaaactgttagcactttaaacagagaattcagtaaatgactgcaaccactacaaatggcatggactctatttaaatgaaagggcaggtgacctaagtattatttcctctaaacagtctgcacaacatgcaaagagggaatctgagtaatgccccatgtctactgattgtctccattcaagtagattgtgtctccctgtgatgtgactcatagaacaccagcgactgcaggggtgtaggctgtcacccagcacaaagcagcctggagtaagctacacagctaacaggctacccaagcctgaaacatattcaagacccgtcttcagtaagacaaggcccgggcgagctccggggtgacctgacacatgaatttcaaagcatggcaagctgttctttccagaaaatcattttgtttaacaaactctcaactgaacccctaactagctacaatctataagggccttttgtctcaggcttcacagctcagctgtgtggggctttctctgtagtggtaattggtttggctgtccattccacccaccaggtgatagaaaactatcaatcagcataaatgcaatgtgagggaagtctctttagccaattagtcagtaatgagaacattagccaagatatcttctgcagagggcaccttagccattccacgagagtctgaggggatggcggtccctgcgtgattaataaagatcacaggacacttaagacatcttacatgggccaagaagaaaaccagaaacacttggaagagctatgttttcattgttgagtccttcaagccaacacaggtgaaggactggggctggggggtgggggatagaaggtagggaatggcagggggggggggtggcgtggagggagtatctctggattccattcccctagttacagataagacaagaatgcaatgacttgtccaaggtcaacaccttgatggccaagtgtggttacctgtaatcagagcatggggaagatgaggcaggagaacagtagtgaacaggaggtcaggcacgagttcaaggtcacatagcaaggccctgtatcaaaaaactaagaatgagggcagggagatatacctgtcaacaaaagtgcctgccacccaagcataaggacctgagctcaacccacagtgcccaagtaaaatgtaggcatagtggtgcaggtctgttaccccatctgggggaaagaagtagaaacaggcagatctctggagctcattggtcagccagcctagctgaagttatgagccccagatccagtggagagactttctctcaaaaattaagatggggagcaatggaggaagacagttgatgtctcattgacctctgacctctacaagcacatttataggtacacctgagtgcacacacacacactcaccaaggactacggatgtaactcagtggaagagtacttaactaccgtgtacaaggacctatgcttgatccccaaaacagaaaaaaaaaaagtggagcctgcagaaagcagcaaagatgaccgtcagtaatagagagaattctccaatacttgtgatacttccatatctgtgtgtgtgtgtgtgtgtgaatgtgtgtgagtttctatgtgtgtatgtgtgtgtatgtatatgtgtctgtgtgagtgtgtctgtgttgtgaatttgtgtatatgtgagtgtctctgtgtgtgtctgtgtgtgtgaatgcatgtgagtgtgtctgtgtgtgtaaatgtgtgtgtctgtatgtgagtgtgtctgtgtgtgtctgtgtgtgtatgttggtctcgagtgaggataaggattttgtgtgttacttctgtgactgctggggcccagcatgatggttttgtgtcttgagaaagtaccatatatattaagatctaggcccctgatgggcctaccacgtcagctccactaagaagtagatatgtgacttcagacaagtacctgtttccccacatgtaaattgtgcataacaatagtctccaccttccaatgctgtcctgagaattcagtacatctccacaaaacacaaggactagaccttcacatgccagctcgggtacaactgcacagggatgtgccttggggagggtgacgtcttaatgtgcaggaataataaccaggtaagttaaagcaaactaaacaatgctgcaatgttccttggcaggatggtggtagaaaagtaaactccaagagagacagccaaggtgaggctgatgaggttgatttgtggctggatcactgtcgcttcaggtgacattgccattgtgtcccgacctgtctgctgagatgctttctagcagaaccacctggcacagtaaggttctgtccccaccctacctaccagccaaggggccagtaacagatctttatcccatgcacacagtagcctcatcactccatcggagttaccatgtcctggacttgatgctgatgtcccctttcccagaggcttctacatctactcctcctactgagcctggcagctctttagacatagtgaggcactatgctgtattgtcactgcttgctgtgccctatttgtgtacttcctacccttcccagtgcctcctaaatgcagggccaggcagattttgacaaaagggccacctcagtgattgtcccaatggaacacatgccaaacacaggcaccattttgacatggcacagcaataaaatgtctttctaggcatttccttccgtccctccctccctcttccctttctttcttcctttaaaggggaattttctctatttcccaggctggccctgagccaccgtacttaagctcagcatggagactataggcatgtcactcacaggctcagagaaaaggaagggacacacctgcctctgcctttgatgggctgtgcacatctgtctcctatgaggggagacatgagacaaagccttacaggattctccaaggtcaggatgtgttccctctttcacagctggtccctcactcaccgtgctgagggctctctgtgtcagtgattggctacagagcaagaaaggaaagaaacagaccttgaatctaggaggtccaaatcaaaattgcctacctctctagagaaaggttctcaatgtagttttcagccaccaggtagacttcctacaaggaccaaccttcaggtagagaaggaggaacccttccacgtgagagacatctgcagcccctccgtctcctattcaggtcagtattgtggaggcccatagccatatggtttgctacagcccatctaatcctctgttcaacaaaaactaggactttcaaagcatgcccctctaaaatgctagtcaaaggacatcattgcattgtgaaaacagaaaatgtaaagcagtccagagagaaactgccatatttacaccttttgtactggccttatctaatgagagcaggaaaaccagtgccaggagccatctcttccttgttttaactagggttcacacacatgttgtgtataataatagtattcttcactgttacataaacataaacgatcacaccccttctattcttcagacatcgtgacagtccgagctaaaacaggtaactcaactcaagtccctgaaagcacagacaattgctatttatcaagtggctgagccattacacttgcctctgacacgaagtctttagaacttctgtgggttacaccatctgatcatcgtgttgtgatacacagttgctagtttttaagcttttaggttcctaatattcaaattaatactttactttgtcttatagtgacagattttaaatcaccaattccatataaatgcaaactgatttatcccaatttccaagaggtaaattatactattgtgtgattggatcttagaacagcatgaaagagcatggctacacacacagcagtagctcaggctctgtgggcaacaaagtcacaaaataagagagctgggagaaagggtatatggaggtagatgacaacggtataaacgggaaggctggatgatgagctactcaaaatcaaacatacaaaactgaatcctgacccttccttccaaaagactaaaaggtctcacgtccagcattgttttaaaaaaaaatctattctttaaaaaaatgtctagacaatcacacacacacacacacacacaccacaaaatctggtaaggtcgcaattctgtcattcacaaagatggactttttgtaaaactacatgtgtagctgtttcttattcaagagctcaataaataaacagctaatcttcagggaagtccaagtgcaaggtcttcttcaaacacctcttcactcacctcatccctgcccccaagtccagtgaagtagtaattgtgttttactaatagcatgtgaataacgtccccaaattctacatgcagggcatggtggagctgggattccaaccagggtgtctgtgactccagacactgcatcactgaccattttattaggatgcatgtagatggatggatggatgaacaggtggatgagtgacacagctatagtggccgtgtcttccctgcggcttgaagagctgctggcaaagctgcgtatactttttaaaaagagctgggtaaataaccacacatagtccttccccatagcaccccagttttcatctacagcaccccgtttcaaaggagcaatgtcaaaagaaatgttggtgtcttttttgtttccagtcacacaaaagccacatgacaacagtgttgcagggatgtgagggacaggaggaagacgtgtgggggaccgtggagcttcctgtgggccccgggtgcttcctgttagagaagaaacatctgtcccgctgctctggcacaaactttacatacaatctcaagtttcagttagtggtcggtctccacttcctgtcccgaactattgggcaagacttgggcttcactttcctgagacctcaagactagggtagtagaatgccttgaatagctcagtgcccaccaggttgggggaattcgggcaagaaaaacaggtacacctgtagggaggtggcaacaagttattcagatacaggactgtccccagacatgccacagcactatggacagggcacactgtacagactctacacattttctggttggatctcttcttctgctgaggtctattaaagccatattcatttacctaagactctgttcagattcttccctcactcattgtgcagtgtatttgaagactttactatccaaaagcaacaatgtgttgttttatttttattattatttttaaaaacatggcagtggaaaaagccagggaagataatattgttgcatttgcagaccagtcatctggggcatttgtgaccagacagaatttctggtggttttggacatccaacttcctcacactctctcccccttaccacatatacctgagctagtaaaaaattctgaaatgagaacattggaaatatccaaaagccaccagaatttgtattttaaaatcagtgttggccctggcacagcttatacaagtatgcacagtgagtctgaatcacatctcttgtgcccaactagctctagcccatgagagaattcagaaaaagacgacacccaatcatcttaaaatagagaattgtgctgggcagtggtggcacacacctttaatcccagcacttgggaggtataggcaggcagatctcagagttcaaggccagcctggtctacagaatgagttccaggacagccagggctacatagagaaaccctgtcctgaaacaaacaagcaaacaaatatatgtatagtgaatcatgacaggtaagacacactgggaggactcattcaccaaatcaacttcatctctatggagaataagtaaatacaaactcattagggtagtaaactccaatatgtaaatagttctgacatcactcttagtgctaagaaaaacacacaagctcgttgatggatatcttgaaaacactaaagcaaagagagttgctttctaatatgctccttgtgaaaaaggaaaaataacacatatgccattcctttttcatagagatgtcttaagaagaaataagtaatggttaaaaatacttttggttctgctgggcaagtcactacccaatcccaagagagttgggttttttttttttttttaaaaaaaaaaagcaaatagagcagtatgttttctacagtttcagtgaggctctgggcccaaaatgttttaaaagcagaaaactggtaacactagagatattgtcaaaatacgtttccctctggctcggaaatggggagagggagggctagaagggtggagtgggaagggattgtcgtcaaagcattgttaatatgaactgaattgcaccacaaaggcgatgcttcaacatggagaatgaaaattgttctgtattatcatggattgacaatatgacaatcgttcattgaaaatgggtgacagctgtagcattatagcttcgtgcacaaggcaagatgaatgagtgttacaagttcttccagaatgggcccctatttcacaagagtccatctcttccccaaataaatacacgccagcttttcactatctcagcaaatttagcatctctttacaaagcaacctgctaccagtggcctcaaagtgccaatgtcaagtccctgcttggaggatttgcagcagctgggaaatgccaagtcaaaatgccatgcaagatctatccatctcctcagcagaggaaagggcaagagataggaaaatgaccatgcccagatgtatgtgaactgacatcaaactacccccagatccacgggagcagtttctggtatcaggctcaggacactatagtggtagggatgccatttattccaactcactaaccaaaaagaaataacattatgcattattcatgcaaccttatgcctcttacaccaactcactaaccaaaaagaaataacattatgcattattcatgcaacctaaaagaacatactcaggtagaggtagttgcactagtccttagctatgacagaaaccagtcctgcttaccgcacacgcacacacacgcgcacacacaccggggtggaggagcacagaggcaggcgaactggagagacagctcagttggtaaagcatttgtttatgctacaagcacaaggacatgtgtgcaatctctagaacacacataaaaacaagccaaggtggggcacaggcatgtaatcccagatccttgggacgtgacagtcagcctggcttaattggtgaattccagtgtccaatgagagacttttgtctcaaaaacaaacaaaaaaaagtagatggattatacctgacaaatggtattaaggatgtcttcttggcctccacacatatatattcttacatacatatgaacaagcacacacaagtacacacaaaaggcaaaggaaaaaaaagacaaaatccacatacaatatgaaaggaaaagatatgtccttttcacactcagatgttagtatttttatttgtagcttcaaatgcatctaaacacattttacagtgtatctctgacaccttaaacacattaatgggatatggagatatttggagatgtgtatacatgacaaaactaagttaaattatctgcttcctgtaagacttacacatgtgtttggagaaacatgcaaagccatttctcctacttttttccaacagacaatatggaatcaccctatagtgcacaacaccctacaacttcttgcctcttgctcttgcagcttggtacccactggtcagcccttcttctccccaccatcttccaccctcatagccattattctgttcccaagttccacatgtctttaaaagacagaatactacatgctttgttctgatgcttgcttttcttaaacttagcaattagaatactataaacatgtttgcatctcaagtatttttcaatagaattccaatggtcacagatacccttccccctacacatagcacaaagcgcacaattccctattgttggacatttagactgcgtccagtgtttcacagagaaaagtaatgagactattacatcacagaatacatttgtaaaacctgtacggattgtctgtgatcctgatgcatcagagacactctgaaatatgggagagaacaagtgaggaggtgtcaacggtgagcaggctctctatcttgaatttaaacacttaccccacttggtccagttttctccagttcaaccgaacagtctgtcttggggaaggagtagaaaaactaatatatgaaaaggaaggggaattctgtggatctcctccatgcttccaaattcatttttaaacataaacttcccctgacacatttgagtaagctgacggagttactgactttactctgtgtatttccagccaccttctaggtatgctacaggttcacagtagaactgcacctcccaggtctgtgtggttggctggcatcatgggacttcttttgaattgtgagtggaatgacaggtagtaacctccaagattctctcttgtcttacaaaccccagtagaagatagtggttgggtcggtgagaatgagcccccgatttaccatgacaagtagagtccctatttccccatgagctcacagcaagtatgaacaagaggacaattgttgtctaaacccccacttcatttattagtatgtatcctcacttctcctgcctggccaattcaacaacatttagctgatttctctgtgatctcctggtctaatctgaaatgttcacaaaaattccaatcttctctattcgtatagtttgaaaatgtggcaaatgacaagagagaatttttcaggtttccagagttcattacaggaggtattttctctggtggcaatttggggaatggagcacttagttacattgttttagaaaagtctctggttctgctagtactattccctgtaagtctgtactagaaacttttttcactataggggcctggagatgggaggggggggctgccttaggtgactggggccactgcccttggaaatggctgatggtattctcatagaaccctgattagttctaatgacagtgaggtgctattgagcaagcttgacccctaaactttctggggggttgcttgcttgcttgctttaaaaaaaaaaaaaaagaaaaaaaaaagaggctggcaaagtgacccaggctggccttggactcactctgtagcccaggaaggcctaaatcacaatctttctgcctcagtcttctaagtagctaggattacaagcctgtgtcccccatgcactcacaccattgctaccctattgatcatgaagccttcactagaatgggccagaggagatttggtcacactcacaaacctccaaaattaaaagcactgtataacctagctggcctagaacacattaagtaaagcagcctgcccttgaactcacagagatctatatgcctctgcctccccagtgctggaattaaaggtgcatgaaaccatactgggctgtaaactttaaataactttttaaaaatttgttttatgtgtatgggtgttttacccatgtatatataagcatactgtgaatgtgtctggtgcctttggagatcagaagaagaccttggattacctgaacctggttatgagctaccatttgggtactggggaccaaactcaggtcctctgcaagaacaagtgctcaaaatcactccaggcccagtaaactacttttagtgaatcatctagccttgtatattttgttatggcaataaataagagggataatgaggaaatgtgaagataggaaggacaaaactctggccctaaataacttaaaatggaggagatatagtttttaatattccacaaagtaggcactgagagttaacaactggactgcagagggtacctgggccaggggtgtcgagaactactgggctacaagggtggctgggtgggtgggcaatcagactacatggggtacctcggcagggttcagtctgaaactgtttgaacagcaagctcgttgcatgtcgttttgtgcttatctgaagtggcatttcagggatgctgaagggactatgagatggaggctagagacatgctctatctctatacagaggctaataccaggctgctgctgctgctggcatgaccaagaatgtaagaggttcaacccagaggagaagatacaaagtaccaaaggagaaggaaaagcatggccttagtacttgagaagactggcagaaacagagatggctcacagaggaatctgagatgtgcttgtgtggccaagatttccacaaggaaagagacagcgtggaaggagggcactgctgaagtgaacacacaccagagacaaagcattacaaggatcagctgtgcagaacaatcctgcagaaacatcacacctagcgtctacaaaggatatcaggcaagtgtgaatcttagggcagaacacctagggacttagagggatttgtgcttggcctgtggagttaggagatgggtgtgaagccaggatttgaagcagggaattctcaaccaggaagaagagaagaaacagaacaggtcctcgcaggttcccttggcaagagcatggcacctatatctgagtaatgaagtcagagcctgattcccagatcagctctgaacatggggtgggggtagtataacagagctgagctgaaggagaattcgctggttggtccttttcctttccttttatttattttaaactccatagcccattttttggagcctcactttgtcattcataaaacagacacagtagaagacaaagatgttacatggacctgacattctaggacctgtgcacacctctggtttagcctagaagaaaccagaagcaggtagaacaagattcgtcgcgagttttgtcttcaaatgctgtcaaggcagcaggccgcactggctatctttgctcttcagactggaagggaaacattccagttcctcaacctttgtaaacatttcccagtggaaacccttcagctgaatctcactttagctgtgcttccttctccgaaagccatttagctttgcttcaaacaaaaagacaaaaatttgtataaaggcttggaaaggcagatggggagagagaagggcctctctctgtggaatcccaagggaggggtgggacagacttcatccttttgacagtgcacccaaatggcaactgcaggaagaggcaagaagaaatgcacctagtgaccaagtgaagcagcactcagcaaaaggccaggggacaatcaaccccacacaagaaggctgcttgtacttgagctacaaaagcagtggctttctctccttttatcgccaaagagagcaaacatgctccatgaaatctgtgctgtcctaaggtcagatctacaaagctataattatccaggtaactcgggtctgatgtttctcaaaatatccaggtaattataggagaaaggtcatttcctctatataatatcaaccctagaactggctgtctacgctggcagttttccagccgagatctgcctgtcatttcattcttgtagaacaggctgtctacgctggcagttttccagccgagatctgcctgtcatttcattttgttcttgaatacaatttgctgaagactaagaagaatcctaatggggacgttttaaaaattacttttgtacgtatgcctcttccttcaccctccaacccccacgttctgatgatgtcctcacaagatggtatgtgaaaacaccctctgctaatttttaacattcaaaggaattgcattctgggaagaagatattgtgagacgcaaaggaaaggaggaaagtgaagaggaggaacggacagagcggtcccaaggtctccaaaactgaggtgcttaactgctgggccctttccaagtaagaaagagcaggagtctgcaggtcaacaaccagcttgggctttggcagcacgggtagtttggggacaggaggaagcgcatctgcctgaggaagccactgttcctttgcttcacaaaggaaaaaaaatggcatttatcccaagtacagcagagcgtggtaggattcgcctcccccatcctttcttccctcttcctcctcccatcgccctcgccgccgccccttcctgtcggaagagaaaaggtgggagggggaggaggacccaccggtcacagtcggcgcggtgggattctctttcttcggcttttaccagccgatgggggtcaggacgctattggttcagcctcatgtgcgagctggtgcctctcgcttagcaacagcgagcagcggaggcaggaagcaacgccacctggccctgcgagtgtgcgatgctttaaaagggaaacagaaggggagagagaaagagcaatctagcttaacatattgtactctcaagagcgaggcttcatcaggctgctaacgacggccagccaggcaaaaagtggacacagctctgtcccatgggcatctctgtatcaccctaggtagtccacacgtagttcttgttttaaagaacaatctactgagctgcatgggaggtgggtggagagacggttgtctgagaggtgggggtgaatccacaactctcagagagttcagtcagtcttgatttgttttcacaccagggtattactagaaaagacaaagtaaaattgggtgtacttgaaaaggcaattggctaggtaataatcatggctttcttcgttttttttttttttctttttttaaaattagtcaacacagtagctgtttctaaatgctaaattctatcttagtggttgacaattagcttttgggagagtcgaaaatggcaaaagagaaaccctgtaaggtgtgctgtgtgtgtttgagagagatagtaatatgtatgtgatgtgaggtgtggtgtgtgtatgaaatggtgtgtgtgtgtgtgtgtgtgtgtgtgtgtgtgtgtgtgtgtctctctgtctctctgtaatgatttttgtttttctctttgctgcttttagttccaagaggtactctaaggaggctggggtgagctctgaagctctccctgtccaagtgaggcagggctccatgccagtgacaatacagaaatgcatccagctagttatgtcctttcaaagagcataattaccccttctggttctagatctccataccatactttagaaggattctctgacttgcgtacccactacaccccaattcaccataacatccaaggagggtcttcgactccaaattacaaaggataaagtatctttctattttcttagggaaaaatgtagtcaacatgggtctttcaagggtgtcaattggtgccccaggacaaagaccaacactatggagggcacagatgggctacacccccagcactgtctcacccagacccagttaaccccttctgtgctgagttgaagaagccactgactatagtgacacctactgctcaagagcagttgtacatcgttctccaaccaggttctcaaaggcagccatttgctccactcccagacaccactgcacacccctctcaaacaggctggcctcagtgcccaacactcaggcctcctatgcagtgatacaacctcagcagagatcctccacaagaaggacagaaaacaggttgataaacgtccgcaccatctgcagaatcactgcttaggtgaaaccatgctattcacactccaggaaccagactggtttcttctgggaggaactgagtacacgctgaatttcacagagaactcacggagtaaagctctagtgctaggaacagggttcataggaactgctttccacgggttgtaggggagacttccagctaatctgtatttctcttgtcctgtgtagtttgtcaggtgccagggactccctcccatttggaggaagaagccatttaattaggaaagcaagttacagttttctaaagcctagcaaaacgtctgtgctgctggcaacaaaatccccaagtgcaagggtcctgtttccaggtaagatcagaaacaacaatatgaacaatactggttacacacatcacaccacacacacacatcacataccatacttacatatcacattccatagtcatcacacataacacacacacacacacacacacacacagataccacacacagataccacacacagagacacacacatatacacacatcatacacaccacacatacacacacacacacacacacacacacacacacagataccacacacacacactgtcaaaaaggtactaagcttaaagtcatattaaaagtggtgataacagctggcttgggtgatgataaacagcggctcaggagttctggctcctttcatcttgagcaaagactatgcaagaagccttcacccaaagtgactgcttgatgaacagaacacatagcaatgcaggaagctcaagcatgaccacatatttggctttttattcccaaacatctcacccaggacaactggatattgggccttaatacatactctcatttcccagacaggaaacagcgctgcagttcactcaggattccagagcaagccagtggaagctcagagggctcagactttctgacttaaacctgcccatggcattgagccaccagagccaggtgcctactgtgagcagcctctctcatctctgtgtgttcatttgtgccaatgtttctgagtcactggtgtcctgtttacattcctcatgaagcttgccatgctttcctgaaatgggttaaagacaactaatggggatgcagaaggctttagtgaaacacagaaggtttcaaacacagggaaaatggaaggctgaacctgcccacccacctgcatttgccaaattctccaatgtctaaacacggaagcatgtggagagtgaagagctactcagaaaggaatcatactctctctccaccgagacaccgatccacaaggtggtgctgccgggaggtgggggggttgccagctcagaagactaattaagcacaactgtgatggtttctttcttgacatacagtggtagaacacacctggacacaagtctatgtgacatgtgcagaacaaagcttggtttgtgccatgggtcatccagcccatgtgtgagagtctatccagggaggtgacaacgttaggaatggcagcctccaaatgcccctcaaaaacagctttcaaaactatttttaaatctctaattagtttcacttaacagggaagggaaataagcagtgaccagtgtatatctcccttgtccttttcttttccagaaggttctaagcatgaggtttcagtgagcagcactaccctaactgacaacacgtagtcccttcattcaaaatgtcagtcatatctcatggcgtcaacactaagagagaaaggtacatagtgaggggctacacagtctagctgtcgatagctggtggctctgtcacagcgctggcaagatacaatttgttttaagaacatcacattcctgggaatggagggagcaccttggatgtaccccattttgctcccttggagtattctagaatgcatcacacctggctctgcttcttgctcccaagtcaggatgtctatttttggagcacagtagcatacacctgtagtcttatgagtgtcacaaagcttgtccttgcttttccccactgggccctctggcttccagacactgttgatccttacagccagcaggagctcctacttaagttaagcatttcaggccctccagcctttgttacaacatggttcacacagtcccaccaccctgtatgtgcgggggttgggggtgtgtgggggggagcgtatatgtatttatacacgtgtgcatgtgtgggtatgcctcaatttaagttcatgtagggcacaagttaacatgaggatgtctttccccgttttccacctttttttgtgtataaaaaaatattttatgtgcatgagtgttttgcctgcatatgccctttttaaaaattttttcttaaagtgtattcatgttttgcttgcaagttgtttgtccatgtctggcccctgaggaggaaagaagagggtgtcagctcccctggaagatacagctattcagacatctatgagctagcatgccggtgctgggaactgaatccaggccttcggaagaacagcagtgctctttaaccaatgactccatgtcactccagcccccaccaccctggtttttgagagagtctctcaaggaaccagaaggtcacagattgagagaggagggctggacaatgagcttccagagatccacttgtctccacctctccagtgctgggattacaagcagatgtagctgcattcaacctttttcaattaagtggtgggccagtgatttgatcatgggtcataatttggtgactttcaactacacatcaagcagttaaagctgggggtagggaggagaacagcatgatttttttcttcatttcttttctttctttctgttttttgtttgttttgtttgtttttcaagacaagtttctctgtgtagctttggagtctgtcctggaacttgctctgtagaccaggctggccttgaactcacagacatctacttgtctctgcctccagagtgctgggattaagtgcatgcgccatctccacccggcttctcttcacttcttaataaagatttctacggcagtaccaggctgtttttatcactacagttctgtagtataacttgaggttaggtataataatacttcccagctgtgttcttactcccaggttttctttggctacccatggtcttttgtagtctacatgaattcttggattggtttttccgaatgtgtgaaatatgacatcagaattttgatgggtattgcattaaatccataaatcaatttaggtattataaccattttcacaattttaattctgacagtccaggagcttggaaggtcttttcattgtttatcttctttgattttctttttcaaggtcttgaagttttcattgttgaagtcttttacttctttgattaggtttattcctgggtactttatttatttatttatttatttatttatttatttatttagaactattgattatgaatgagatatttcccctaatttatttttctgagttcgctggaagcacatacatacatacatacatacatacatatatacatatatgttaatatatatttatttatttattttgaatcctacaactttattatgttcactagatctcaaagtttctaagcagattctctagaaaagacttgtgctatttatgtgctacttacgaacaaggatagtttgatttcttcaattcttgttttcatcccttttatgtctttcccttttttaactattataggtaagagtttgagcccaatattgaacaagacaggggagcaatggcttcttgtctgagttctaattttagaggaaattctctcagtttgcctccttttagtacaatgttagctttaggtttgttacatacagtctttatgattttgagctatgctccaactactcctaatgccatgacagcatgttgaactttgcaaaatgcttttgtggcataaacagagatgactgtgtggtttctctcttaaagtttacttatatggtgtgttacttttattggtttacatatactgtggcataaacagatatgactatgtggtttctgtccttaagtttacttacatggtgtgttacatttattggtttacatatactgaactaaccttgaatctccaggatgaagctcacatggttatgaccttagtgtattcctaaattcagttggcaagaatttcattgaaaattttttcagctatgttcatcagataaactggtcatagtttccttttttatgatagcaaagaaatgaacccaatctagatgaccatcaacaaacgactagataatgaaaatgtagtacatatgtaaaatagaatattattcaactgtaaagaaaaatgagatcatgaaatttacacgaaaatggatggacttgaaaagtataatattaaggtaggtgactgaaactcagaaagaaaaccatgtattttttctcatatggatcctagtttataatatatacaagtatgtaggttaaaaaaatggaagtatgggtataatatgacatttaggaagaagaccaagagaaggtaatatcaatgatgaaaaagagtagaaatgcatgcaaaaaaatataagtcacaagagaagatattaaactaagaatttgtttcagtttcaactccgacatagttgttttgattgtttgggtgggtaagggaaattaaaaagtagataagccagacagttgtgggaacacatttattcccagcagtcagaaggcaagaggcaggcagatctctgagttcaagagtgagctccaggacagccagggctacacagagaaaccctgtctcaaaaaaacaaaacaataaaaaaaaaaaagtgaatagtgaaagtgtaaaaccctaagtgatgctcaatggcttcagaatggccattatgcctatacagaagttcagtgagatacacagagttttaggctaggccattgtttgaacggcttccttaaactagtcagtgctgttcttatttgtgagttaatcagaacaaagtgctttcactattttattttttatgttccaactttcttcaagattttcttacctatgacagtatgaagaaagcttcagtcatgtggcgtcattcattggctagtgtagaatgtatttaatctagtatcctaatcagtccatgagctcccagcaggcaggggcccttcaaaaccatccatgatctccaagacaacaaggactctccattgaagactctgtaagtactggagagccacctatttggtcattccatgtgaaaatacagctatggaatttctttcaactgtagagtatttaataaatattttggatcagcagatggaagctagaaagacagaaattttgtctttatgtgtgaaaatattatttttttaacttttagaactgtccaacaataaaatatgctgcctcttgaaataacacatttcctgacaccaaaaagtattcaaaacacaagtgtatagccatctgtcagggattctgtagatggaattcctgtattatttaggtcagaccacatggcctccaaaatccattctcactcaagaactcgttattttgactgactactctccttgcctctcccaggcagcacatttatctgttaaaattaagtgattcagtgagtttgaggccagcctggtctacagatcgagttccaggactggatccaaagcaatacagagaaaccctgtcttgaaaaaccaaataaataaataaataaataaataaataaataatttaaagaaagataggccatgagtttacaccaaagatgatcaaatccttccttgtttgccattttttgataaagtatatggatataatattaagatagcattcatttgtttctttcaagatttaggatatttgccacatttccaacagtaatctgaagaaaacatcccatagcagtaagattttttttgcccctatttgacagctccctgaagagggtctgctccttgtttttgtttattttatttgccttgtaaaaggctgctggagtggagccactcatcaactgcctaaaggatgacatgttaaataaaacagcatctccattcctcttgtcttaactttaactttctagaacctgtacaatcttaggaaagcactaaattgaaaaggaacttaaaaacattcttacctcccttgtggaggtaaaaatatgattccctgaacacgcaattccatatgactataaaaccccacaggttcaaaataacaagaatgtcttcctttgagttctcatagagcaactaccacaggctagacaagactgaaagcaccgggaacagtaagcagaagacccaatttccatcaatgaggtacactggccacctaacaaagggccacttccttgttaaaaaacaaaatgggtgggggtggttatactgactggttttcagtgtctccagtgccatattaagccttcattcagttcagcaaattaaccagtgtttgaaacaaggaatgagctccctaagtttctgatcccaactcttttcagagggtgctgctccactgagggcacacagtgtaccccccgctaacctgtcatagtctccttgaatgattcaggaaagaataaatcacacactgtatcttctgatcctaaacacaggccagcactaataataatgtcttacaattattaagcaattactgtgtacaggcaccaaaaggatggtaaatggtttttaccagcaatggcatcaaaacagaagaaaggttagaaacagcccttggccagcaagactgttcaaagtcggtggcaagaatgacacttcatgagggtttcggggaaaacagcactcaacagagcgaagcccagcctggtcggaattgctaataacatctcagaaacatggcagcttgctattcctgttttcttaaatagaagacatctcatggatgtccatcattggcataaatgtcagtaatagacatccattcagggtcagggtctaaaaccaacagagctctttgatcttactgttggtctaacagacttccagtaactgactcacaactcagcttttcttcctgttctcttctgacctacttctcatggctgttgtcctgtgatcgcaaaatggtcacatgctttgtcatggttaaatgtgaaactgtcctcaccccaagttggttttttatttgtttgtttgtttgtttttcatttctcgaacgcattcccagcttccagatggtggagactggtaaagtaaaagtataacctcattacatgcagagttactcgtgtgatctttttctttttctttttctttttttcttttaaaactccctttctggaaagtcagaatacagtctagagaagttttattttattacctgccaaaataggtaccatattttaaaaagttaaatattaacccacaatggaacagggggaaatgatgagtctttagtaagtaaaagtagcattaagttttcccttgaatgctttatatttggtggaagaccttcaagtctggaaggttagaaaagcgttaatttaggctagtttgttaccaagaagaacctgctgctaccaggacactctctccctctgcctgcttgactgctgtcagtgagtggaaagcagatagcagatgctgttcgtctctgcatcctgcctgtccgggtcttatgacgtctggtgtccatccttaatgcagcttgagctcactacgatacagatctctacaatctcattatcttaacctactccctttgttgtcttttgccatttttcaaactgtttttgttgttcttcttattgctgttccaacaggcacaataaaacttctttgtgtaaattcccagcctttctgagtaaattctttggatgtaaacatgaattatcagtttgttaccaagaagaacctgctgctaccaggacactctctccctctgcctgcttgactgctgtcagtgagtggaaagcagatagcagatgctgttcgtctctgcatcctgcctgtccgggtcttatgacgtctggtgtccatccttaatgcagcttgagctcactacgatacagatctctacaatctcattatcttaacctactccctttgttgtcttttgccatttttcaaactgtttttgttgttcttcttattgctgttccaacaggcacaataaaacttctttgtgtaaattcccagcctttctgagtaaattctttggatgtaaacatgaatcatcatgttactaactgaatacgaaatctcagcctgaagcagagactaaaggaagtacatgaaaaggggaatatttatgcgtcacggagaggggagtttggggatgctctgttttccacagaagcctgcatcctgcatgaaaactctggtaaaaagaaaagaaaagaaaatctttttttcttcatgtgttcggcacagttctggtaaaggagattgtcttccgtcctgttttctctcattgctaacactgtccatgtgcagaacagaatcagacaacggtgctcttgagagctcctgctgtttctacttgaacttcactttcatttttgaatctttttttatatttggcattttttcagacattctttgtcggaaagaaggagataagtaggtaaaccatcatcagaagcttccggaacaagaaatgaaggaaagaaaacagtatctcctgcctgtctgaccagctgcaatgcccctggcattgtcacagggacagaacaggaattatacaaatacagcccgggtctgggaagggtaggggactgaagaaagagaagtgttgtcgaatgggcccaaagcacagtttgataatgtgattcagtctggcattctagagcatcatgaagtcaattattagatattttgaagtggccagaagaaaagatcttgactactccccaaaaaagaaatgaccagggtttaaggtgatggatatgacaagtactataatttgatcactctgtatccacatgaagaaatatcatactgtagcccatgaatgtgcacaacacttctgtgttaattaataggtaagtgcctcataggaacattgaaagattccaaagaaaacatttcctggaggaatgcctattggcagagaagatgttcttttcctggaggaaattcacatccacttctgtgtcttgacttaggtaacctggtaacccacagttcctaaaagtacaaataggagcatgtgtgaaattggtgatttcagtcaaacaccaaaagaaatgctggaacatcctaatctggttcttaaggaaataaatacattcttattataaaaataattaggggctatgggattactcagtgagttaagatgcgtgtcaccagcctaataacctaagttccattcccggtggactcaggaaatagaaggagagaactaacctccacatgtgaatcttagcatgtgttcccccaacataaacaaagatttttaaaattcactacttaaaatctttttaaaagacataaaataagtagctgtatgttcaaaacagggattaccatatgtgaaccagaatacagcctatggtcccattaattaatttgtgtaaatataatgtaaagaatcaatccttccagaggctggttggtagattggccttgataatttcaagtttgtttataaaaagtagtggccaagaaaagagatgggaagaatattcaaagatgtttagttttgtagaaactatcagggtttctattgacattgtaatgatgaagtcaaatatgcatcttttttttcagatagaaatgtgaaagatatctcaaatagaggtgcaaatgctttgcttcaatagagcagtttgtagacttatttggaacttcaaagatccctaagtttttttgttgttttatgtaacaccaattgttattttacactgttaaagttctggcaaccaatagctgggatttggcaggaaatgaatgaatgaataaatgaatgaatgaatgaatggcaggatagcctcaaaggtgacaagcctgctggttgtggtggcccatgcctttaatcccagcactccaggaggcaaaggcagaggcatatctctgtgagttaaggccagactggtctacaaagggaattccaggacaatgagggctgttacccagagaaaccctggcacaaaacacacacacacacacacacacacacacacacacacacacacacacacacacacacacacacacgagacaaacctgaactcaaagtcaaaactgtgaaccaagttgggctgacctcccctaatttaactatagttcctgtcccctgatacaggtcagtggcccagatcttggaagcattgagaagcattatttgccatactgaaggccctgggttgtttgatccctaccaataacaaaacaaaataaatcaaagatttccttgactggggcattagaacaggaatcactcgacagtcactgtacatgcacagaaagtcacttcaaaggaaccagacactaaaaggaaagagatgagtctggcttatttcatgaatttctcctagaaagtatgcccctgcaccaatgttataaagcaatgtttgaatagtgctgtgctttggatatgtatctctaaaggttaaaatgtcaaaggctaggttcctggcccacagcattattgacagatggtgggacctttgagatagggttaatgggagaaggttagatgattgggggcagggcttgttagggatagaaggaaggagcagcccctcctcctctactcttgggctccccagtcgctgtgaagggagcaaccaatcacacactcttaccagtatgtactgcctcaccacagatccaaaagcaatatggccaattggtcattgaccagatccccctttgaagttcattatttgggtattttgttgcactgatggaaagctaacagaaatagtcattgcctacctcaaacatcatactgatattctaatgcccttaagcggtttgcaatccatttaagaacagacattttgtattgttcacatgcttaattacaaaatttatacgacacataaatggaaatgtatctgcacaagccactggatttgaggcagaggattcaaattctagctaaaatccaaagctaggaaaacagaataatctgttcatcgaaataggtgggagaagcaggatgtgctcagagaaagccatgtttttatttcaggctaccagaaaggaatacaatggcagatttcatatcatctggagctaccaaatggtatgcaccttcaaagcagattctgtgtagcacctacaagcaggggttagttttcaaagccctactcactgtccttctttctacctcctcaatcctcaacaccaaacctaagagccagaatttttcagtgaacagtcctcactttttactagaattgaattcaaaagaaaatgtggtcctgagtcgttaagcaggtcagtgcatcaaggcaactgatcacagagagaagtctgcacaatgaaaataatccttcaactatgacatggaaggctgcattctctctctagttaagagacgtactgcttcccgtacaggagggagattaacaagaaacaaatattcctcttagaatttcctgtacgggagaatcccaaatggtttcagtaataaaagcaatgaacacttctaaccacaatgcaaatattccagtaggccaactcaaggcaggttacaagaccaattttatacccagttaccaaaatacactgtggccagcagtaatttgtgtcaacccaggtacacctttcacctattgaatgaacagtaaggaaatataactgtcagaatggaaatgggcttcatgaggaaggctgttgtctctttcccacagggtcaccttggtccacagcttgttacttagacttcatttggtattggcaaaagtccctactagctgccagcggaacagaagaagatgacaatatggtgcctgtatatgctgccaccagagcccagtgttttgacattgttactgaaacaaactccactatttatgaaagctaagttgaatcaaacagttggtgtggcaggaaaaaacatctgtttctgaagtctttttgtttagtaaggcactacggaaggagaggaagcatggcactcacaccaacataaatacctcccaaacaacccatgtgggtagtgccatatgggatcagacaccaacccagtactcacctggcagatgtgactgatttgaaagtggtggcacatctctgggggtagttttctggatactttcaactctccctttatagataccaaaagtagtatgaatcaaatagaaaatctgcccacaatggagcatatgcttttttgtcttcttaaacagagaatatggacaggaggtgtaggtccatgttagcctgatatgtatgagaatattctagcacatgactgccatgataaaatttacgataactgccagtcatggtggcgcatgcctttaatcccagcactctggagacagaggcaggtggatctctgtgaattcgaggccagcctggtctacaagagcgagtgccaggatagagagagacatagagagaccctgtctcaaacccctaccccaccccccaaaaaacataacaataactgatcatctagaatatcatgactaagaagtgtcctttctttttttgtttgtttgctggggggccggggtgatacaagttctctttctttgggtctaaatttttgctaaatgcacagttaaactataatataccatgaggtactctctgacacatttaatatacaaatacattctttaagtcacaaggggaatcactgggagagaggctacttaagaacacacttttcaagcttcaggcacatctgtatatattgaagttgctaggaaaatgccatggtccttattccctactgagaaaactcagcagcaaactttgaatttgaataacctgatcataatccatatttaatcacacaaatggacctgtaatccttgtagaggtattttggggtgggggagttggttctataaagtgcctccagaagagactggatcaagaggcaaatgatcacctacttcataagtaaaatggcattctgataagtcactcatgacagcaaaaatataagaagcacatatgagcaagatatataaaatggagttgtaacccggccacagtcgtccagagtttcccacagtcagtcattcaggctttcccacactggcggcatgttcaagggctttgctaatttgcaagtgtagttgggctagaggaggctgcttgactttccatacttaagcactagtttattttttaaatgagtcctcagtgagaggtaaacactaaccatgatgctttgaacccgtattgttatgcaaactaacaggggcagaacctgctgtggtctgctctcagaagccccagtcctgaggagtatgcaatagcccttcccattccctgctagaaaatgccatctccctgatgcccgtctctcctcacctcaccaagcccctaaagttaaagtggaccccttaagttttctttctttgacctctcctctaattactaggttttccaaaggccttttgcaaactgctgcaagatgatgggaagcccatctcgtgataatgaaaatctcttgccaagattttcaaatagagacctttaaatcactcggatgacatttgtctagccatcattcaggctggagtaaggcagtctcaaccaacgtagccttgcctagccctagcgagtaaaggcacttagggtgcaagactcttgtgcattaagatgtcttcaccactacataccaagaccagaaacaaagcagaagtaaggagttgttttctaaaaagggtgtgctagcacagttccaaaaccactttgtgaagacatacataagatgcaaaactataaattctgctgacattatgtagtagggtatatttgaacatacaatttacttttctttcttgtataaaagaatggacctccctttttaagttttgttttgttccatccaagactggaaataaatgtaacacagcaacagagccctggcttagcatttggaagtagcatggtaaacaaacaaagtaggactggaaaaaaacagctcagttggtaaagagttcttacctattttttacaaaccctggtttcagtctgtagcaaacatataaacgaggcacagagatgtgcaccttggaatgccaggaggatcaagagttcaaggccatcattctcagtatacaatgaatttgagggcagcctgagaccataatatcctgtctcaaaaataaataaatttctttacatctggctaatctgtgtcgtactgtagtagaaggggaagcatgcaattattgtacatatcagctgtctgcctgagggagctccttctcctacactgagtaactgattccttctacactggcaatctacagcaggcctttactttcagagtgggaacttcgacatccatgactctacgctctgccaacttcaaaatcttcgagattaaacctcacccagacagtctctgctcacctttacaaccacctgagttgcaaacagagcagagttcattgtaagattctggaccctggagtttctgtattaagatttttaagccctttagaagagcttgactttcaaagtctctccatattggaattgtaaagttcatccctctttcaaaaaaaaatgtcatctgaagccatggatatggctcagttaggaaagtgctgcgtgagcacgaagacctggtatcactccccagtgtgtgtctacagcctccaacatgtacacacacacatcacacagacagtgtgagaagcaatcattttcctcttgaatggggtgtccccagctgacctcccctcaacaacaccaccctagcactcccctgaacagaaagctttgtgaggaaagagactgcaaagtggttcctggcatgaaaaggctgctcaataaacacctgctcagtgagaatgtgacatcttataactttgtgacaggatttcctcaaggtcttctctcttggacaacctctgggggcacaggattaccagcaactggctgaaacacaacatttatatgtgtcttgggagttagtctgaccaaaaaagacagtccaaaatgaataaatcagatacataaaacatcacagactttgaccttgtgcttttcaagactgacttgatttataaagccttaattacaaaaagacctgagtctgaggcctggggatgtggctcagttagtagagcgattggctagcacatccagtccccagcaccacatggacctggctgcggaggtacacacctgtgatcccagcattccctgtaatctcagcactgggaggtgcacacaggagaatcagaagctcggggtttacctgagatacatagttggacaccatcctgggctactgagaccctgtcttaaaaacaaaacaaaaaacaaaaaacagcaccttcatcacacagcaggtctgtgctctgaacctcactctaacaatgaaggtgggaatattaccccaaggaggaggctggcagtgccttctgcacacagcaggcctgtagcaaaggctgttcccgagcatacagctagtgattgacctctgcacagctctgctccctgtctgtccatgccaatgctgatccttacaaggtcaagttttctctcaagtatagacatcctagaccacacaggtcagcttgcccaatttggtgctgatgtgaaaacatgcgccctgggaaggaatccaggaggaaagagctgcacttcacaccagaatactagtctattcacatgggaaagaaagggaggaaatgaacaggggggaatcatattgctgaactatctccatggtgttcagggatgcaaagagaataattatgaaaataataaacaattgaattccagctctcctaccctccaaggtcaccagggggcacgcagagccgcacaggcctgtgcagagatgctcccacaggtgacagcctgacctggtctgaaggctacaatgggcaggcagagccaagaaggcctggatccactctggccaccagctgctgcttcctttccaggagatgctgtccaattgcagccctatagagccttgctttgaacctaatatctggagaccggcattgagaggcaaaccacaaatctttaagtgccaattatccagactctgaacaaagggatttgataatacactggctatttttaatctccaaaacttccaatctcttatgtaaatgggttagggttaagactatttacatgagtaacctcaaagataatgttcacacaccggtcctgagtgatgcactgtggcatgcctttgcttcagtagcaaagctttctggaatgtctgctctaatttacaggaattccagatagtaatcgaggtaactgctaaatgttctgacccccaggccttcaggaggaggccttagggaagacagagaatgaaaagcactaggggcagggagaggaagaggaagaagaggaacagggaaggaggagggaagggaagagggaggagtctaaagcgatgcaaagctctcagttttcatttcctctaccgctcagggattcaacttgagaccagttatgagaagggccaagattttgcaagtgtcttgataactctagagaagtgctggagacagacagtgtcagggagggaggctgcacacatggtgttgtagcacatccgactaacaacgcctatgtgttattagctaatgtcccagagcataacagcaagcacctggggtagtgagggaggggtatgagagttcatggtaaattcctaacacagcagtgtttctgtactgtctctacagtgacaaagcatactcatttgtcattcaactggagacaataaataaaatacggaaccttttcaacatttaaagtgtatcattcagggaatacccacatacaatgttaaccttttaaaatctggctttcatgaacagaaaggcctttcccgacttagtcttagaagtcatagaaggagcattgcacgcttgcatgtaccctactggtccaagcagtcacaagcttccccaggcaaaacagaaatggacttcgtaatctcaagagtaggaatgtggtaaagtcccaatactgtgtatggaatattcactgtggcttcctcaagcctggcacttcctaattccttgaagatagctgactctcttgtaaccctgaagacgagggctctcacacagtgggtgttcaaaaaacagtttagaaagggcatcatgaattctcttgtcagaggaaaggaacgatgtgaccactaacttgaattttatatacaagatgttcaaagatttgtagtaagaaagtgcttgcaagggtctctgcctaagtacctttcagaccaattggaccagttcttaaatctgtaaaaataggaaagcaagcactgttcagtagtgagaactctatgacctgagatgagggtgagagaaaaacatagatttaaaccctgactctactacttatgctctgcatcttacactgctgaagaactagctcctcaattccttttgttctctctttctttctttctttctttctttctttctttctttctttccttctttctttctttcttccttccttccttccttccttccttctttccttccttccttttttcctttcttcttcaatacagggtttctctgtttagtccttgctgtcctagaactcacgttgtagacaggctgacctcgaactcagagatctgcctgcctctgcctctgcctcccaagtgctgggattcaaggcttgtgccatcaccatcaggctccagctcctcatttttaaaacagtagcaaacaacactacctggctcatacacctgggagaattcaatgtatcagtccctgtaaaaggcaagactagagctgggcacacactggggtgcccaatcaacacacgctgcactcgaatcattgccacttaaaagtcttcagaccattcattccccggcaggcagtaagctcttggtaaaccacggctcttactcactgtctgcattttgtccagcctccatctgcctctctctcacctacttccaccaaatagtgaaggagctgctgacaaaatgcacaatgtgacaaatcaaacattatgaacttcctcattgtcaaaaaaaaaaaagagtgaaaagctcctgataatgagattgatgactaattcatatgccattgtatagccttcatccaacagctggtggaagtagaagcagacacccacagctaaacactgaactgaactgaaatccagttgcagagaaggatgagtgaagagcaaaggggtccataccaggctggtgaaacccacagcaactgctgacctgaataagggagaactcttggtccccagaaggataggtgggaaacgagcataggactgatccagacccccctgaatgtggtgtcagtgaggagaccttggaaatctatggggggcccttgtagtgcatcagtacttatccctagcataggaatggactttgggagcccatcccacatggagggatactccctgagcctagacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataaatacatttgggggtaaagtcaggggctagggaaggggttccattgttaagatacttgccatgcaaacataagaacctgagctcagatccacagtacccgaagaaaatgctagagtggatcaggcctgtaatcttggtgttcataaggaggaaccaggaagaccctgaagctcctggccagctccaggtcttgacaaatcatgttctcatttaaacaataaagacccaggaagaccctgaagctcctggccagctccaggtcttgacaaatgggaaacagatttaaacaataaagtggatgggatggcaggatggctcattggctaaaggaacttgccaccaagcaagaaagaactgacacctccacatagtgcagtggcacacacacacacacacacacgcacacacaggcacacacacacacacacacacacacacacacacacacgcacacacaggcacacacaggcacgcacaggcacacacaggcacacacaggcacgcacaggcacacacaggcacacacacacacacacacgcacacacaggcacacacaggcacacacacacacacacacacacacacacacacacacaccccaaataaaatgtacaaacaaccaggtgaaaagcaatagacaaacagatacatagatgtgtgaacacaccaaacacccatgagcacacatatattctcatgtatatgaatgtatacatataaatatgagggagagaaagagtgagggaggtggaaggctagggtgagagagggagaatgtgtagtgaaattatactgtggggaaaagccacactgggattcttcttgttgttgttttgctttcttttaggaaggaaaaaacaaaaaacaaaacaaacaaacaaacaaaaaaaacaaccctaacctgacagtgagccagactgtgattttggttgtgtgaacagggctatcgcctgtcttattcaatgccacatttctgattgtggcttcagcactcagcactcagagagtacttcagaataatttgttgaatgagttgctttcattcacatgaaatcaatggccgggaaaggatctctcttaatattttagcctaagtaagtacttcaactttgaagctggaggtaatcgtattttaatctataataatcttgtttttccattatgaaaatgttcccccactttgggaagtgagcttactttttcacttcactgatgaagataatcaaaatacagcagaaaacactgaagaggggagaaatggggaaggaaggtctttataaaggaaagcaggacccacaaaaaataacggggatgaggagataggctttgtaacaagttcaatccttgtaatgccagaactagagagacagaaacaggcaggggctctctggccagcaagcttagaccactgggctatcctgcagtgaaatcctatatcaaagagaggtaagcagcacttaaggaacaatacccaagtctatgccctggcttacacacacatgcaatgtacattcacatgaaatgggaaaacagtaatcatgtatggtcttcttgcaactgacacccacaacttaattcaaactggccttttcttagggatggtgccagagtgagacccacgcacacaataaagcctaactatacaatagtacctcctccatgagaaaggacagcactaaaacaaatgctttccgatggtcccctaaggagggcagatacccaccaggggtaacttctttatgctttagctcatgctatcttactcggatgtgcttgagacctgcactcccacaaatgcttcacccactccagtcattagcagtgagatgtggggatctcctccctgctaataaccactctgggcatctggccttgctagctggtgtggtttcaacctggccttgggtactgatgacaacgactaagcttcccacatcagacaagcacatgccactcaagactggatgctgtagtcttcagctgaacaccagctttggggactactcgcctaacttgcctctgctggagccatcttggtctgtcaagtatgttctggtccttgccattgtcaggaggacaaaaactgatggtttcttaaacagctgtctgagagggatggtggggagggcacatgtgtgcctaggctcctccctcctccctctcaccccaccagtgcaaacagccaggctgcctgaacttgttccatccagctgactccactggcctcttcctggaagcatttctgcagctctcagaagccctgcagaggcacttgtccagtgccttaaacttcacaacttgatcttgaggtgggaacctcatatcctacacatcccattactcatgtcaattcacatgttaaaagtagagggccaacaggtctcagggatctattccgaggagaaggccaagacagaaggggtcccagcgctgagagggggaagtagacatgagttcccatccctaaccaagatactatctccaattgaggaccacttgcaaaggaaaaattagtcttctcaaatggactctcactgggtatacaaaccacaaagggaggccccaagcccagtagtagattcgaacacaaaatgaactcaatggtatttttgggagatttgtatctcatattgatttgttcaaacattttttttttttgcctacatatctttcacttgtatattatggtttccaattttgaatttttatgctctctctctctctctctctctctctctctctctctctctctctctgtgtgtgtgtgtgcgtgtgtgtgtgtgtctgtgtctgtgtgcgcgcgcgtgcgtatttctcatgctgtttgttttgctttcttcttttttaatttgcctgtttgttttctaaagagagaagggaaaagtgtggagttggaagtgtggagaagtgggaagaatctggcagaagatgtgggaaaggaaacagtgaacagaatatattgtatgaaaaaatatgctaacttcaattaatggggaaaaaaagcagagggccgagacagccacttctttttaatgttaagagatccaaagtgacatatgagaataaacacaaacatacacactagcctaggatgaaacaaaacaaaacaaaaaccttccttttttagccccaaagccttatgggactcatgatttataaacaacagcaacctaatctaaatctatccataaaatgtactgagagccttactctttccagatttgggaaaatgataatctttacatttatattttatgggactaagatgaaaaagaagtgcacatgcatcagcctatgttctcagcaaccagctggacagatggtcaagaatatcattagttaagaaagcttccattcattaccagagagtccctgggcaggctggggtggggtgcaagaatgtcccagaatgtgttatttgaagaatgtgttcgtgtctaagacatgagtccccgtggtggatgtgggggagtaggaacagacagcctgttgtgatccaacagcagccaagagttcctcaacactggtgcgtccaccagacacttccggctcccattccacccacttggttgacagtactaactaatggtgaagaagaaaaccaggaggaggtcccagtaactatcatgatccctccattctaggcacaattccacccaaacagaaatctatcatagacggaagagaaattgctgtcttgttggcttcccttctcagctcataaagattgtgagacgagaaacagacagcaaatgaaggggtggcgagtactgagtcaatccacaagaggacccataccaggtcacacccacctttccagctcagctcctcattcatacccaccagaagggactctgacagaagggtgagttcccctgccctagtcatctttcctccccctcagctccccacaccctgccctgagcacctactgggtatgagatgttctgtcagacacccacagggttacaggagaagtgagaaagtggagacactcagctcagctcgtgactttagagaggagtttgtgagtgaagatcaatcgacattcacagcttctgcacaaatcagtcttcaaaatgatccaagcattgcacctcactatcagtgcccggaattggagaggtctatggaagaaatcagagatgccttgaggatagatgagagagcagaatcaaccaagaggcaggtacagagactggagcaggaaatcagagaaaagagggacagggactgtgatggagggctccttcatcctctctggttcccaccgctgcctcccttctctcagccaactacctctgggggtatattatccctagccacttccttttgctccctggttcctacatctcttttcccccatgtgcttcttctgtcatgatgtcccgcagaagcagctggggccaaatgatcatgcacgtgctgaacctcccgaaaccataagccacagcaaaccttccctccctcaagttgcttttctcgggtgtctgtcacagtgatggaaaatgtaactaatccattaactttattaaagaatttagaaaagtacatacacacaacaagttaacaaaatatcagcctgtgctcctaataccaaaatctagattttagcaaatcactaatcaattaaccaagtgttaagataaacatatatgcttcatatattttaaaacatgctataaaaatgacctattagtctttctagaacaattcccccccttttttcccttccaacctaaggttgtgaaagtcaaacaagacattatggtggctgaaagctctgccttctatctgcttcataatatgaaaataataacatactcaatattttatgtcttcaaaatgaaagtatatggctattataaattaacagtagaaacaaaacttccttgtctgtttgcaacatcaggatgaggcatgaatacaacaatgaggaaagtgggaccctgtggtgacataaggatgcctcccctgtcctggtatcctgtggcatggtgtcatgtgcttttaatcccaacagtcaggaggcagaggcaggcggatctcttgagttctaagtcatcctggtctacatagtaagtcccaggacagccagggctaaaagtaagagtctgaaaaatgatgatgatgatgatgatgatgatgatgatgatgatgatgtttgttataattcactttttccattctgtagatagagttctggaatccaacagaactgaattcagcttccacccctcataaatcctcgcactacaggaagtcataaacagccaggctcccgtttgcttattctgaagcagtgttataagactatcttacagttgccatgggattgaatatagggataaatgatgaaagaaagaaactttccagggggcaacaacagaagcaagctggtgacatctttcatcaaagcgcccccagcccttctgagcaaagcagagttgaaaacaaggtcgagcctttctgcttccagagcttctggaagtgaatcgcttgtgacagcctttcttagacgtcagatctctcccttccatcctctttcctgcacttcccaagagggactgagaacacaaggaatgccaaggatgagaaagcacaacacaggcaacccgggactgaggggtggagatcagatctgagggaaaagaatactgtcacccacattcatgccaatcattcccaactttatcaaactactaagcacgagcattcagactcctacattagtttggacatggggacaaacaggattctttcagtcattatcatttttttatgacaccttcacaccccctgcacagtcccaggggtaatccaaaagtaacagggctcaagattgtttgatgtaacaccagctacatcctggtaaccagagaccactctggactctatcagggccccacctccctgaggacaaatgagcagaagaccctacgtgccatccagcctgcctctacctgccctagtaatctgtgccttctgaaaaaaatgtaagtgatggaaagctaactagaggagggaaagagggagtcagcaagagtggataagccaggcatgaaccagcacagagcacagactactgtggtcacagaatccagcactgtctctggtttccaccacccagatgaaaggaactcctttgtgggttggagggaagggacttccctaagataccagacacaccaaggtccatcctgatgactagagaggagactgatgggtggcctagagaccactgtcacaagagaggaagcagccacagaggaaggcctgggtggctgcttagctgtaaaccatgttcacagaagcatccaagcaactgagagggccccagtcacccagaaacagtaaccaggctttctgaggcacgggggtgagggtgtggggggggggcactgggaaggtagacatgccaggaatggagagctcagtgctctcgggttactgatacagacaccattgcctcagtctctgatatgaagggcatcctaaccatgctggtcttttaaagagccaactgtgggagactctcaatcatggacgaatggccttctgaaaggaggacggacacataagaagtaaacaacagctatgcacatttatgctttgcctcctttcctggagaaactggacactcaacaatcttcctcctctcaacaaagtttccccagattcctgaaaaacagtcaagtttcacctgtagatgagcaggcagctaatgtttcccaatggctcaatactagtgggtgtgaattctgcattagtccatgtggccagcacacaggcactcaaggccagagaggaagaggaggaagcaatacattgatattccgaattgttatgaaaatgtttcaggctaacctggaaaacattcgcaatcccaaaggtataaatccgatctaaaataagtttttacaaaaagcaagacagatgtttggatttgtttccaatgcattaaagaaaataacaacacgttactcccttgaacaaagaatttcacagtgtaaatggtagctaattgtgaggcaggaaaagagtgtttagtcacttacatttttgaagtaaaggttaatttgcggaaaatgagaagttaggacgtgtgtaatgaacccaacagtatacaatataaagaaccagaggcaacgactactcaaggattaaaacaggaggcaaagaagtaagagaagctaaagtacatttcattcaggctctttcctccatttagtcatgataggcagatatgcctctagtgatgagcatggtcacccacaggatgctactcaaactatagtcactagactcatgcccctagaacactaacaacgtttcacagaggctgtggggtccagcctgcattacataatgagaatgnnnnnnnnnnnnnnnnnnnnnnnnnnnnnnnncatgaaacactgatttttactaaaaccaacacatatctttatgttttttagctctcccatataaggcaaaccctcacatgatctctttatttgtttgtttatagaaggaaattctgaactgagcactcttctatggggagagcggcattcatcattttaattattaagcatagccaaatatttatacatccttaaaccccaaatatatgagcagttagatgagtattttttttcctttttgccttactataaagggctatgtttcaattcatggatacaatgtgattatataatatatccctttcactgatatattgtaacatagtccttcctagtaatatttcatgacacttttatttgaatatctgtgactttatcaatgccactttgtatcttctaaacatattttagacttcatttgcctacacccctccacaaacacagagaactgtttctgaagaaacataggacagaagaaaacagcctctttctcatgagattaaacacaccaagaaaacaaaactatatatatacacaggaacttgaacacaaatgtaaacaaatatgcatgatccactccttaacaccatcaatcaaatccccactggctagctgtcttctcaccaaatagtaaactatgatggctggagagatggttccttggggtaatgtccttgctttgcaagtgtgaggacccaagtttgaatccccagcacccacataaaaagctctgtaatactaagttcgggaggcagacccaagcagaacccgaatgcaatggttaactgaaataatgagctccagtttccctgagagacattgtctcgaaaaataaagtgggttgaagacttcctgacgttatctctggcctccacatataccttcaagactcaatacactcgcccacacatatgcataacacacacacacagagagagagagagagagagagagagagagagagggagggagggagagaaatagacccaaacatcctcaaattacagacttgttatttaccaatactatatgtttactgcctggcaagttgattccaagttcaactggtaagtgtaaatttccctggatgtgtcacagtgatgcactgaagaagggagagtctctggcaccaggcaagctgcacaagaaaagacaggtcagtggtggctggatttgagaatcccagtagtcaacagtgaagtcttactaatgtgaggtcacattaagagacagatgcaggcccatgtccaccacctcggaggccaggatgactgcaccatcctcctggtcctcacaggcgaggccttttcccatcaaaggctctggtggacggcactgcagatttttatgctgctttcttttacatcaggtttattttccccatgttaaaccccgtcaagtttactgctcagaaacccatcttagaaaaggaccctcctcactttgaagaccccttttaagaaatgtcaaggggcagtaaacatgaaatagtatccatagcaccaccaatgacaacaaaagcagagcaaagctaatcagtcattcccataaaaccacaccctgtagtctctcagtagcaacccaatgagatttgtgaggggaggtaggcagtggaggactaggcagctgaaagacagacttcctgctgcgatgtccctcctgtgcctctgtcctagtcaaaagggctttgggggaaaagaatgttttatggttcctctgctgttcaggacccgaacagcaagtttatcatgcctggggccctgtgtgggatggatttgctcatcttcaagtttgcaaagtgaaactcgaccttctactgttcagactcagtctttaaatcaaaccacacagacaggcccagcataagggcaccttcctcctcggctggtagcttcctggtgaacagtgaggtgatcaaggagacaaacacacacagtgtaagatttggggccccaacctcaagggctggggcctcaggagctaaagtttgaagtgaagcaggcagatttacccccaaagccgccaaagcggccaacagatgttctctaggacagaatgacacgattcaaagatttaagaaaaggagatgaaaaagaaaggaaactggatatgcacttgtcacaactgggtacaaatataccctaaagttgtagattagaatgactccatctaactagtaataactggaagcagctaggctgcctgctctgaggaggcttgtttgctactactctaaagaacactttacctgttaatacactatttaactgttgattaatttaatttcataacaacaacaaatccaagagtgagaggggtagaaagtatccctcctcctaggctgaggatatagctgcattgctagcctgctttcccaacatgcatgaagccccgggtttgatccccagcactgacagggcagggtcaactttagctatagagtgtgtttgaggctagcctgggatataaaaattctgtctgataaagaaatgagaaggcctccaaagccacagagaaaccctgtcttgaataaacaaaaaagaagagagagagaaggaagggaaggagggaggaagagagggagggagggannnnnnnnnnnnnnnnnnnnnnnnnnnnnnnnnnnnnnnnnnnnaagaggaaggtagaaagggaagagggaggggaggaggagggggaggagggaagagagagaggggagggaagggagggaaggatggttactcccattttttggagaaactatggctcagacttgctaggtgatctgcagaaacaagcagggaactgaaaatacaagtgaggtcttgcctcttccctcacatctcagctcatctacaattctctcagatgggaaagaaaattgactctcagcttatgcctgtaactgtggcatggtggatgcccagcttccggataaatgaacacgcactccctgacactcttcggtgaaccttttcctttactgccctgggccacagtgcgttgggcctgagagtgtcctgtggaatcttaagaagtcagaaaaacagggccttgtggggaaagctggctcccagggtgaatgcaaacgtcatctgccttgccccacacagctccagaacttggaccagtaggaaccccacggtgcctccctgctgcacaggccactccccctgctctttacttccatttctctcagttttaccagaagattctacctagtcttccctgcttttatctaggccaagcgatgttttgccaatgacagactctggggattttgttggtttagaatcaacttgttctcagcttctcccaggttgttaacaggcatttggtccaagccacacctcctctaggcctgagctctcccacacaccagctcctgctggcttcaaagaagagtggtggcaaaagaaacacccagattaaaagacaaaccctgctgaagtggaactccctcttggtgggaaccaggtgcagccattgctaaccccctccctaagaagggtcaaatctccctagttctggtcatttctgagagattggtttgggtgaattatctgttgttctcgtttttttttgtttgtttgttttatgaccttaagaattgaactcagggcctcacaaatgctaggcaagtgctctatcatcaagctataaccctattgctcctttttactttcttgttctgtttttctgaagacggggtctctctatacagtcctggatgtcctggaaatcactgtgtagaccaggctggccttgaactcacagagatccatctgtctctgccccctgagtggtagaattaaacacatgtgtcacaatgccaggctttctttttacttttactagacaggatctcattagattgtctgggctggcttcagacttagtcttcagctgaggtaggccttgaacttgctttccttccacctcagccttctgaatagcaattatttcaggcctgttccacctggcccagcttttgatcatctcagatgtgttccaatctactgcgaatgtgatgacaggctcctgcaaggcccaacttgaggaggaaactttatcaaattctacagagcaatttagacaagcaaaaggaaaaagacccctcaactattggctccttagtgatatgtgccaccttaaagccaaggccttgacattacatgatagtcctcagatgcttagtttgtaaaaaacgctcaaatgatttccataatttgctgccatgtgagcagcacaccaagtgtgcttgcagacacaagccaggagtgtgtgccacattgggctctcattcctttgaagagcagactactcattacaatgttctttatttcatcatacatcttcactacaacaacagccattttcacttttatttctccatcaaaatgttcaattttccatatctgagtttcagtctcaaactccccatactcttcttcctctccatctcatttctaatattccactttccagctgaaggtactccaaagcctgacctatagtcagcatttacttccagacctcctgaatgaaaaagactcactaaaaaagaaggcagcggaagacatgttagtgactatttttggatcacataagcaaaactctatttttccagagaaaaggaatcctttaacctagtttgaagatggaaaaaaaaagagttagatatactgtgttcaaagttttgtttattctctagcaaagatgggggaggatgcatagttccaatatttaaaacgtgatcccattttcctccacaattaaccatgttaggcgaatggtaaccttaaagcaatgcaaacaaatacagccataaagtttaacaaagggtctcggctcatgttgctgttgttgcctggagatgacttgaaaatgtttcctttaatgcccctctaaaggatatggggttgtgttgtgttgtgttgtatgtctgctccaggaccacagtgaatctgttagctggttgggaacagaactcagccaattcaggaattgctcacatgccagcaccgcatagggaaacaggaaggcctaagtggctgttgtctaacctgttttgtgttgtctttgcttacttcttcccaagctcttagcaaacaggtaatgggagttaaatacttactgtgcagtcactgggctggcccaagtgcaacagccagtaacttcaaaggacacactagcttggatgtctttcacaggggacagagcacaggccccagggcttattataaaactggaggaggcagtgacctcattgcctggcccctggtcacctgagccacactacattctctctctctctctctctctctctctctctctctctctctctccctccattgtacattgtgtgtccttataccaccttcttggaaaggtcatggtccccaggctcctccaccaaagcaggaaaacacagaactagagaccaagaatcctgaacatcctgttcatttcttcccttgcatctacatgaaagcatgcatgaagtacttctttattttaatttacaacacggtttcacaacaaacaagatagaatccatgttacctagaaatgcccaaaggcatatagctatagccgaaacactgaaattccagttgaattgaaaagtgacattaaaaaaataataataataaaaaaaaaagcaagacactgacttaactactgagctacagtaactttacagaaggaagcctgggccggcatctatggtcaattttccaacccgctgtggcactttcttgtctcagattcagcatgaggcttctctcatctatgaagctgctcttgaatgtcctacacaagtgtttgttttccactatatccctctggtctgcacacccagaaagcagtagtagctccagctatgcatccaatgctgctcaagtctgggagcaactgaactcccttggcagattcccactctccacactcccttcagcctcatgagtgtgctgtgcaaaggacctttggtgcctccctgaactccactttgatacactcgtttgcttggactcttaactctcagcagttcatctccagtatctgtccccttcatctccctttgtctcagagcagttaaagaacgcactggtctaagggtcagaatccttctgcgcttgtacgtgctctaggccactgatctcaccctccactgagaacagaggaccaggaaattacagccactttttatgggagaaattttttttaaaaaagcaagtactttgtgacaaacacaaggtgtgtgggtgatcgaggcctaaagcaccagagtttacaggctctggcagacatcatgaagcctctccactactctctgggtagagacaattctgtcaacaagagacagaactaaagaggagggtggggaggggactaacatgtaggaaaggatttcccaagaaattattttcattttgactcttgttcccattgattcactgaggaagagaaatgcaaacatgaagtagctctttctgctaacctgcaccctgtattaatggtgtctgtgtcagggctggccggatggcacagtggttaagatcccttgctgttcttccagaggattccagctaagttccaacacccatgctgtgtagcttgctaccacctgaaatttcatctccaggggacctaatgctcctgatgtacatgcatcacacacacacacacagacacacacacacacacacacacacacacacacacacacacacacacacattttttaaagtttcatgtttataggaagccacaattaaatgtaaggaatcagtcctggtgttccgttacacagaagcatcaatacaaatgataacttaaggatattccaagaaagtcggaagtgatggctgttttgtttgtttgtttgtttgtttaatgcccctgaagtaaaagtttcaacagtaaaatgaaggaaaaaatgaagctacacacagaaaatccaagaaaagtctaatccaacagtaaaataaatcccccatattgttgcaaaagactgtcaactaaaacgctttgttataacaacaaaatcatgtatcgcacagaacagattccaatgtcctaaagtaacagaagtgggctatcaaatctttcaaagtacactgcacaaatgactagtgtttagaaacacttctcttataaaacatgggccatgtgtcttcacaaactggtggtgtgatgtcccaggcagcggtgtgtattgctactgggtggggcacagcatccaccccttgaatgtctcataactttgtccttcctttctattgaagttgaatgaattcacctgacccactggccaaccaagcttgcttaaatctaaaaattaaagtagaaagtttagaatgactgaaagttattgaagtcagtgaagacaactaccagtttcacaagggagctaaaatcctctcaaaatgtgtagtctcaaatccaacacagaaacgaatgctataatctacgttgtcacagttaggttgcagttctgaagcaggtaaaacgggggtcaagaggtgactttcaggactgggttctagctcagtgggttaagtactagcctgacctgagtctaatttacagagcccacatgaaaagcccagagtgggggctggagagatggctcagaggttaagagcactgactgctcttccagaggtcctgagttcaattcccagcaactacatggtggctcacaaccatccatcatgagatctgttgccctcttctggtgtgcagatatacatgaaagcagaatgttgtatacataataaataaataaaatcttaaaaagaaaaacaaatttaaaaaaagaaaaaagaaaaaagcccagagcagctatgtcccagtgttcatgaggcagaggcaggggacagagaacggaggacaggggatggggtctctagagcttgctagccagcctaagctgccaggtgagatctaagtcgatgaaagactctctttttctgtaattataatcaggggtccacacttctcttgagcatgcttccattccgtatcactgtacatacacaccccagacacagtagcccatatttagtcaaagaaaatacgttatggttgtttaggatatatttctaataactattctcatcatgatgctagatacttaattccttacaatcatttggagtttcaacctgccaatggtggcacatgcctttaattccagtactcaagagacaaagacaggcagatctttctgagtcctaggccagtctggtctacaaagcaagtttcaggacagccagggctacacagagaaacctgtcttgaaaacaaaacaaacacctggagtttcctatgacatttaggctatgcaaagctttagctctctgtaaattattaccagattcagttggaagtggtgaggcaggtggaactacaggactttgaggccagcctggtctacaaagtgagttccaggacagccaggattacatcgtcttgaatgaatgaatgaatgaatgaatgaacgaacgaacaaacgaacagacagactgactggtaaataaataaataaataaataaataaataaataaattgttgcaagattcttctctgagtatgttggaacagcacagtgtaaatgaaagtgtttgcccatgtcttgatcatgctgagtttagacttttttctaattatttaggcagataactacattctaaagtgatacaagtatttaaatatatatatatatagtcaccatgtcattttttgtcaactgttgccttcactacttagttgattccttctaaagcatagaatcatgccatctggggaaaaggaacccaaaaatatttgcttaatcataactaacattgtaatcaggacaaaaaaaaagaaacaccattattccctactgaaggaaaatgcaattataattagccttctgaaaatgagtaacaatcaagcataaatacttgttaataggttcacacataagcacatgaaaacaaaattgacccggtcaaagaaagaacacctttctctccttcctaggcctcagtcccactgtctacccccactcccacttctccagggggaaacccaccttctgcagcatggtgaatctacctcagcatcctagggggtacagtcctagtcttctctgaccctttttcttgtatcccgtaggtatttctctaaccaaaatctatcttcctttccatgactgctgcccacggcctgcctcacatctgccccagctgccagtttctctctatcccatgctcctagatctgcctccaggagcacagccctgacctggtccctcccacaggtttgtaggttgcactttgtgcaacctacaaaccaagtatcccctggttctcaccaacaaagcccacttccagccgcgtcatctggacttctttaggtgtcagcttatggctcccgggactttagtgttcgtggtgcttaaaaagatgctaagtatcctaagaactttaggttgggattttaagctagaggtcttgctgtgcccatttcatggcatctagtcagtaaatgtaaatttactaaagctaaagtcttcattctatctttcagcgctcagtcccttcataggagaacctgcatgaattactaatcaacagactaaggaaccaacagctccatgactgtcagacccaccagcttgtcttttagaataatacacctagaaacatcagtaacaaactcaaggaaaaatagcaatgctaagaacactctcatcaattagtcactgagaaatgatgtggaatgcaaagtgaatgttgggccttcaaagtttaggctctgttatcaacttccacctacagcagtccagcaaagacacagatgtgcgccaagaaggaatgtgttagcgagtgagactaatctacacacttctaaaagaaactaattcttctcaaactgttatcataggtaagcctcagtttgcctaataacaattataaaatgagtggaagcccgcctgacaagcagccacatgtcctaatcccatcgtaatgtggctggtgtggcctggactgagcaaaggggattcccagctcagccagcgttctttaattagcttcacaaccttgggcaaatcaccccaccttcagcagtctccccttcttcacaagggtaataagaacctttgactctgattgtttttaaagatttttatcccgttctgaggtttgacttgtgacgtatgagtgttagatataagtgtttttctaacacacaggatagactgagggaaactcaaatgcattgtgctaagtgaaaaagccagataagtggtgtgtgattgtattcacaaggcaaacgaagagatgggtggagggaggtcaggggtcaataggggtttgaggtatgggggttgtatgtctgcagtagggtagcataaaaatgtccttttgggccggacagtggtagcgcatgcctttagtcccagcacttgggaggcagatgcaggcagatctctgtgagttcaagacaagcctggtctacaagagctagttccaggacaggctccaaagctacacagagaaaccctgtctcaaaaaaccaaaaaaaaaaaaaaaaaaaaaatgtcctttagggatgcagtgatggaacagttccatatgaggcggttacatttgtcaaagttcccagagcagcacaccaaaaaaagagtaacattatttcttacaaactaaattatttaagtcactgaaaaactattttttcccattctgtataatttttaaagatctcaacacgagtacagtgtcccaagagagttacactgctctccagtatttgctataaccattttgttgcaagaatgatgagccgatcaatgtgtcccattaggtggctgtttgttttttgtggctattgtctttaacctttccgcatagccctctttctcagtatgttacacctaatgatgaagaacggaaagaaacaaaagtggggaaactgctgggtcacccagacctgtgtggctttcatgcagtgactgcttttgtacccctaaagtatggggtactagacatgaccgacagccgtgccacagcagtcagcagcagcgtgtaatgtttaatgagcgttcagtgtgttcttagtgtgtctgtatagtcctattgagtgctaggaaaaatcctactaagtgctaagaaaagaagctcatttagttctcagaataggcctccagtgggtaatactgttatcccatttgtcagttgaaacaatcaaatgactagcagatggcagagtcagaattaaaacctagacagtctagccctttaccacaaagatactatactgaaaatcttcatttttaaaagggggggagcggtatatgactgtggtagaggacaacctcacatattgttcctgggacaccatccaccgttttttgaagtctgagtctcattttttttggagctcacacagtagggatctacttccccagctcagggattaccaacactggccactatgcctggccttcaaaagggctcatggggaatcaaactcaggtcttcaggcttgcaaagcaagaactttactgactgagccacctctacagccctagaaaagctttatcgaactaacttactctccttcttggaaagactatggcaactagtacacaaaccatgaattctcatcctgccttctttcagaggacagactgaagcccttctctaatagtgacaagccagcttctctgccacaacctggtgacatcctggagaggtctacagtggggaccttccaagagcccttccaagaagatttttctctgccaggcacagtctcatacccaggcctccttccctactcccagaccgctgaagaaagcttcctgaatgcccttcaacaccaggcagatgaagacttgaacttctgttagataccagtttcttctctggttactctggtgttgcatgcaagtctgggcctctggatacaagcatgtcctaaagcacatccattcctattctggaaatgactagctctctcctaaggtaagacaagccaataaattcctataacccagggggaatgctcagtaaaggggcaagagggcaggcggaaggaaacacaaacaaaaaccgggtaggccattagacagcacttgtaaagtgttgggccttgcagttccaaggcagtagaaggcagatgactggagagaagggggctcagctctctcatgccttgtttagtctgcttatctcaagtctaaactaatcatcttgatggttgtttgtggccagaatagggtttagtggcctttcagatgggcagagaggcgcagcccagttcttactagactccccccaaggatcccacattcctctttagcaagcatgtctactgggaaagcaaaagagaattcatagttttattgatttctgcaactcagactgaaaaggctacgaacagcaggaaggtgtcacctctgctgtttattgctacacctaactgagagatcagttttggaatagaaacttaatagaaaaaaaaaaaaaatcagagagttaattgcctgcctggtgggaaagatggcaggtctggctgaattaaggtccttcatggacaccaaaccctagtgactgacagttactacatcacctactgcaaaggaactttttacagaatctccaaattaaaccaactatctgactaccagaatcaaggacacaaatctcacctggaagggggagggggtggggctgggaactagatgataggccaccttgactttctccaccccctccctctcatccctaaagtagagtcaaatgagctgagaagggagagaataagccaccttgactttctccaccccctccctctcatccctaaagtagagtcaaatgagctgagaagccaggcaaggcctgttaacccagaagcccgcctccaattaatgtgttattgctcctttaaaacctcctagaacggcctggctgctcctgatcccggaggctgaagcacagtaattgtcacttagccacttaactccccgcagccctgctcactcactccttgtggtctatctctcagccaattactgctgtcatttgcgtttcaatgtgtggaatcagaggccaggcccgggtatacagcacaagagaaacccccttgggggacaggaacctaccaagacccacaggctgacgggtgagacacaagcagcccgccagtgtgggaacagcaaaggggtctcctggaaggggaggtctactgagcaccagctgtgttccttttccgcctcttcagtggggcaacccaagaaaagaaaacctcccttaagatgccacatcagttacaaataatggtggcaacatttaaaaagctgtagtgtgattgcagacaggaggcaagatgtgctgaggattagtcaagacaagcaagagccacagatgtcaaggcaggggagtctctattccagccacagggctcttcaagcaattggggaggggagagagggggttgggggaaggataggcataggcaggcccttatccctttctggagctgccctaaagtcccagggaacttgggagcctcctcagctagccctacatgaacacttctagaacctgtttttgtgatctcttgtattttaggtcgttgctatgtgcggcatagtacaggtgtgatcccctcactgggctgaccaaggctgaagaatcaggagtcacaggccagcctgggattcacagagactatctcaaagaatccctaccctctccatcgagaaaagattccttaaagcatagtttcaatcgaatcagaaagtcccactgtccccccccccaaaaaaaagagccaaagagccagaccatggtggcacatacctttactcccaggtggatatctgtgagtttgaggccagcctggtctacaaaggtacacagagaaaccctgtcttgaaaaatcaaaaaaacaaaacaaaaaaaccctaaaaaaaaaaaaaaaatgtgaatccatgtgtctagagtcaggattggcaaagtcactcctggtgactgagtggatcagatcctggtttttttagggtggttccctctgcctccccaataaaagcaaaattccccgcactgtattatggcttttattccaaaaggtttaaaccactcctgtcagcccaggtagcttcctagctgaagttaattaacttagcccattaattggaacgcacttgctctacctaagggagacacacagagcctgaccactggaggtagacaaggaagctgaggcgcaggcagggtctttgggagcagagctaacacagtacgagtaagagtactgttgagccaacagggagatagaggaccagccagaggggtggggagccaactaactccagtttgtatctccactgagtagcaaggaggccataaacagtaagcttcctcagacattccattctccacaactcggcaaccaccagaggagggcctaagccggaagagacctgttctagctggatctatctccgcctgtctctaggttgaaaataaaactctgaacttctctgccaatgagctctgccaggcccgatgacgtcctggtgcgtcagttctatttgcaggcaaggtccctgtgccccaggtgaggaggagtctgggaagaggactcggggaaggtgggccttctgtgcacagacgagatttgagaaagagccgctggggtgccagtaattgtctacgtcagcaagggctgtgccatggagagtgggcccagagagagctaattgctatcctcgggctatgtgctcctcattgaataccagagcgggaaatctgatctctgcaaagcaaaggaaaatcaccagtgaattaaagcaaggcagcagtctgcccacaccggccacagcctcccatttgtccggtcttgttattaagaaaatctataaatctggagctactagatttcttgctcatttctgtcatcacattggtgacaattgagcatggagactgactccccatataaaaaggtggtcccagggtgaacttcataaggaccccatgagtctaactttctcctcctttccgctctgagtttgcaaggtattttttattattattattattattattattattattattattccagctgaacaatcatgcgaaccgctcctgccttgctttctccctcttcctccgtctgtttctcagctcattaatagctgggtctctgggtcgtgaagtgtgcaataagctgctctttttcttttgtctcacggccaagagactctggagaggcaagttcctctcctctggccctccccactgtgagtgacagcccagtggagctttggcagcctgccaccgatggccaagaacatcgagctgtccaatcagcagcacggatccccgcccactgagaacaagggagcaagcagcctttcttcagcttggctgctgccacccaaggtcctcagagctgcctccacctgtggtcctgcccgtttctcaaaggacttcacagagtacctgcccttgggttcatccttctcgccctggctccgtcagattcaatttgacacaccgggaagagccttagtccctcccactttaccactccagcattttctgctctcccagtcttgacagaggaaaaaaaaaaaaatcaatggctctgtcatttgtgggttatccatggtgttagaaagagcctatcttggacttcagtgcctctctgggcccccacagataccccacagatacacaggagacgatggcttctatctaaagagaccctctgactgatgttccccaggctaggctcttaccccctcctcatcttccactccacctgcaagctttttgcattttatttcactcacatttctcaaatccagctcccagaatccagagatgagatcccagccccttagcccaagccttcctcctccatgtctcttacacaacaccaggagagagttaaggctcaagatctactctgtcactgttccaaacccctcagtgtggcatctgaaagtggttcccttccacagacaccatgctgactcctgcaccaatcccctgttccactgggaatcccccagcccctgctcagtctccatcatccccacagatcaggccctcctaccacttcacccagctaaacccatgagtttgctcaggcgctccccatctggactaggctacatgcttctcctggctcctataaccctgaaacacatttcagacattgcactgagttcacagggactgcgtccaatatctctgctgagtctcagaacccagtggcacaccatggacacctgttacaaacagtagattctcagcatttgggatattggatttggactttttggactttcagattactggtggatgccatctgtttcttaccacagtgcaatcaatcaatacctgagtctgaattagatccacttgggagttatctatttaaaggcagcagacttccagacaccaaagaccgagcctatgtaacgtattttgtctggcaacgtctttgctttggggtacttaacatgatgaagacaatgacagtgacaatgacgtcagccatgacaggaagtgggagatgattagacatccctttattctctgaggctgtggaactgcttaaaacagcccaggatgagtcacagaaagacagctcacttatcttgaaatcttaactaaccaaaatccagcctggatcctcagtcagccatgcttctgagaagacaagatatgtacctgaaagtacacacaccagagcttcagttgagaactcatggaggagttgcatagcctgccttcagagtactttttcttgctttaagtctcccttgagggactgaggagtcagctcagtggataaagaactgagtctgaggactagggatcgtatccccagcacctggataaaatgctggacaggcatgatagcccacctgtaatcccagcatgcaggaaataatgacaggatccctagaacaagctggatagttacactagtcaaattaatgagctctggcttcaactgggagaccctgccacaatatatgaagtagtcaacactaaccaatggagtgcacatacacatgtgcacagacctgaacacatacacatacacacgcctgcttccacacctgcacatacacacaattatgtgtctacacacatatacctacatacatataaacatgcagacacatatatatgcacacatacagacactgaaagcaaaatccatatccccttcattagtgtaatctcattccccaagaacaaaaatagcagaggagcagagtagaaattggctcccagggaccaccatgaacttgggagaagtattaaccacaagtaaaaggggacagagacaaactttaagggactacaaagacagcatgctgagacatttcacatttagaacaacgagttctacacagaatctcagacccaaatgacagcagcacatgctgttacaggtagaatgctttctccacagcgatgacagagataatgagagaggcgatgcttctgcagtactctgcttacaaaggacatctagagtagtttgttcctatcaaggaggcttcatgaaatcgtgtttatcattaccaaagcagcctgtatttatactgacatgacagaggcactggagacatgagccattactttgcttcacctgaggtttggagagtcaccattccacaggccttgcccatcaagagtatgcagcttaaaggaaagcaatactcatgggaatgcatttgggtaggcattttattttaatgcatgaagaaaccaaaacctaccaaatacaagatgagctcctgatccatgaaaaatgcaaagggaccatggggataagctgatctgatgaaagagcaagagatgaaagtatttcaaggcagttcaaattgggaaacaattttctgttaatagaagagtctcatgtagcccaggctagcctgaaacttgcttcatagccaaagataaccttgaactttggcctccatctcacaagtccttgaaaatgcaggcatgcatcgttgtgcctgcttttatgaggcgctgtggactgtacccaggaccttgcaaatgctaggtcagcactccctctgtccactgcactacatctccagaccttctctggtagctctgtcttcctcattctcttcaccccacccccttatctcaggtcctttgtgtacagaagcagcttggaagagggaaatgatgaaaaccagactttctttacttcatgagagtcacacagccgccatttccccatgcaaccaaagaaaacacaaggaagagaccacaagggacacctggttattgttcagcaaaggtgggatggaagacgttaacagactcttgaatttacgaaaggagaaactcccaaacaggatatttcaagaaggaatgaaatacagtgtcggcagggagagagagagagagagagagagagagagagagagagagagagagagagagagagtcctttaaatgatatggagagagaagtggagagaatgaagggaagaagctgaagttaggtgtttactgacccttcctacaaaactggaaacttcatggctgtgtctttacatccacttttcttcctggtgacaagatggaagtaagcatgtgtcataaggtggggaatacacatgactgcaatgttttcaacactgtatctccagtggtgcttctgaactggctgtcactaactggtgttgctttttgttaccctgcctgcattaagaaaatggtctagaaaaataacttatttaaagtaacaaacttccaaatcttccacactttattttcccctcaacaacaaagtataagactaaaagaaatgaaaatatgttctgtatttgttcaacactgtgagcttgatcctgagagttcttaaaactctgattttcaaattgaggtaaattctattttgcacatataaagtgtgccaatttacactgagataatattttgatgaagaatatttatggtgcactcaaaacatctgcagatgtgccaaggtttagagctagagaaatctgagttggaatcctttgttatatataagctgccagccttgctctggtcactcaacttctctggacactgatctcttgatctgttgaacagagaactgagtttgttgtcaggaagatttaatgagagatcagatgccaaacggtcagtagtttggcatgtggccattaagcatcagtcagtcagtacatacattgagcatccaccatgtgccaggctttatctgaggcatgtacctgcaggcgactcaacaacagaaaagagaaccaagatcccttccttctctgctcccttcataagccatccccaggagctaacaaacccaccaccaaaaccaagatttcagtgtagcctgaaacaagggttgtatcttcaagtgagctctagcctatggcccagaggtctgagcacaaacaccccgtggctactggttcttaccaggctattcacctgagaacaggaaagtagaggtctggagagacccagcctgggtgcagacagtcacagaactcaggagataggcattgctgtcccttttggctcttaaaatgagaaaggcgatttatggggggcaggatatgaagtgtgtgtgtgggggggtaattgtggctctactcagaggaagctctcaaatgaactgctccattgtttctgaactctctgagtcattttcacttttcctccccattccttcccagctctccctttggtgtcttgtgtgttcatgtgggacacaagagagtctttgtaagactctactgtgcaataaagccagatatcagggcaagaataaatgtgcaaaacagagggacagtaaaattgataggatttgtgtattttctatactttcttatctacaacatttcacttaatagaactggcaaacttgcaacaacaacaaatgtacatgtttataaaactaactatatgcaagagctccatgtgcttgatccacatgcaatacacacacaactcaaaacagaaaacatttctgcaaagccaaaacacaattctgagtccttttttcttgttactaacacaaccccagccacctcatttcacaagtaagaaacttcaattcttttcattaggtgaggcagtaagggattatgggaagccagaggcactgtgaacccaatatacttggtcttagatctcaaccctgttcacttctcactatctaccatcaagaaaggttttaaatgtcaccagacctcattagcctcatctgaaaaccaggtttttgcaaagaactaagtaaaaaggacacaaggagaggctcctaaaacagctgtcttccaaacaccccttccccaatattcaccctcaaaacctttaattccctccattttcaccgttgctctccttgcccatagtcctccaactggtcttcagcctcttgttggcaacctttctacactacttagggtctgctattagaagcatctctccaagcttagaaatttgatgacggtactctctgcctcagctcttgctatggtaatcatactcaaaacaagtctatattcagaacaaaatccacatgcccccagtccatccgtccaggttcattcttccttgcccctatgtgaccatggtccccagtgcccctaagcatcgttcctgggacacaccatcttctctgttgcactgactcgtactttcccccaatgggtgagaccatcacactacccctcccatctgcagagacccttgtcccctttaaggctagctccagttccatttcctctataaaagctgattacaaggggttaaacttgtgcactggtaatggctttctgtattaactacagagttatgtgtacaacgtcacttaactatgggttcctgtaaaatcaaaattaattcacattctttcttattacaagaggaaaataccagagcacagatagaatcaaatcaaagcaaacccaaatctagcaatgcaaatagcttagtttccaacatctggaactcactcaggatcagctgggttccaaagcactcaggtgtcctatctctgcagctctggcagccacaacacatgtagcttgtgtcgtgcgctcagtttggctcctactctacacttgctgctatgcttggcggttctcccacagtcctggtatctcccccatgctacaacttcatggcaactgcatcttcaccagtggcctcccctggcctctcacaatgccaggcctcagttgttctccatgacctcttcaatcatgcagcttttatgcagcccaaaccagcatcatatgggatacctacagattatcaagttctgctgacagcttgagatgcagccctgacccctctggagcacagtttctatgtgttgatcctaaggaaatacttcagaagatttcaactcaataattctggtctcttattaatcacagcttatttctgagcctcagcaaaccagcatccattgttctagtaaagcaaaaggtttcacttccatagtcttaatacaaatatcgtacaactgaccagcccagagggagtctgcttccctctgaaactacttcacaatccaggcctccattgtctgcatttctcaaaacactcccatctttcaatctcccacaaaacagcccattaacctacaaacacacaatggcttttccagcccaaaattcaaaatatttccataatcctccctaaa

SEQ ID NO: 34 - DNA, 391790 bp, Cricetulus griseus
  modified_base (704)..(794): a, c, t, g, unknown or other
  modified_base (9078)..(9244): a, c, t, g, unknown or other
  modified_base (44693)..(44963): a, c, t, g, unknown or other
  modified_base (45342)..(45477): a, c, t, g, unknown or other
  modified_base (48698)..(50192): a, c, t, g, unknown or other
  modified_base (51138)..(51155): a, c, t, g, unknown or other
  modified_base (64010)..(64165): a, c, t, g, unknown or other
  modified_base (64567)..(64612): a, c, t, g, unknown or other
  modified_base (65959)..(66278): a, c, t, g, unknown or other
  modified_base (90948)..(91074): a, c, t, g, unknown or other
  modified_base (108207)..(108269): a, c, t, g, unknown or other
  modified_base (167041)..(167465): a, c, t, g, unknown or other
  modified_base (182712)..(183553): a, c, t, g, unknown or other
  modified_base (184965)..(184996): a, c, t, g, unknown or other
  modified_base (207113)..(207168): a, c, t, g, unknown or other
  modified_base (209614)..(209643): a, c, t, g, unknown or other
  modified_base (229668)..(229719): a, c, t, g, unknown or other
  modified_base (275283)..(275403): a, c, t, g, unknown or other
  modified_base (299067)..(299339): a, c, t, g, unknown or other
  modified_base (308102)..(308148): a, c, t, g, unknown or other
  modified_base (339612)..(339638): a, c, t, g, unknown or other
  modified_base (389339)..(389395): a, c, t, g, unknown or other
  modified_base (389699)..(391687): a, c, t, g, unknown or other
ctgcctgtttctgcctcctgagtgctgggattaaaagcatgtgccaccaacgcctggcctgttccacactttttaattggattgtttggtgttttggagactagcttcttgagttttttgtatatttttgaaatcagttctttgtttgattcggggttggtgaatatcttttcccagtctgtgggctgccattttgtcttgctgactgtgtcctttgccttacagaagcttctcagtttcaggaggtcccatttatcaattgttgatctcatgtctgtgttactggtgaaatgttcaggaagcagtctgctgtgccaattaattcaagggtattatttaccactttctcttctaataggttcagtgtggctggatttatgttgaggtctttgatccatttggacttaagttttgtgcatggtgccatcaccatgaatctatctgcagttttctacatgtcagcatccagttatgccagcaccatctgttgaagatgctttctttattccattgtataaatttagcttctttgtcaaaaatcaggtttttgtaggtgtatgggttagtatcagggttttcaactctattcctttggtctacctgtctaattttgtgccaataccaagctgttttcaggactatagctctataatagagcttaaagtcagggatggtgatgcctctggaagttcctttattgtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacgataacaagaatggagatatcataatagagggagacatttttggtttacagagacgtcaggcactagagaaatatctggagatctgcaaagatgacaccaactaacaatctcagcaacagaggctacattaaatgccctcccctgaataatgagatggatgactgattcatatgccacctgatagccctcatcctgcagctcgtggaagtagaagtagacaccaacaactaatcactgaattgaactggaatccagttgcagagaaggatgagcaatgagcaaaggtgtccagaccaggctggtgaaacccacagaaatagctgacctgaacaacggggagctcttggtaccagagtgatagatgggaaactagcatgggactgatccagaccctaggaacgcgggtatcagtgaggacaccttggaaatctatggggcctcctctggtaaatcattacttatccctagcataggtgattttgggagcccatccctcatggagggttactccctgagccaagacacatggggtgggcctaggacgtatcttaaaggatatgacagactctgataacttcctatggaaggcctcaccatccctggggagcagaaagggtatgtgataggtaaggttttagttgctgggggggggagctgcactgttgctcgaactcactgagctcctgtcttctccttgccttgtattcatctctagtgctggggcttaggtgtgggataccaagtgctgagatcacctttgtgtgagctctgcttctcttttagactgaatcaatttcacgtagtcaagggtggccttgaactgacagattcgtctgcctctgcctcccgagagctgggattaaaagtgtgagccaacaatgcccggcacaatcttgtttctaattcaaaataaaaataaaaataaaaataaaagctttactaaaatattgtgttcttttggtattaacttcatacttcttgtacttaactgccacttttttctgtatcatttagttttgtactaatcttgtactgtttggttcctcatggctttgaggacctcaggcaatattttgtaaccttgtcatataatatgctatgtcatcacagtttatattaggtacatactgccatgataaaattgtctactgatgatttttcacaatttaatccataattaattgacccatgactatattgcttttaatgcagatattctccttgtgtctttcatgctggctttgttgcatgaaccctgaagcatttgttatagcactttcaaggaatgtttataatcttttcagtttaactttatatttttttgttttatgtgtatgaatgtttgtcttcacatgtgtgtgttctttgcatacatgcatgatgctcctatatgtcagaagacagcagttcccttgaaacaagttaaatagaattgtgagccattgactataggttctgggaagtgaattctaatcatctgtaagaacagaaagttctcttaacttttgagacaactttctagtcacacacttcatttttaaagataaagtggcaataataacaaaccatgagtcaaatacgaagaacaaacataatatttatgagctccgcagagagtataacacatagtaaagaccttagattttccttaatatcgtcacctctacatctacttcagatgcatgtattccaagggatgaatgtttatgggtgcaggataatattcttcaagcagtaagtgtgtatgactaatatttcacaaatgtgtctagacagaaaatttgcaaagttttcttgaatgtagggaatgaatgagttagtgtttggtttagaccactatgcatgaatatgatacatatagtctatctttaatccaaagcaaacctggtgctggacttgtgtgtaatcttttttatttaaattccttaattattactcatatttacatatctgttcccccattcccttgccttcccatcctcccaagttcccaaccaacccctcccaacccatcctccaactccttaccagggataatgagaccctccaccttcaaaatctatcatatcatttgggggaaggccgaggccctctttgctgtctctgggctgcaatagtatctctccatagggaatgagctcccaaagtccatttgtgctgtcttggcctcctccctggcacccacattcagaaggcttggtttggtccaatgctctttccccagctttatgactagggtctccatgctctcactaggtcagatcaactgtttctgggagtttctgcagccctgtcttggctcctttgctcatccctcctccctttccacaactggattccaggagtatggttcagtgcttatctgtgggtgcctgtttctactttgaacagctactgtatgaaggttctaggaatggtaaccaaggtataccatcaatctcattataggggagggacatcaatggcatcttcaccaccactgcttggatttttagttggggtcatctgtgtggatcacttaacatttcccctatgccagatctctctaaaaacctgaactgtttccctctatcaaagcatctcttttcttgccctcctctattcctcccctgtctcagtcttgttctccctcctccctttcttcccttcccaccctcttcctctccaaccccccatgttcccactttgttcaggggtttttgtccccctctcctttgagggactatgcaatcttcttggggtactccttgttttctagttcctctggcactgtggattgtggactggtaatcctttcctttatgtctaaaaatcatttatgagtgagtacataccatgtttatctttttgtgactcagttacctcactcaggatggtttcttttttaagaagcatggagttaaggagattcttaggtatgtgtatgtgcttgcaaggcagccactttgtaagaaccaattgttgaattcattgaagtctctagaccatctaccaagaagctatttagaattttcttttaggtgaagttgacaatgagaggaatcaattcaagaagccagttggagtcatttcattgtacaacaaaacactgctcttgcccagcttagtcattatcaaccaaccaagcagccttacctttggggtcagatgcacaggtttgaggcaggagcaagggttcttgggaaattctctgttgctatattttgcttttcagatgctatatagaggtagtcaccacatcagctgatgaaaccagatgggttggggctcatgtaataatatacttcagataattaaaacattttaacaatctattttcagaaagatagtgagtaaatggcaacatatctcaaaaaaataaagtcaagtagtatccactattcatttgaattgattggaaactttgaatatatataaattcagtaatgacacaatttattgaaaacatttttctagtttaatttcaataaaatgtttgccatattttctgcattctgctggctttagatctcctgactcttgtctccatttgaagattgagaagtatttcacatcttttcacttgttgaaaagaacaaatagcaattggggctgcttttgtgatggatgaatgaacttcatctccctgaatccctgtatcacttgagtccatttgttttctgcagcgtgcttggctgccacttccatgcccccaaacttgcttcagcaccctcctctgtgtttgccttctctcaactgattgctgaaaaggaagcagctggtatttccaattctaaccatggctgttcagtgctaacctcaggttcagactacagatctgttgctggttgctcttttctctttttctggaaaatggcattgcaactcttgctgctatttttaaactgttgaaagctcaatagtattttcttattcctatgagaaagtagtagataaaataattaattgacattaacacaatgagcatttatctcattgggtttacaaaatattcttaattaaattaatatttatttcaaatgacatctaacaagtctttagtgccaaacaataacatagcagacagacataagaaacctcagagagaaattgtggtgtgtgtataatttgctatgtggtttcagggttattaaatctagttttgagagaatttactcaccatgttaagaattctggaaaataaagttagtaacatttgtgtaatatggatatagttcaccaatccaaagcttgttaagtaagtacaaagatttcagtctggatccctagaaaaatatgtaaaatgccaagcgggcttggtggttgctgttattatagccttaggaagcgatgataggaagtcatcagaatgaattgcttcacaagacaaccacaatggagagcactgtgtgtgatcagtgaataaggcaaagaacattgataatttgtggcatggaacttggatctctaaatggaagaagacatcatgtctcatacctgtgtactcacacctgcataagcatgaataaatatactcacataaaacacacatgaaaactggacaaagtaagaaatcatgaatgttattatttttcatcatccaacaaaaaattgctgttatcacttccatatacatgcttactctgaaccagaatttctgattcctcatcagtgggatttatgcattttcccaaagaatcagtccaatggcatagttgtatacaatcatagttaggcaaatccatgttctttcctttaaacctttgtcctataacatttccttagttagcaacataattccagttcatttgattatcagggaactagagtcttgttttagttctctaaattgatcactgaccaagtggatcacaaatgcagaaattgattttcttactgttctgaagactggaagtctaaaatcaaggtaccagcaaggttgattttttttaaagcctttatccttgactagtaaatgattcctttttacatagctgctaatcaatgtatgcatccgtagcacttatattatatctaatgatgatactgtgtttcttgggagtcctgatacattcaatatactgtttagagaaagaggaaaagtgcccatctgaggatgagattgttttcatgtacatgtgggtttctgtgtttctgtgtgtatgcccctgtgtctatgactttgtgaatatggtgtgtgtgtgtgtgtgtgtgtgtgtgtgtgtgtgtgtttgaagtggaggattttgggacttgagagaacaacttacatgaaatttacaatttttcttttgatttcttcattttcttcttattcatggttgtttctattctttccatctactttgcttccctcttttcattttttccaactctcctttctttcctttcaagcacagtatatgctatttagaatatgtagcaatgatgctgacagcagaatgaaattatatcatgtaaaaattaaaggcaagataactgcatgtggtatagggcatgaggtcattttcgaattaatatcacatttaattgttttaaaatttagaatgctgactaaccaagtgtgaaagctagagtgagacattctttaaagataatgtctttaactttggtattttatacaaacccgattaattggttatagcatgataaaacattaaattctcttgaaatagaatcaagaggtcttagtaaagtgctttcagaattttcaatacacaaaaccagcaattttgaaaagaattgacatgcttttgtgttttttttctttctagacagatgcatagactttaggtgggtggaatccagtgctgctatgaacacaagttacaaccatatagcacaaaatttaaactaaaaattttatatgttattgagcaatctgtacatagaattagcaatgcaatgagagtatggaaatatctaccgactttctgtcaaaattggctccaaacatacaaacaaacaacaagatatcaattatgaacatggcattgggaggtaatttcctatagtatgctaaaacaataaaaactctaggatatttatcattcagagataatttgttgtatgatgtgaagaaaaatcagataaaacaatgcttgtgaaaaaaatttatctcactgtgaagaaaaatcatatcacattatttattttgagtgatgaaaacagaaacattttggcatttagtttgtttttttgatggaatcagaggaaacaacactatggaaaaggatcagctgactgcagaattatgattcttggagaatgaaccaaagacaggggatcatggcttctgtgtgaaaccacagatcctgacaggacaaacaaaaggggggaggtgcgttattggaggactagtcacataggcatgcagcatccacaatactgacatcagctattcaaaatcaatggccatccttggaggagagcaagtcaatgttcataacatacactgttaggataaggtcatttcaatgtagtactacacatctagcttcaggcccttctcaggtagaatagagcttggattactgagtcagtggtccccagagaggatgatttctaccctaaagagaacattgaccagaggcatttttgagggtgttgatgcagtttattgttgcattaatgataatgaagagtgtctttttaattcttccaggggatagtcactatgcatggatgtgtgtgctgggggtgggttcgaatgttctttactgtttattaacaaaaactttagtctactagtcctattttattaggattctgtaaatatttgttttaattttagttaagtgaatgtgtgtgggtttctacatttgagagaaggtgcccacataagccagaaaaattatggaaattctataaatcattttgatgattattttgtgtttattttgattttaccaactgaaataaattagttggttctccaagttttttgctaataaattattaattccataccaggtccaactggggacattttggtcacattatgatcatattggcatggtatttataaaacaaacaagcaaacaacaacaacaaaaacaaaaacaaaaacaaaaaaccagaaaatacggtgtctttagaagtagatatgagaagactaatgctgttgtcaactttggttgtcaactttgatggatctggaaggtctgtaaagggatttgctgaatggatttactgaagggggaatccccatcatggtgcatggcacttttggaagttatcaacacaggaggagattcaaaagaagtggtattagctctacctgtcctcactttcagtaatgagcacaacatgctgtggatgcactgttgctgccatcctttgcttatttcacaacccagattcttccagtggggactgagtaccagtatctctctagcaatctcacaagctctcagcaccaaactgtgattgctgaggtgtctaggtttatgaactgagcagcttccaaatctcagccattccaccatgaagatgtaagaccccccagaagttcaggcctccagtatcttttcccaggacttcggccaccccaatcaccatgaggaggcagaaacttgatgcaaacaacaagaggctttaatgaaaggtggatatttgtacaaatgggctctctcagcatgcaggctagagagcagccccgtcccccaggcacaggcctttttaaaggcaaaaaccacaagtttagggagggtcctcaactctctgtccattgaataagtgaccagagtcatgggttcctaggaggccctttgtcttgaggggaggcctgggaatcagatagactcctaaccccaccagttgtaacacctgaagacctcaggatgtgctaactaatgatagctatctctttgtttcatagggacccttaattgttaattattgacacattgtcaggtggtgcaatctgtttccttcatgagccccttggggaggatggccatctgggaattcttggtacccagttatcttatggccttgtaagggagtaattgctggtggctggtaaattccaggcactaagtcatagtagtagactttgtcagtttctgggctatatttctttgctaatttttaagtctttcaaagaaagctcctgttgggctacacagcatctattatgaaggccaatctactaagtaccatattaataacgtatattgtgtatatgcaatatatgttatattaaatattatatattaatatatattatacattatgtatacattaacttagatatattcatcccattccttctcttcctctagacaaccctgacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcagtcagaatggcaatcccatccatttcttaaagccattcctgtttgcattagcctgtgttacatgcactgtttatgacttaaccatattttcttaggctttacctttgcagaatatagtcggtctagctgtccctccctttgaggccttctatagtttaaaacctcagtatcttctctcacagctggccagagaagctcaaaaactgtttcatgtaaacaactaacaactgattacagacggcattgatatacaaaaatcctgctttacttgctccttatttgaaagaatgttgagccatgcatttacaacactatctatagttcccaagggcagtgttattttcctagtagtaactggtggttagatcacctcattagtatctgtccttccttgtctgattgcctcaggaccctctaatgtttctcaggatcttttgtgtccctgttgtcacaaacaatcaggaagaaaacatgcagacacagaaggcaacatgcacaatctctactaaagacagggagtcattttatctattttatgcaaagaattaaaaattatacttgaaatgaaggaaccagcttcccttttggtagccataacggccgaacacgttatgcttctatgaccttgccctagacactagaaagtcagattcctgtctcgtgacaaggaaccaatcgggagttagctggtggcgctatgctttatggctctgggtgtgctttacggacaagcacacagcaaggacatagagagcatagcaaccaccctgggagggccaatgggccataacaaccagttgaccaatcaacacagggtaagccctccaagcctggaggcacaacaatcgtgagcctgtgcgtactcctagacactccccttatgctgccctataaagatctgtacgtagcagcttcgaactgtcttttctggccatccgccatggtgggtgggtgaaagacccgagctaacatggggttagcttgttaaattacaataaagcctcgtgcagtttgcagcaagctctcgaatccacctggtgattagggtggcctcaatcttgggctaagattctggaagcctcagctttccgagggtcttacagaaacactagttttggtcatagtgcttttcagctggaagaactagacagcaagttagaggtcaagatcacaatgatcagtatacaaactggaaaatacacaaaatgatggatgcctaagtattttttataataaaggactgcttgagaaatgcaaaatcattgttaaagaagaacatacagagtattcagctatactatatacaacatattaatatttcacacaagattaaggaattagtttcattatagagtgaatgtattttgcaaaatcttaccattaacaaacaatgaatgtgggaatactccctaatttacctctctctgtttttcatccttaatgatggcatttctgccatcaccttctatgaaatcaaaatttgtgtaatctacctattagtgagaccaaatagtattggtctttccatgattggattattaaataaacataatggttgacaggtccatctctcttcaatatttcattgtatatgtgtaacacatttttgtacccacagctcacttgatggttacatgatttgttcctgatttgaatctatttgtgttatctaagtataggggctgataggaattagcatactggttatttatttggctgtctgtcaaggaatgggactgctgaatcaaacaataaacctatgttacatttactaaagaacttccaaactgtagtaatttaaatttttaatagtgggtaagcactatttttcccatatctttatcagaacccctcctcttttgttgtagtgtttggtaataataattgttattggctgtatatgatgaatggttagggtatagtgggaaattaccaatacggagtcaggtagaaatataagggtatttaatagggaaaagccttacttacagagcgacctagccagctggtggatcagcagcctgtaccgcaagtaccaaagagaaaccgaaaccgaaaacgcagtcacactacgtcactctgaccacgccctcacaagcctggtcaggcacacctgtagccagcccctaagaaggcgtggctacagcttcccctacattagggttatgatgacattattttattctctagtgatgttgaccaattttttctagtaccattagagaccagtgacttgtctacagaaatttacagttttctgtgtaccaaattgaaaattattttaatgtatgtgtctgtggtgtgtatgagatagaggagggggggtagggagagagggagggagggaaagattgagagagagagcgagagagagacagaacacacctatgaaggtcagaaaaatttagaaagtactgttctgctatttcggctctagggatcaattttgagttctagtcttgacaataagcctccttagcagctgttctatcatatcaaacactgttacccccattttaaatcaagtaattgaatattttgctagtgagttttttggagtttcttatttaagcctttattaactctcgtctaatgtatggacttaagagtatttacatctattctgtgtgctttcttcacattttgttctttcctttgcctcttgtgccttgttgagttttttaaaacatcacccagcatgccagggtggcacaagttgttaatcctagagaggcagaggcaggcagatatttgagtttgaggtcagcctggtctacagagtgagttctgtgacatcaaagtctacacagaaaaaccctgaagtaatgccatgtaatgccttttagtttgaacacaggttttgttttgttttaaggataaattttgtattgtgaccatggctcaagagcacgctttcagtagacccaggtttgatcctcagcacccacatagcagctcacaatcacctatgtttccagtttcagggactatttgtccctttctggcctctgaggggactagatatgcacatagtaaactatttgtagcaaaactatacacttataattaaacctatttttaaatggctttcattgattgagtttttgtgttttcatataaattttaagatattttaagataaaggagagcttcattactattttgatagttggtattctattttctgttagaatgtctttcactttttcaaaagaaatattccaaagtattatttttgtagctactggagctagcaatctctctttattcttttttcagaccatgcttggttcatataaaagctattaattaatgtatcctacaatttttaacaattgttttattaattctaatcattttaattctaatcattctaatcatttctaatcatgaagtctttagagtgttttagctgaaaaatacaaccatctacaaccactgaaacacttgcttcttttcccatcacttattttttgcttattgatcttgcctattggctctgtctagggtgaaactggcattcttgtagggccccagactttagactgctttcagctcccttcattcatttattttatggtagaagttgacttacaatataaaggctttacagaaccaattgtcttcagtgcttgtacattgcaagtctgctaaatttcatcaaatgcttttctgcctctgacaaatgttcttatgttcttttttcatgtttgctgtgatgtatcatatatatttgtttgcacataagccattatctttgtatccttgaggtgaattccactctgtcttacacaaaatgtttttaatgcaattcagaattctgttagtgttttgatgaagactgttatgagattggccagtagcttactgctttggataccaagcccaattttgttacagcagcaatgctgacttcacacattgtgcacaaaatagttccttcaacttcacctttttttaggaacaatttaagatagaatatggtttttcttttgtctctttacaaatacttagtaaatttcagtactgaatctatgggcatttctttgatgagaagtgttttaagaagatgcactcttgctaattgttctttttcaaagattctttttaattatttacctgtgtatgtatgtatgtatgtatgtatgtatgtatgtatgtatgtgtggaatagtgccttctgcactcagaagactgcactgagcctccaagaagtacagttataggtgcttgtggtagtttcacaggaccttaggtcctcctcaagagaagcaatgattcttaactatgggcctttcaagccctatttttggtttatatttttggtttcttcatgatttgttgatattgaaggcatatgcacacacacgcatgtgtgtgtgtgcatgtgtgtgtgtttgtgtgtgtgtgtgcgtgtgtgtgtgtaacattttcacttctatattatgaagaaggttgatgtttgatttccatagtaatttcatagatccaactatgatgccagctgtaacatctttgttttatcttgtattttatttgctgaagccactttttctattataatccattggttggacaattttttcttagctattattttgtatcacttataaacctcaatctaattaatttttatgtttatttttcatcacatctgtttttgggtttgatatgttgttcttttttgtttctcttaaaattaatgacagataatatagttgagtttatcctttgttttccttggtgggtatttttctctttttacttcatatttcatggtttcataatactattttcaagtttgcttccacatactctcaggatacttatgtctttataacttaacagaatcagaaagaaatgaaaagacatataaaacagcaagcatatgaatacaactttctaaactttaattcattccttgccagacttaaaatgtttgatgccgcactaatttctctattgtcttaatatatgagatagattaatttacactgaatttttgcaatgattatatcatttctataattttatcttttaatcttcatattagagataggagtggtttatgtcttacatttacatgattagaacattccaaaattctcttcacttattcttactcaagagtgttacatcttgtggcatttcattttcttattaatgcttagatctttctgtttgaggaatttctgttaggcacagggaaattactcagcaggaatcacacttgctgcacaggcatgaagacccaagctcagattgccagcattgataacacattatagaagttactgtgtgtgtaatcccattgctgggaccatacagagacaggaggataactgggacttgctgaacattagtctagctctcacatgaacattagtatcaaaagaataagggagaaaacgatagagtagggcatcaaaagtcatcctctgctctttatccccatacagctctctctctctttctctctctctctccctctctctctctctctcacacacacacacacacacacacacacacatacacacacatgtacacatgaatatacacacacaatctcattcagtattcataggatcaattttgtgagagacattctattaccttttgttggattggacatacttttactctttcagttttaaaggatagttttacgagtagtatattctcatctgtaattgtttcctttactgcagaaacctcatgtcagtctcttaagaggatctttattgagcttgaataattacagaattaattgtgattactcacagaactgcctgtaattacttaagtgtacagacatagtgcacatgaattatgttaaaaaatatcattcatatacatgatgtaggttattcgaatacaatgtgtggtttctttcgttttttttcaattgcttaacacgttttattccctaacatggtttccaaatcagacaagctgtaaacaacaagactttctgagtaaaataatttggaatgcaaaggtaacaaagaatttagggatgcagttctcagaggctacattttcttaagatgccaacagagcaggagataacagacttactttcagatttttgcagaaacactcatgaaagtcagtaaaacatgtgatgcatgtacttatggcttattacagggaaacagaatggtttcaatacccagagggagagagaactgcttgactacagcctattctatgtgtacactgactctccaggtgtccattcttcatagagtaacaggcttcaataatcatttcactgactgttatgaactgcagatgtttatattatacttagaatctagaacctttaatgctccactatccaggcaggtttaaatgtccatctagttgccctcagaattccttcctgcaagaagtcaaggcagtgcattgtggcttaaactactcaccctaagctacattttaatgtgatctgagacctgctgacaagttgtcctgctatatgacattgtggttacttaggcatcactgacaagatgtcaggaccaatgtgcaatactcttttaggacaattactgactatggaagtctagaaatgagactgtggactcttccaactggcttgatgtagcttgcttagcacaggttaccaagggatcattttgaaatttgtattttatattatatatgttggctctaggcaatgcgttcttaaataatttgctgaagaaaataacatttgaagattcagcttcaaattgaaaattctgttttacaggctttttagaaattcttgatttcaaacataaatgatgttgtactttcaaaataaagaggaaatataaaatatgcagattaacataacatgcatttttaaaatgaagtattattagttaagcaatcatcaatatagtcttatgtatagtcattacctaaaaaaataacacgcatcacattggctttcattttctttaaagcctacctgtattcattcaccacatacttatttcatattactatgagttaaatatcaaatccactttctagaaaacttaacataaggacacctgcaattcaggatagaactttaatttatttttatttacataatgtttcttgctttctttgtggcaatatgttattcaaaactctaatcaccctctttagcgtcaacactcagtcatttttacctggcaaaatggttctgttttatactggtccttttgttgttaatccttccaggagtttcatatttcctctttgaatacagtctcaactctctgtgtttcaacactgctgtaccctttactaagaagtatgaaaaggccagaaccccaggtatgtgaagaactgcatcagatatccttgcaacttatgtttaaaacatttttttttcaatccaggacagaggatttgggcaaaataatctctttagtcacttgttattcttgtcaccattttatcagcatctgtcaggcagggacacttgctgtctctgttttgtatgacatgaccatcctggctatctagcaaggatgaagcaattcccacaagcgagtacttatcattgatggcaatgccagcactgagacctgctcatcaacctttcatgaattacaaatatttcaagttggattcattttatttttaatgttttccaaatgcctggagatctcagcatggtagaaatctccttggagtaacagttgcttttcttgcagttctgagcaatcaaatgtgtgcagtcactcttgagtgattgtgctaaccgtgatatttttgagaaaatgctagagttatatggcttagtggctattcaaccacagattaccatatgtatttaccttttaaaatatcagacttttcatgttaaagcccaatggagtcataaatattttaaagtttgtttcccaaatttgttatctaatctcatcataacatgaaaaaaaatgtgtttgatagagtttgtttccttgaagttctcttatctctaagtaataatgaacagttttaattgcaagtaggcccaggggacatctaaagattaactacattgtcaatttaattgacctcttgagagttttcttcagagcatgtgttggtataaacctggtcaaaatcagaagaggaagagacatggggatagtggaaaatgggctgatttgcatcaggaaactcaggtttcattttccttctgtagtatttactcatgcatatatttaaaacacagatgaagtgtgagagagataactgtggctaagaggacttactgttctcccagaggactgggcttaattcccagcacatcattcacaaatattttaactaaattcccaggtgatcttctggcctttatgggcatcagacaaacatatggtacacagacacatatgaagataataataaaataataataataataataataatagtaataataatttcaaggaacgaaagttcatttcctgtctttaaccatcatagtttaaacaaacaatatcagaatatgtatatggcaatatatccagtaaaatgtcatgtaactacaagaacttattactgtgaattataaagcatttctcaacacactaggagaggcacagaagccaagtgaaacccacatataaattttacttgtttctttttttctttccattttttttatttgagttagaaagaaacaaaattgttttacatgtcaatcccagttccctctccctctcctcctcccctcccccacaactaagatcctaccataccatttctgctccccagagatggtgaggccctccatagggggccttcagagtctgttatatcctttgggatagggtctaggcccaccctgtgtgtctaagctgagggagcatttctctatttggaatgggctcccaaagtgctttcctatgctagggataagtactgatatactacaagaggccccatagatttctgaggtctcctctctgactcccatgttcatggggtctggatcagtcccatgctggtttcccagctatcagtctgggaccaagagctctcccttgttcaggtcagctgtttctgtgggtttcaccagcctggtcttgacccctttgctcatcactcatccttctctgaaatttgattatagttcagttcagggtttagctgtgggagcctgattctacttccatcagctgctggatgaaggctctaggatggcatataagttagacatcaatctctttatcagcagagggcatttaaggtagcctttcctctgttgcttagattgttagttggtatcatctttgtagatctccagacagttccctagtacatgatttctctttaaacctataatgtctccctctattttggtatttcttatcttgctctcttctgttgttcccacagctcaaccttcctgcttcctcatatcctcctctaaaaatttcaaattgagaaaaatattttcaaacacatttccatctattggatatacaattatgcttaaatcttaagttttaagactgctactgtcatatgttcattcttactctagagaaactcattaactaacccattttgtgctcataatcagaacagttattcggtcaggatgactttgtcctcagattcaagggtatgccaggatgagaatgaattaatgatggtatcttgatcacctgtgatgggattgattaaatctagacctgtgatgcagatataggaagaaaaaagagggtgtgtgggtgaattggtaaatatagatagatagatagatagatagatagatagatagatagaagagagaaaggaaagaaagaaataaagaaagatgatgttatctcctgctggattcttgaaggaaaagattaaatctttaaattttggccaccaaataacttagtatgggagcaaaaataaactctgggccaaagatatagctcaatcaatagagtgggcattaagcatgtaaaaagccctagattagatccccagctctacatcaacaggaatttggtggtggaagcagaggtatcagaagtccaagattgtctacagattgttagagaatttgaaatcagccttcaatatatgagattctttctgaaaaattaaatataacaaaatactaaaacacttcaacatttacacttatgagagcttgattttctgtgctttgcaagcaaaatcatcctgtgctattattctgatgccttatgtaattatctgatatccttgggcctatggatattgaatgactgcttgtgagattttgaatgttccctgtgtcacaatgaccacagccattgtgatgatcactgtttcaatcactttcgatcctgagtttctaaaaatagaatattgttgacagtgtgaatagaacatgaatatttgacattacaaatgacatgcatcttcggctttttaattacagcttaatctagttcaacttcatttaatagatatattatggactgttatgtattcccttaaaaatatgttgaagatttaaattccaagtcccttggaatgtgaccttgtttgtacatgggggaggtggagagtaaccagccatgatttatgaagatgaaatcatgctggagttgtatgggcagtgcagtatgactagtgtactcataggaagaggcaatgaagacagactcacatcatttgacagattcatctatgccttaccaacaaaaatcaacagggagtcagaaagaaatacaagaagattaggattgcatcacacaatgtagtgctatttgtattatttggatattgtcccaatctgtattctgctgtggaggtctacgggcatcttcaattagtcagttttttttccttctaccttggaggcctctaaatggaattcctgttatacatctcagtggcaagtgcctttatttgcttgccatttcacagattttagaattatttttaaatgccccacttaatttctacatattaatatcacataatcacagttcaccactatgcaggaaactattgttttttaggaagggctgtattgtgaggaggcagtgtctctttcctgtatctcaactgagaacaactcacctgggactactacctgaggactgttctctgatcttccaagtctagggttaggtaggccatgcattgtgcctagaaaacttcattgacaccgaatatatctttcttaaactcaggaagtggtattcccctgcataaggctggaaccatcaacacagagtgtctattaatataactcactggacagaagccaacctcttagaatttggcagaacaatgctagcttttagttccttctttaatttccactgagattaattaactttgggtcattttataaaacccatgcttcctaggtaaataaaagaaaaatgattcagatatcctctaaccctttatagatttcttaggtttctcttcttataagggggctgaatagggtgaaggtttttcattcagaaattatttgggtcttgcttaatattttacaagttttgtataaagagatttgagttctttctcaatagtgtcaaggaacaatatgagataaagaagtgggtgactaaaaaatgatctgatccctgttttatacagtaacaagttttggaaacattatggggcattttcagatctcaaatgtaagactctttcttaaaggacataatgatattactcttataattgtttggattggattatggttctgggaaattgctgatctgtcatacttttacattacaatgaatttaatagtgaatattatattatatatgctcagaattgctaactagactagctgctttgggaaacatggagttcagtgaaagattatgcttcattaaatagacagttggatatctgacttcaactagtgatctacacacacacacacacacacacacacacacacacacacacaatgcatcaggctcacaaacctgtatttatacacacttataaatataaatgtattataaataaaaatcatcaacctctaaaatggcttcatcaggttctttaaattggttatttaagggacactagtccattcaagtattttgctctgccaggccctgcctatctctcctacgacttctgctttgataaaattcatgagattatcatcatgcacaaaactcaagtacaaatggatcaaagagatcaatataaatccatctaccctgaacctcatagaattgagtgtggggaatacgtttgaatgcataggcatgggagataacttcctaaatagaacaacagtagcatagactctgaaagtaacaattaataattgggacctcctgaaaccgagaagcttctgtaaagcaaagaacacaatcaacaagacaaaatggatccctacagaatgggaaaagatcttcaccaaccccagatctgacaaaaggctgttctctaaaatatacaaggaactcaagaaactagacctcaatctaccaaataatccaattaaaaatgggatacagatctaaatagagaattctcaacagaaaaaaatctcaaatggaagaaagacacttaaggaaatgctcaacatcctttgtcatcagggaaatgcaaatcaaaaccactctaagattctatcttacactggtcagtatggttaagataaaaaataccaatgacagcttaggctggagaggatgtggagaaagtggaacactcctcctttgctagtgggagtgcaaacttgtacatcattgtggaaatcagtacagcaatttctcagaaaattaaggatcaacctacctcaagaccactcaataccattgttgggcatatacacaaatgagaaacattcacaccactaggacatttgctcagctgtgttcatagcaacattatttgtagtagccagatgttggaaaagcctagatgcccctcaactgaagaatgactaaagaaaatgtggtatatttacacaatgaatactactcagtggtaaaaaacaatgacatcctaaacttggcaggcaaatggacagaactagaaaaaaaaaatcctaagtgagataacccaaaaccagaaagacaaatatagtatatacttatgagtgcataagtggattccagacaaagcaaaagttacacagcctacaatccatatgcccagagaagcttgaactctcttcctgaaatagaagcaggtacagaaatccataactaaccaatgggctaagaaccaggagtacaaatgaactgaggaaggagcaagaatttgaacaaaggagtcatgaccatgatgaggaaacccacagaattaggtaacatcagctagtgagagatcactaactcaggtctgaaagatggggaacctgcacaaaaccaaactaaactccattaatataggtgacaatactgtggctggaacaatatatgaggccaattgcagtgggtccaagatctaatgctaatgcacaaactgacttactggagcttattctatatggagagatacattgctcagcctagacacagggttgtgcaggtggagaggtgccattgtcctgtttcaactagataatgggaccgacttagtagacttcctagtggaggccttactctctccatggagcagttgggaggagggggcagtggagggagtgggacgagaacagagctgggtaactgggattggaatgtaaaaaatatatttaaaaagtcattggattacatccctgaagctagtctccaaggtatattccttatttttacaatctatcctctggaggctgctaccaaggttcagctattaaattactaaagtccagcaatgaaaccccttttggctcacctaattagcatgcccaattaaaattaaacacctcatcctaacatggtgtttcctattttacctccataaactgccaatggtctatgtgccatgtatgtcttctcacaatccagaggcactcctttgtctcactgatgtaggcagaccttctgtatgctataaatatgtgctgcttttattggctgatgaataaatttgttttagccaatggataggcaggattcagctagaggggatttctgcacaaagaggcagggaaaagaaagacaaaggagacactatgtagctactgggaaggtaggatgcctgggcattctctgttaagccaagcctaagcggagatacacagattaatagaaatgggttaataattaagagagggctagccaataagaagtctgagccataggctaaacagtttataattaatataagcctctgtgtgtttaaatgggactaaattgttaccataaatctttccgccaaaagccacctgagccccaccaccacgcgtgaactttaccctagctgcccgcccgagttaggcccaaatgaatacacagaaacttgtattaggtataatgttgtttggccaatgactaggattctcatctgtttgctcagtcctaactatcataaacttatatattttataagatttatcttattggatgctttattggcatccctcgttgctggtggatcacattgtgctgctggaggagcaaaagggacccttcctgtttctccttcgcttaaatatgagtctccttgctatgccacttcctgcttagatcaccattcctctattagatttcccagaatcctttttgactcctagtcccgtctaacttgctgtctcattggccaaaaagtattttatttaacaaccaataagataaacatacacagaaatacttcccccatcactaaatggctacaggcccgggcgtgacagaaactttcctcttcagtcccactgtaggacaaatgtcccatactgtgatggttgacataggactcagagctaagattttaacattaatgaaaacaaagattcccacagcccaaaatttgctatttgaagctgcagtcacaaattgcaaaataattacatgatgataaaaatgtgtcaacataaacatgaaatgtcatgattttacagctaagcaggcaatagctctaagtctgctaatcagctaagagaatcagtttggcaactgctttaccttttgtaggcattggaaccccaccttaatggaggaaaatgatgattttctgtgtattttcatgcttatttaattttcattgttctttttgttcaatcttggttgtcaattacctatactaatatagtacaacaacaacaataataaagatagttttacgttttcttcttccaaatgcctcatcaatgcatatagacaatatcactccctatgtttcttacctcaccaccatgatatttatatgcctttatggccagagctctaatgattgaagaggtgatattattctggccaacactcaggtaatgcctatgtattcttatcttcatttaaaatatcattcgtctctgtataaccaaatctttgtaatatattttctttctgaaattctgatattccttagagattgtttttttctttcattattgcccccctcattattttgagctttgaatggtgtctactcaggctaggcctacaaaatgtaggccactgtcctggatcaatatatctgcagtgctaagcagggaactagcatagaaatgttggctttttacaacagaggattctgccattagaaaggctggtaaaaaccacagagtgccattggcaggttttgcatatacttgacattagaggtaaaacaagaaagtgacactgaacatttagattctgtgtcaatgtcaagatgaagatgactttcaaagtggaatcatagagggaacattctataaaaaacattccatgtctttctagaaaaatccagtgtaagctttctacctacttgggagagttttgccaatgataacatattttagaattcctggaatagctcaaggcaaatacatattttgaagctgaaaggatttctatttctttctcttttttaaattttgaaatattattttcttttcctacaatatgttctgatatagtttccctccccagcttctcccaacttccccacccacccaaatccataccctttcattctctctctcattagaataaaataggtacctatagtaacagcaactgtaataagaaataaaacagaataaaattcataagacaaaattaaggaaaaaagtataaagagccaaagaaaaagcacaagaaacacctacagatagtgaaacacacacaattacacactcagaaaagaaataaaaacaaaataggaaaccataataaataagcaaaagatctctaaggttaataaagaaaaatcccgatgggtgttggtggtgcacacctttaatcccagcactcgggaggcagaggcagacagatctctgtgagtttgaggccagcctggtctctagagcaagtgccaggataggccccaaagctacacagagaaaccctgtctcgaaacaacaacaaaaaaaaaaaaaaaaaaaagaaaaaagggggggggtggggggcattccctctctttggttatggtatatgtgtgttggtgcatgtatatgcatgtgtatgtgtatttgtgtgtatgcatgttggagtatgtgtgccagtgtatgtatgtttgtatatatgtatgagtgtttattcttttgtacatgtgttgtagttcacataaaatctcctcttgggcccacccaagcttctacctgactctgttagttttcaggaccggtacagaaacaagatggtttgaggtgtgcctttagttaaagtctagtgagaaaagcaaggcttcagtgtttgtgattctaataggaacagtaagtgggccatgaaatgaaaacactttcacgtgctggtccattgtataatggttaccactctgaactctgaaaatactttcatcttgcttttaaaaggccttcaccacacagtccagggtcagaattcttcctgaaatagaagaaaaaaacaaaatgtcaaaatttgcacttttccctaaatccaaaacaaatcatgttggataatcgtaattgaaaattcttcaattttatatacaattaaaaacctgtgaacaaaggctgggttacttggtaaagttaatgcttctttcagactattagttagggaactagtttaagaaataccagattattatcaatttagaagcaaaaatttatgtttacactttcaaaataatttatcaattacatgtatctaattaagtttactttcacatcccattctactgaagtcacataattacactcacatatgtcaagcaataaagaaattgccttgggtcaccattatttttagatctcagtgtagcacacagtaaatggctaacacagcaataatgcttaattatactacagtaaaagttgaaaagtcagaggctagtccatgatcctgttttttagaagtcccccaagcataggtattagaaaccagcaagttccaggggttcttcacctcagagtcataaaaagacaatacaatcagaataccttatgctttgatgtggctgtttcagtttgttgttgaacaacagttcaacagtttgttgtttcttctgtgaaaaccttttcttggtcacaaatttaaatcaaatttagcaaaaattctgttaagagaaagacaggcagatgtccgcttcctgcatcactggtgctgcacaaaagcctgaagtgaaatctatactcttttttgatttccatgtaggttccatttctagattgtttccagcacactgtccattgtatctttaaacaaagactaggtcaaagatgacatgtgttcccaataacttacaaagaacctaccagtagaagaatcaccttctgccttcccctacagtccctttaagccaggggccagtgttgtacacagatgtttccttagccaggaagatcccaaatatgattgtggatttacaaatgcaatcaatttagcattttggtcacacataacaagagcaatgattgtggtaaagaatgagcagacaaaatgttttattaatgtctgcttctggtgtgatgcatatgccacatgaaacttggccaaactattgcaggataatgattttccaaaagcagcagaaagcagatgggaagcatgattccaaggtcaatgatcacacctaggagatggttataggtcttaacatattttattgcttatagtaaattgtcagcaaaatacctcttggtaagttttaatttctatcagaattatttattgatatttacatatatatatgtgcacatacacacacacacacacacacacacacacatatatatatatatattaattcatttaaaatttatcttagtataatatcttattagttatttgagaatttaatacaatatactttgatcatattcacctgccattatttctcctaaattctgttagatctaccaccccttttaataatccaccaagtctatcctgcattgtctctgtctcctgagtgtgggatcattaactggagcatggttaacctatgaggaaggaggcacaaccttagagaaaactgactctccctacgcctgaagctattcattgccaatagatttctaatcagagaagagtgcttgttaaaccccccccccctttccatgctggacttgatcttgttgaggtcttgtgtagatatacacatttactgtgatatcctgtgtacagtagtactgtcatgtctagaagaaaaacttgctctactcatccctggcctcactcttacagtcttcctgccattgctgctgtggtggtccctaagccttctggttattgtatagatatcccaattgtagataagtattccacttaacactttgtattttgacaagctgtgaacttttatcttgtgatgttttgtttgtttgtgtttgtttgtttgaaacaagatttccccatatagccttggctagtttggattctaaaatgtagaatatgccaaactcaaattcatggaggtctgcctgcctctgcctctcacattaggaattaatgctaaatgccaccatgtgaacaagttgtgaggtttgtaaaaagttttttttttgagaatttcatccatgaatacaacttttccatgatttcaaaagaaactctttatccaataaacaatgcttgtccatcatcctttgcctttgaatcctggaaacagccaattgtatttctctttgtacaattttgacaaactcttatattttctctaagtggaaaaacacaatattggtcttattgttcataagaatgctaaaaacagtcttctaaggctgtgagtggaatgtagtgcctgagagctggatgagcaggccagagaactttggtttgatctcctgcattaaaaggcttttataaagtggtttcaggtttctaggaaactcagaagacttttagcaaatgttgctccttcttcagcaaacaattcaaagataacaataacatacagtatcatacagtaacatacagtatcataacaataacatacaatagcaagactttgttttccatccttacttggcttttttattactctatttcttttacttttattttttctattttttgagataggtttctctgtgcaactttggctgtcctggaatctactctttaacctaggctggcctttaaatcacagagatctgcctgcttctgcctcttaagtgctgggattaaaggattgtgccaccacacccagctactctatttcttttactattatttacttttttattttatatttttataattataattagaccaattttaaattagaaacaagcttcttttacatgtcaatcccagttccctctccttcccctccttacctcccctcaatactatcccaacccctttctgctccccagggagggtgaggccttccatgggggatcttcagagtctgtcacatcatttggagcagggcctagaccctcccccttgtgtctaggctaagagagtatcactctttgtggagtgggatccaaaaattcattcgtgtactaggaataaataataatccactaccagaggtcccatagattgaccagacctccaaactgacatccaccttcaggggggtctggaacagtcctatgctggctttgcagctatcagtctggtttccatgagcaactctttgttcaggtcagctgtttctgtacgtttctccagcctggtcttgacccatttgctcaccactcctccctctttacaacttgattccagagttcagctcagtgtttagctgtcggtttctgtttctgcttccatcagctactggatgaaggctctaggatggcatgtaagataataatcaatctcaatactggagaagggaatttaaggtagcctctcaactattgcttagattgttagttgggggttaaacttgtagatatctggacatttccctagtgtcagaattctctttaaacctatagtgcctccctctattatgatatctcttttcttgctctcctccattcttcctctgactaaatcttcctgcttcctcatgtcctcctattctccacttctctttcttctagctccctctctgtcagaagccagccttggctagctaaccgccagatagtctggcatcccacgatgtcgatgtcagaagccagtcttggcgaccccccatgcctagctagccaccagccagtctagcatcccatctcttatcacaggagattcctgctacctgcctgagaagcaactaacacctatcccttcccccacttccttaacacaggagatttcggatacctgcctgagagcaattaacattcatccctccccccaccttctttttctctgcttcctcctttctctataaaaaccccttgtaataatcaataaagttggccttgacaaaggaatctgcttggtcccactctttctttcccgcccattatttgcaggcgtgatccacctcagactcacaaattaccagagccccactggatggggcccctctcccctccccacatgctcccaattagttgtttgttgctttcctctttgctgaagatgatgtggagaaaggggaacacttgtgcactgatggtgggagtgccaactcatacagccactttggaaatcagtatggcggttcctcaggaaaatgggattcagtctaccacaagatccagcaattacactcttaagcatataccccaaagaagcacattcatacaataaggacatcttttcaaccatgttccaagcagccttatttgtaatagaaagaacctggaagcaatctatatgcccctcagctgaagaatggatggagaaaatgtggcacattcacacaatggagtactactcagcagaaaaaaacaaaaaacaaaaaacaaaaaacaatggaatcttgaaattcacaggaaaatgtgtggaactagaagaaactatcctgagtaaggcaatctattcacaaaaagaaaaaagttgtatgtacatcctgatacatggatttcagatatagaacaagggaataccagcctataatccacactgcaagagaaactaagaaacaaggaggaccctaagatagacctacatagtccccctgagaagaaaaggactctttttcttttataaggactttatctttttttaatttttcatcccaagcctatgtatatttttaaacacactagaggttaaaaacattagaggtttttctttcacaaggacatcccccatcaatatcttttgccttacagaaatatctctgttttcaggaggtcccacatattgaatgttgatctcagtgtgctactggtattatatttaggaagttgtgtcctgtgacactaggtaagcaatagtggagagggtgtttgaatgggccttcctctttaatcagatttgtgactaccagaattgttatcatagaaccttcagatggaatctgacttacagtcaaatattgagctgagctcttggagttcattaagagagggaggaccctccttgaacaaagagggtcaagagcatggtggggaaaacctcagggacagcagactcaaggtattgggagcttatgaactatggactgacagctagggaacctgaatgggacttaactaggccctctgaatgtgggtgacagttatatggcttgatgggggggggtggcagcggcatcaggacctatcccaagtgcaggaactgactttttagatcccattgtctgtggtgagataccttgatcagccttgtacctggggaaggatcaagttctgctctaaacttaataagtcagatattgttgactcttcatggaaggccttaacctctctaaggagtggatgggggtgggaaaggggaggtgtaggtgtggggtggaagaagggtagggattgggagctggggtttgtatataaaatgaaaaataaattttagagaaaaataaaacaaaaatagggataaaggaacttgaaatacacacattgtcagcaataaagcaaatatcctgacttcaattcagaagaaccatgaaagcagatggtgaggctcacagcctggactttgtccatgcaaatgttgttgagtaccggtggcttcatggcctttctgacaatttccattcagtacagccatagcagggattcttacataagtccaaatttttgctgatgtgtctatctagagagtctgcatctaaacacaaaaggagtaatctcttcttacgtttcactttcacttactccccatcatttacttacatttctaatgtgaattctctgtggaaatacaatttgaaaaaagaaatgtgtgctgtgtggttatatcttccaaactgttagtcacttgtaaagtatattgtgtatggttttcttttttcttttccttctttctgttttttgtttgtttgttttatttttggaaaggcatattgcaggaggagttgattgtagacataattcttcacagcttagaaatgggttagtatgctgttttgctcaacaatatgagtaacttaagtctgattttcatatcaatcagagtcctttacccaatttcacctgacagccttaacatttatttttgtagcacatatagaattacctttgtaagcctttgcttgcaagaataaatcatttatttgttgttttatattttgagggaatgcacacaacccttctggaacacctggaattttctattttaatattgaaattccattctcatctaaactattgtcttcaatttcttacaaaacaatgttttgttataaatccatgaatatcttgaaaggcattaaaagagccacatttatggaaagaaaagatatttattacattgttttagaaaaatcattgacagttaaatcgatacaaatcttaacttgtctaaatacctatacatgactgaaatctccagtgttataatacaaaatcaatgatatttccttatggagaatgatgatgtatgcatatgtatatacatgtggaagtccacttgtccccttgacgttctgtggggagtcatttatgagcataaaagtaagaggttattatggaggaggagctatggggtttaaggaaggcaataatcttagtcatttaatcgaagttttaagtggcaagaaaattttcccaattttttcccaaatattcttttaagtatcacatgtgctcctgatttctgaaatccaaatttagatcaatagaatatgccattatttttaatcatcactcaatattataataattatcatcaacaacaatgtaagcatcactacagtcagaggtagtagttaaagggaatctatttcattacagttatatgttcagtcatcatctcattttataagtcaaacatgacttttatgtggttttcaagagtctgaattactgttctattgctgagaagagacgccaagactcttacattgaaaagtatatattggggtgcatacttacagttttacaggcttcataccctattatgacaggaaacaggcatgtgctgcaccaggagctaagagctttatatcctgttccacagtcagtgagtggagaaaaagtgacactggccctagtgtaagcttttgaaacctcaaaccctacccccagtgacacacatccttcaacaaggccacacctcttaatccttctaatctctctcaaacaattctactccctagtgattaagcattcaaattatgagcctatgagggaccatttacatcaccacaccaaataaccacacttcccactgttttaacaagtcaaacatcactctcataaggtctttttctttattgtttataggcaggatttacctggcagctacaaccaccaaaagacatcagaagggaaatgatgacaaaggaaccacagaagctctgagtttaagtcacatactactatctctggacaaatctattggttggaattagaaccctggcttgacaccagtgcacatgcaaagtttttggaacactagtggctccttctgtatccttctctacattcccttgcaccttctccaaactctaccttctgtagcaccttctacaaagtcttcaccatctctcaatgagaaagtagttcacatggagccgtgatactctcattcctaccatcttttgccttaatgattggtgcttgttttctgtgaatcacaaatttattttataatttccaaaacagaaatgggtttatatcaggaaagtctttgactggctggtttccaaatggctttatcacacttctctttaattgagcctattaatttgtagttcatttaaaagtctttttacatgtaaataattttagtagattaatacaaatacttcaatgacttcataagaaacgagcgaaagaaaatgccataatcaaaattagcaattttaatgagtgtaatagactgcattttcactgagatttataccttttaaaacaaagttgtctacatctcattaaatgcacaacagaccacctgaggctcattagtgtttccaggtataagaagataattagggatgaaggaatcaagggacttgccccaaagcaagacaaattatgttacagaatctggatgttcagtgtatgtttgtgcaaattcttcattacttattttactttattgaacaggcattaggagaaagtttctggatcccttaaattgcatataaaagacaccacctactctgagcaaatgattaataatactgataaaaggtgtccttttattcttagttgtaattgagaaagtaaaagacagacaaactggcaaagaacatgttataaaagtcctggaaaatgaagaaaaaccaccccaaacttaatgagattctgagaaccagaggacgataacgcaacagaaactgaacaccaatccaatgtgcctactgtgaaagacttcatgagatgccaaacaaacaagaatgtggaccatgtcaaaacacaatttatttactagaattctatgagggaagatggaaacaaccattggaacaataacaaaatgttctcactgtcatattttcaactatcaaaatctgacaaaaaggaattttgttttatggatgacactgatcaaggcttcaaaaccccaggtgtgtgcaaactgggctgggagtagctgtcacatcatcagacagcttatttgggaacatttcaacctcagaccagcctatttttagaaggacatttcctataactcagactaagaatggatcaaaaatggggtggcttacaaaaagaaatacatttcacaaagtttgatcagttcactgctttccacattgatcaggtggaatatgtaggtccattaatccttaataagataaaagtggttgtctgaagctaaaagggtatttgtgagacatgatgctactattaaactcatgaactcacaatggctgtgactgcacacacaacaggactgcaccagacacaaaccagtcaaaatcttggaatggacaaggaaagcattcatgaagtcattggctattgttttctccagggatatggcccatgaaagtctatccatgtttctgtagatggtcctatactcaatgcaaacaaaggcatggctaagtggactcagttttatggttgttgatatctgtttgttttgtacagcatgtaaagttaagaaggaaaagcggcagaaaatgcaggagaggacttagaagggaatagggatggatccaaacatgttatatgatatatgaaatccttgtaaaataaaggtaaaaataaagaaacacaaggaaggaggactttctgtgtctaaccttctagtatgtcagtggaagtgggaggtagagaaaggatgctgagagatctacatttaaaggaattgagcaggatttggcatttttgccatgagccattattcagtgtacaaggacatgggagggcccaactacagtccaacattttcaaaagtctgcatctccatcataagaaagagtagttttcaaagcagaactgatgttttccagaagactactgtcaaatagaatatatttaggacatcatttgctgtttatcatgcatacatgacattttctggtgatggagcttgtatgactggtacatttgcctctttgttctgctagatcgacagcttggtagattataaagtagtagtaaaaattcaacctgtgaatatgcataggtaaacctgggaattttcaaaatattttatgataaacagaaaaatcagcgactttataaggttgattaaatagtatacagaaatttaggaaaagactctttgatatctcacttcaaagttcatcttcctttcacaaattcacttattaaggtggaatccacttacattaaggtatgaatgcattctcaagtatactggaaaattgtctttaaaatggtaaattttagttgatagaaagcaatttgtcttctaggattcctgatatgtttgtgagtcctcctcctttgtcttttttctctgtgtggtgtgttttttttttatatacagaatgtatgtgtacaaatgataaatgcatgacatcaataaacatatttttcctctcttttgacttgtcatgatatctgccagattatctcactaaagatgattaaaatctttataaactattagtgttcatgggactgataacaatgatttacatcttaaaggagataggaaacacaaggtattttaagccatccccaattttcaaacattagaatgagtttttctaagttagtttgtctgcttcccccaaagaatgatattttatgcattttcttctgtatttcccccaataattttgaggagatgggaaaatacctatgcatgttctccccatgcagagaggaagctggcaatctgaaagagcatttcctcccagagagtaaaacagatgggtgtttacagggtctattcagacctgcctctttcatcttgaagttcttgtctgttagtctttttctccaaataattgaacttggatgatgttttcctgaagtgggagagcaggcacactttgaagtgtcactgggagctaaaaggagagagactaagattttctcagaggcaaagcgataggagagaatgaaggatgatgagcttcagctcagggatttgaggacctggatgaagagatttgattagctggttcagggagaaaaaaatcgataggaaaggtgagccatttgaaatcatgaattgagggaagccctggatcaatctgggctaggaattactttttctaaggctcagacattctattttcagtcagataggcttagaataaaatcataactagtctgaaataaattcatggatgtctaccttataaaataaaaacaaaagtttggaattgagttgctaagaacaagaagattcttaaacatagtacttctgcacctctctatatttttgaaggtatattaaaaattattgacaaaatggtccaaaggttaaaactgagggtacaggttgacagggttgaatagtgtttatataactgaatcatccaaattcaagactggattaaaatggacagtttatttttcaaggagttggcaaggctatcatcatttggtgaaatgaaaagcatggttgtaattttttgcattgaagtatagcacacatacaataactactcatcatcaataaaaaaatacttaaaatcttaaactttctccttcatcatcaagattctacctctaaaaagtgtcaatttaaacaaagcaggattttggaggcaggagctgatacagaggccatggaggagagctgcttaccaggttgccccccatgttttattcaaccctgttctcttatagaacctaggaccacaagtctagggttggcccaactcacaatggactggggcctcccacatcaaacactaatttaaaaggtgtcctacagatttgcctataagcctgatattatggtgggattttctcagtctagatgactctagcttgtgacaagtagacataatgagagctatcacaatcaccctttagattattccactaccaaactccaacaaatgagatatcaaaaataagaaaacaaaatcaaaatcaaggacaagcaattagaattaatttttaatttttaagttaattttattttattatttttggtttttcgagacagggtttctctgtgtagctttggaacctatcctggcactcgctctggagaccaggctgtccttgaactcacagagatccacctgcctctgcctcccaagtgctaggattaaaggtgtgtgccaccaatgtctggctagaattaatttatagaagccttttttttttaaataaaaagacaagaggagccccatagatttcccaggcctcttaactgacacccacgtttagggggtctggttgatcctatgctggcttcccagctatcagtctggggtccaggagctcccccttgttcagatcagctgtttctatggatttctccagcctggtcttgacccctttgctcatcactcctccttctctacaactggattccaggagttcttctcagtgtttagctgtggagcctctggcaaatagatcaccatttacccctagtatccaaatggactttgggagcccattccacatagaggtatactctttcagcaaagacacaagtggccacctaggccctgctccaaatgatgtgaacagactttgaagatcccacatggaaggccttaccctccctggggagccgaaaggggggtataggggtttggtgggagcaggagaggagggaagggagagggaactgggaatgacatgtaaaacaagcttgtttctaatttaaacttaaaaaaggagaaaaagacaagaggaagaagcatttctcaaaaatatttaatttcattttatttgactatatgaatcactaattttccacaggctgatactgcagctatcataatagaaactaaaccaaatattttatatcaataattgagaagtgatcaccaaaactttttcctcactaggtaccaaaattactaaccaaatgaattaacttccttttttagaggagaaggaccttagaaatgaaaaaaaaattaattttgggtatgtatcagtctttaaatagatttttaaaattaacccattaatttgaggtttaaaaaattcctactgcagcttttttctccatcattttatttaaattagaaacaagattgttttacatgtcaaatctagttccctctccttcccctcctaccctgacccccactaacatcctacctatcccataccaattctgcttcccacagagagtgaggtcttccaaacacaaaagaaaataccttattttcagcaccctatggaatcttttctaaaatcaaccacatactcggcaacatagcaaacctcaacaggtacaaaaaaatttcgataacaccctgtgtctaatcagaccaccatgctttaaagttagaattcaagaacaacacaaattgcagaaaacctaccaactcatggaaactgaacaatgtacaattgcaggattcctgggtcaaggaagaaatacagaaagaaattaaagacttcctagaattcaatgaaaatggagacacaacatataacttatcttttatcataactaaggaaaaccataactatcggtctgtaactccattaaagagcacagaagggtaatatataacctctagtttggacagaatgctgtaaagcagtccagacaaaagcagttttttgtccaaatggccagttttgcctgctgtttctgtcattacttgcacctttaggaaggtgcactcttgcatttcctgcttaccctagtaatgttgttttccttcttaggcctttgatgaggttgaagactacataatatcctctcttatcttatatagaaaacaataggtataataggcactagggaaatgtctggagatctacaaagatgacaacaactggcaatctaggcaacagaaaagaggctaccttaactgccctcccctgataatgagattggtgactggcttatatgccatcctatagccttcatccagcaggtggtggaagtagaagcagacagccacagctaatcactgaactgaactcaaatccagttgaaaagaaagacgagtgatgagcataggggtccagaccaggttggtgaaacacacagaaatagatgaccagaacaacagggagctcttggtccccagactgatagctgggaaaccagcactgcactgatcccgaacctaggaatgtgggtgtcagtgaggagacctcagaaatccatggggcctcttgtagtagatcagtacttatccctagcttaggtgtgtactttgggagcccattgcacataagggatactccctgagccaagacacacggggtgggttaggccctttcccaaaggctatgacagacattgaagaccccctatggaaggcctcaccctccctggggagcagaaagggtatgtgataggtagagttttagttgggggagggtgataggggaggatgggagggagagggactgggattgacatgtaaaataatcttgtttctaatacaaataaaaaatggaaataaatgaaacacttaataaaattttcatgagaggttgaaacctttaattattaaatgggttcttttgattacctatgtatcttaaaaacaaactgtactaaaagtttcagattttctagcttcaataaaacctttattatttataataaaagaagaaaatactaggtataatacttagactttctagattaggacagctatgggagtaatctcttgcatatgctaatgccttgggaatggacatgtagaatgtgtcgattgctcattgttgctcttgctggttgtaggtctaaatttgtttttacctctccttctcctggtctatacttgaagtttgttattgtatattgttttcatatgagacttgaaacccccttatttagatgaaaggggaattgtagtggcatcttgttttgtcagtgaacttgtggttgtggccacactctgggcatgggttttaggttcagatatgaccccttgtaaagtaatggatggactggctttcagtctcttgggttgcagtaagagcattgaaagggcagagactgcatcttctggagcaggatgaccatgaagtgttatttactcttatctgtgtaagtgattccctaataaacacctaactatcacttttcagggttctgctagactcatttaaacctcaccttcattttctcttttcccatcaacttctaaataagatatatttctgaataaatttcgattttctttaaatttcctatttatatctgggagaaaggctaatatgttttaaaataaaagtgaatcattaggagtcattttaataccatgtgcatttaagtaaataatggtattgaattcaatgctcatcaaagcagcaccttctattagaagactgtgaacacaagattctcaaatggtcaaaactctcagaataagagagtgaggagtgctcagtcctaaagagaacatgcttattgtaccacttcctgaaattctcagggaacatggcagaagatggatcagatgtgggtagaaggtagaagatgaccaagaaaccaaggccgttacacttctgaattcacaagagttttaacaatattcactcaaactacacaaactcaagccagacaaaatttcagcacagagcacaaaagatgggtgcaaaattccaccactgactgaagagctattggcatttgatagctactaggaaaggaagtcaattttcttcaaaaatgtgacacttggttatttgaccacattctggaaaagatcccatacccaagaatatttggccaacacacattggaatccatgaagaaaaacaaataaagaaaagagctggatgcttggggaatgagggtgggattaagggatgttataggatgctttgtgtaacattctcaaatacttaataacataataataaactaaaggttaatcatctttgaatattttcattacctataaattgttccattaaaactcatttgtactagaatttataaggttattaattttaataaaataacttttagttggtattaagctatatttataagaagcatctagacgtcttaattttcattcataaatatactcaatatggaattctgaatcaattcattcatatattcctgtagttaagatattcattttgggaaactgtatgagattagtgtgagattgaatgacacaggaattcaaataattatccactgtgtggcaactgttatcatagtaaaaggtatagttacttactattgttatttagaatgttgatttctgtacctgtttttaattttaaattatttagacctcattttaagtgaatggtcagacttttcagttctatctttgttgagtaactaaatgtagagttcatgattagaaggcataagatcctggttcattctccagaaaataaaaagacaaaatggaaggaagagacagaggaaatgagagtgaaagtacgaaagggaaaaaaaggaaaaaaggcaattttatattgaaggaaccagcttccttttggcagccataacagccgaacacgtgcttgccataaacctgccttggtcacgtagaggtcagatgcctgtctcgtgacaaggaaccttagtcacttagaggtcagatgcctgtcttgtgacaaggagccaatcggaagttagctggtggcgctatgctttacgaccctgggtgtgctttacggacaagcgcacgacaatgacgtagagagcatagcaaccaccctgggagggcctatgggccataacaaccagttgaccaatcaacacagggcaagccctccaagcctggaagcacaccaattgtgagcctgtgcgtaagcctgtgtgtacccctagacactccccttacgctgccctataagatcttttgggagacccaaggagccgtctttctctagccgtctgccatggcgggtgggtgaaagacccgagctaacatggggttagttcgttaaattacaataaagcctcgtgcagtttgcagcaagctctcgaatccgcctggtgattggggtgaccgcgaacctggcctgagaccccggttacttgagttttcgggggtctaacaatattacaataccactttttctccaaacctacaactaaacaaaaaacaaaaaatctgaataatcttcaaaggtttagaagcatgtaagataattttaaattattgtattttgtagaacatatgtatcttcaattttaaatgttcttgggagaatgtgtaaaatgtgaacattaaatttgaagatacatatactatattttaagggattcgtacctcaccaatcagtaaatcccaaagaactttattgataataacagttgtaacacattaaataaatgtattaattaatcatatccatgtcttgcatgtgacataatacctcaaagatctgttgaaaacctaagttattaaattttgtgataatctaataaaatctttaatatggcttcttaagattttttttcctttttggaaaacaatcttttcatacaatgtattctaatcatggcttcccatacctcaactcttcccagatgatctctactgcccccactcctcacctaccaactccacatctcctttaaaagtacaacaatatgatatataaaagttcatgaatgtatactttacacaaaagttttgaaattattggcttttagtaattcaagaaatgccttgtaaattagagcatgaagaaaactgttttaatttattcttcgcctatagtgacacataggacactgtaaatgaagttttgaaatgttttagcattgtaattaataaaatgaatacaaatgaaaatggtcatttgatcttcccacctgaattaagactgctaccttttctgaagttaaacaggtggcatcatgcattgtttatagtcatggttctgatcacagtcttcctgctgcttacagacccatgagtggacctctaggggatccattactcttaaaagtctctcaaaaaccaggacttgtcttcatgaggcctgagagcacatatgtgttaaacctgctcttggtccataatatgcttcccctctcacctactgatgtcccaaatctattattttaggtcccacactacatacaggaattgccctgcccagtttgcttcactagctagattcatctctagtgatgagtccttaggctgtaatatctgtacctgttgcttcttcagtcagacactgatgagcacagatgctcataccaatgtacaaaaatgaggaaaaaaattggggagaaatgaagtatgtattgcttatatgaagatgatacatatctcctgtcttcttactcctgttttccctgtggactatgagacagtatttttgtgtttgattttagaagatgggaagtccatactgactatggaggattgatgcatataggagaaaagtactagaatatccggtcattgttaagtgaccatagaaggcttgccataattgaaaatgataaattgtttgattttctacttgatcattttcaattattgaataatcaaaaaccaaaaagtaaaacagaggtttgaatctcaacttaacaaatgctgaagagatttataattgtcgctatcaaggagtgttcaaatattgccactcatttcttctgttaattaatatttactaatatacacataattttctaaatgtagaatatgtatttactttttaaagataaagcatttaatctggggctcagttttagaggcttagtaagtgactatctataggtaaataattttgaaaaccactatgtaagtgacagtagggaacaactatgaaaagatcctttcacatctccatgatgaaaaaggaaggatgggtgaggtaacccaatcgcaaaaagacaaacatggtatgtactcactcatatgcggatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagagggagacatttttggtttagagagaaatcaggcgctagggaaatgtctggacatctacaaagatgacaccagctaactaattcagcaatggaggagaggctaccttaaatgccctcccctgattatgagattgatgactgacttatatgtcatcctatagccttcatccagcagctggtggaagtagaagcaaacacccataactaatcactgaactaaactggaacccagatgcagagaaggaccagtgaagagcacagaggtccagaccaggctggtgaaacccacagaaacagccgacctgaacaccggagaacacttgctcccagtctgatagctggaataccagcatgggactcatccagaccccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagacacacagcggtgggcctaggccctatcccaaaggatacaaaagactctgatgacaccctatggaaggcctcaccatccagggggagcagaaaagatatgtgacagattggggggtgggtagggaaggatgggtgggagaagggaactaggattgtcatgtaaaacaatcctgtttctaattcaaataaaaatgttggaaataaaaggaaggatgggacagaaaaaaagaaatgagagagaaagaaaataaggaaggcaaacatgaaggaagacaatgctgcttgacactaatggaaccaaaatatgccaagaactcacaatagcacccaactcaaagaaaacagcaacaaacttacaaaaggtgtgaataatttgaaatttatcatttttatttacaagatgttattcctaatgtgtgtcttcccattacctaaatgcatctaatttcccacaaaaataattgacttcctctcctaggtattcaattaatctctcaacattctctacctgtggatacatatttgacccacacatgtcagctatgtggactccacacagcacctttgtacaatcagctgtcagggatttctcttgaagtctataaatgcattcaaatcattctctgagctctgagatacatcttactactttgatctaaaattctatcaactcaacttcattcttttcacatttcttttactcttttattcatgcttgtcatactatagtcttatatgttctggaagcattgcaaattttactcaccttttaaaattttgaatattattcctcttaaatattgtcttcaccccttatttttccaatgaaatcctactcattgtcctaacaggttttaagagtgtcaattcaaacatcgttccctccattgaggagaaaacatgtttgcttactagtatattcagtaaaaacatataaaggaaatattattttctgataatgatgtgagcactgtaaaaccagaggcaatctaaacatcaaaatttccttcatcacttcatcattgcattaacacacctatgtggggtttgtacagtaatcagaaacagattattgtaatagccttttatatggagaagagcactttaaaatcaactcatgacagttggaattctctaagaaccatgactaaagtatttatttgaatgacaggtgtccttcatagacttcattctatgaagtcataggccctttaaattttgtccctgaatgatggccaaatgatgttcatgcatctttgatgttatgattaaacagggtcccttgatatcaatccctatattattatcagaaactataggttctatcaactgcatccaaaggactctagcatggcaatttgaaaatgctcttgagggcaacacatgaacagaatgttagaaggtaagatgtttttaaattttccctttgctctttcaattgtaaaactagagtgagtttaattccctttgacagaggtctttgccaaatgtctctgcaaatgtaccatcatacattatttagcaaggaccatgctctaattcatgcagtcagcatattcttatgttcattagagtcctcatactaagttactaagtgctctgtgcaatagtcctgctttaggtattgggcttcttaagagctcataccttagaccatttgcatattttgatttaatgtgaaatgccacacatgaattcacatgcttaaacatttgttccacaagtggtggtggcatttggcaagtcctggaacactgaagagacagaagaaataggccttttgcctgggtttgaagttttctaattcagtgtggggaccaaataattgttatgaaatattttggggcccagcctccagctccagcaaacaggggcgtgggaaagttccggactattgtattgttaattgccagtagggctgctattgtttaccatggcctcagggtaaaatgccttctatttgcacctctgtgggcctaagcatctgaataggcctgcacctgggcagaggtgggaggtgagtgagtaactagggaggaccgagttaggggccatagaccccgcagagaggagaatgaggagagaaatagttcccttgtggtcatgacaggacagttaagaaacaccagaaaagatggctaataaagaaatgattctagttctacaacatggaactaagagctctctaaagatgacaagatgcctgtgtttgatctttatcgccgttgggttgctgagttcccccccccccccccccgcatggattaaggctgagacatgctgggacaggacaatccagttaccttcctgttttccacttccaccaagacttgagaagatgagacttgagaagagcatctacatgccacgaaggagatggagggtgccatgacttccttcagggacagactgtgtcctctgaaactatgtaaaaacacacagtttccttcaagtgcttcttgctgagtatttgatcaaggaaacaaacaagtaccagttttgtccagaaggcccagaaggtagagatgcttgatccagatgccatatgggaggaaaggattaaattgtcttctaacccctacatgtgtgccttagtgtgtgtgtgtgtgtgtgtgtgtatgtgtgcatgcacatgtgcatggacatggtttagtacagtcactatcactaaataaattcaataacaaaagaaaataaactaagaccatgtacattacatattttctaggatcatgcatgataaaggatgggtggtcaatatagttttctctgatggcctgcatagaaagcaatgtatatggcttcctgcatataaggcattatccatagcttcctgcattaaaataagaatattttccctgatctgtttttatttagggttgtttttctttttgtgcattttaaatgtttgtgtgttagtcttgaaggaaccggcttcccttttggcagccataatggtcgaacatgtgcttctatgaccttgtcctagaaaccagaaagtcagatgcctgtctcgtgacaaggaaccaatcagaagttagctggtggcgctatgctttatggctctgggtatgctttacggacaagcgcacagcaatgacgtagagagcatagcaaccaccctgggagggcctatgggccataacaaccagttgaccaatcaacacagggcaagccctccaagcctggaagcacaccaatcctgagcctgtgcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcagttaagatttaaaatgttaatgcttctatatattacagaaagaccttaagggaatttaaatttctttttaaaaccagttttcaaatgtttgtttttattaatgtttgtacttaaagagcttcaatttagaattatttctaagcaaagcctgacaatgtaaagttcttgttttatgaaagatgctgatctattttaagatgttacagttcatgtttttaaaaattaagtttaagatgttggtaacacacacctttaagtttaggacgttggtggcacacgcctttaatcccaatattcaggagtaagaggtagatagatctttatgagttcaaggcctgcctggtccggcagatcgaattccagaacaggctccaaagtcacagaaaaaccctgcctcagaaagaagttaagctactgtttaaggaatataaggtagctctatacagtgttaagttcagctgtgctgtttcaaactttttactaagttaaaaccagttacagtcagactaaaaattaattacagaaataagactttacctagccacctgtatgcttcttgtatgcgtaaggcaagtaactaaaacagacagacagacctctaatgcttcagagatcttcagaatatggcatttaaattgttatctttaaagtttataatgtcagacagactgccagatccggagagtgacccaaaggctccaaagattatgaggcaacccagtttctacacctggaccagtgagcgagatgctcagatgtgaaacctgccgcctgccagaacctggccaagaatgtggacaaagctgctgggcactggaaaattgattgtacccctttgcctagacaaaacaaggtcagtcttttccatggccctcttccacagagagaaaataaaacctctcacagataggcctggcgaagattgttgttctttgagacnnnnnnnnnnnnnnnnnngagaaacttgggtttggctaactgtatatggacttgcttctgactggcttctgtcacttttagtagattcggataaaatatacccttctcagatctctgaaatattactggttgtcagcttgacagcatcaggcagtcagatccactatagactagtcagtatgttagctgataaaatagtaactatctattgttcaggcacaagctcaaggtttttaagtttattttggttgtcatctaagtacaaacttaaagggcttttcatcaggccaaaggcacctctgtccaatccatacctggctctctggacagaagaaaaatatacatgcttatagcccaaatctgcagtttttgggggtctaacagtctaacttttgtcctatccatagtagttacatggtttgaaaatatatgtgtgtcccgtgaatatcagttgtctcacgtaagtttaagcatgctctgattatttgttaccaagttgtatctagtaactgcatactctgtattatccagcatttttgagtatataattatgttggcactagaagtatggcccgaattatcctaaagtaatgagaccaaaaaagtatttatagtaatattctgtgcgaagtgagggccatttggttcacagcatattctgcaaatcaagtttccacagtttttttgtacatagatttgtggtagaaacctgagtcctcagaaggccctggaaaagaagaaatgctgactcaggaatctactgcatggcagtaggagaaactgccccacagtgatagcaatgtggttcagtaagatcctcagatggcattttaaacaaatgctgttaattttgggctttattggttttatagttttcctttatttaatgcatacatttgttttagtttatagttgcataagactataagattggtagtttatactttatatttaaatgtatttaatgacattattgtcaatgtaagtcaactcaacactgggaggttgagacttctttctctttcaccacagtaaattacatattaagatgaaatagagacagtgtccaagagcaacatatttacttccaaaatcaaatatttcaagggtgtcaggaagcaggctccaaagctacaaatactccacgtgatttctgctgagcattggggtagctgcaagctccttcaaatgtgttttatgtaattacattagtgtcagtttttaatttatattgtatccccaagctaatatctcacataaaatgtaacattcatggtgctttaaatttagttgacatttttctttattaatgtgtcatacacaattctctactttagtttaacttggagatattaaatttgttgttcccttctaaaaaatgagatgagatatttcaaaatctgtgtatttgaagaaaaaaagaatcattttaattcttctataaattctatttttattattaacattatatttatcatatgtatatgagtgtttggaatgcatgcaccacttgtatagcctgtgcctttggaggtcagaaaagggtgtcagattccctggagctggatttattatagttacaatggtatttttacttttgagttcattataatgaaattattttttattaaaaatcacttgtaggatttctgggactcatacaatatttaaatgaacgatgttataagttgactgcagtaatatatccagtggtagtagaggtcagggtcagtgacagtagcagaagaagcatctttggttggtgactaattctcttactgtgttaagatttgttatgcttgtaatgacactgagtagataagaattgcattgttttgtctttgaagacaattggcttagtttctctcccatttctttgacaaaatacctgacaaacatcatcattttttgtacaaatggcttattcagacaaacctggaattataagaaacacagtgtattggtcttatagggaagagaagtctgtccttgcagaaaagtcaaagtggcaggaactagagacagctgatcatattatatccacagttaagaagcagagagcaaagaatcagataacttcattataaaatagttgaggggggcaaaggatataaatgtatgtatagcatgttttatctcactccctttttccctgctataaaaatcaatgcaactctctctctctctctctctctctctctctctctctctctctttctctctctctctcattttacctatttgaaatttgtataagtatagccaaaagaaataattgcatcaaatgtgttgaaaaataagaaaacacttaaaaatcattggtttataaattccataatgaaattttactatatgcaatgaaatcaaatcaaagatattaagtcatatttcaagcaccacacatgcacaggttatgacattatattgtaaattaaagaagcttttgattcagtgacatcagtggggcagcaaataacttgatagagaaataatatattttcatttatgctttgtaaatttaattaagtataaaaaggattagggaagaaccctaatactaatgaagaataacaatgagtgacatacaattatctttgctttaaaatgaaatcctatcccagagacatattttatgtcccaaattttacttttgtaaaaaaacatggttttttgaaaagaataaattttaataaaaaagggttatatttagagtagttctttatactagcctcttaaaatacttcagatttctttcaggtgttactcgtgcaagtaatttattatcaagggtaataattatgaagacaaacataaaaagaaaaatgagcagaaaaaagaatcttctacactatcttagcatgcatgtctgtcttcaggataaccaaaattgtgtgatcagatttaatctgtatcataaaagaagcctctcttcataaatttcatggatgccattactgtgatgttgtgaccctttcagaaactaccttatttttttaggaacacacatacatatatgaatatatattaacaatatatatgttcatatatacatgtattcttatatacatttgaaatgaagtatgtgcatgcctctctctatctctcactctctcggtatgtgttggtagttgataggcatgtgaaagggggaatggcagggattatggcagatattggtgacagtaagacatttcagtcttctgtacattgttattattagagaccgtgtgattctgaaactcatagaagccactttatgaccatgaattacctaaaatttaggggtcaaatcaaatttccaccttgccagaggccttagagaagaacctaatgttatcatttagataaattggtacaataacaaagtccctcctagatctcactttatatccttagtttagtgaacctcttaacactccttgaagatgcttcatttgctgtggatggtaataaatacagaagatcaggaagtggccaacacaaaaagaataaaaaactggacatctcagttcaaagttagacatcattatcacaactgactttcaggaatcatcttagaagaagtggagggaagatttaagaggcagaggtgctacacatttgtagcaaaacagtatttgtactgcatacaaaagactcacacatgataaaaacaacaataatctcaacatgggcagagggagggctcatgaagccccacacacatctgaggagatattggctatatattgctgttgggggaggaaaattcaaatggcaccagtgatgtagttgcagagaagcaacatttactattgcagaagctattacatccatgcacagacaagtacaactaagtggactcagtaggtctcaaaaaaagaacatgcaattgagagggaaaagtggtggtaaagcagtagaagaactggagtggaagagatagggactggatttcatcaacaaccttttatgtatagatgagactctgaaacaaacaaaaaataaaagaaagaaataagtttattcaacagctctaatgtttggaaccagacacagtgctaattggactgtgctgatcaattcatgctcttgccatttcactaaaaccaatgctaatattgcataagcccccagaatataaatgcagaagcatctagaaatgaaaatgtccttttcttagcaaaagcaaggaatgcttgtattttgtcttacaacataaatgtttcttgatatgaaaaatgaaggatggatgtgctcaaccctgttataattatgaaggcatccacagaaagctacaacatgcaggaacaggaacatgccaagctctgtggctagtgacagaaggcaacgccccaccccagccccaaatttccaagactggtaatgaaagaacagattgatagctataagaaatgttgtggtttagtttctgttgttgcaaagtataaatatatacatttattaataggacattgcagggagtcaaaagggagaaagaaggatgaagaagaaagacaattcaaaatgagatagatcttaaacttacagaaagcctagatctggtgccatgtttgttgtgcaaaaaatgagatcacttccatacaataaagcccttcagttcaggtttttaattcaatattaatttgaaggactgagaatatagttaatataagctaacaaaacagggaggggaattttaacctacaatacttaggtagcaagataggacattatagagattaaaaataatagacaagagagaagcattttgggtctgttttgtttttagaaagggaagggctaatctctaatcaatgattacaataaggtcaattagaaagaaaatgctaagacatgcctttattctagtcagttttgtaccactaaaggatttttctgttctctatagctgtttcagaacacagtcaatgaatagaatgctttgtagttgaaataaagggtgaaatattgtatagcaatatttgaatgaggaaggagttgtaacataaaaggaggcattgggtgtcaagataacttcaaagtgtgtcaagtctaaattaaagagttaggatagaaacaaagattaactactccactacctccaccaaaagcattatagatgaatcatttcatgtctttgttggcaccagtcatgtcagaagcaagaaaatgaattcatatatttcttttcagtgatggatccattatgtatttcccaccttagatcaaagatgcccagaaatattttggagtgctgaataaatgatctgttgtttccctggcctgtaggggcataacaaatgtactatacccaaaacactggtgacaacaaattcagttctgacctgcactggctctaacaccaacttgctttgttttaaagcttgcaaagtgaagctgtctcaggtcagttctgtgggaggagggatggtgtgtatgtgtgcttctgcttgggaaaacacattggccaacaggtgctgggtattgaacccatgtcctctcaagacgagcaagtacttataaccactgagccatctttccagctcatttatcatgctttaaagggagataggaaaacacatagattctatgaagattgatcacaaaaatatattttaatataatatcctaactgttggaagctgagaaagtactgaacaaaaggtttgactgaaggcaggattaatggatatgattttgtctaagtatgtgactgatttagccactaagtaagcacctgagtgaagagatggctaaggagtgagttctaagagttaatagaatgtgttgtgttattcttcttcctttcatttgcttttgtgtgacaccatttttaaaacatcaaccatctgacctgaaaatgaggaaactcagactttatataatttaacaagtaaatgcaaacatcaaatcctgaagaatggcagtaagaaaggataggcttcctagaattcaatgaaaataactgaacaaaatacctgaacttatgagcttatgggacacaatgtatatattactatggggaaagttcttagcattaagtgcttaccttaaaaaattggagagatctcattgtagcaacttagtagcacacctgaaaactctagaacaaaaagaagttcactcaagaggagaagagagcaggaaataaactgagggacgaaatcaataaaatagaaacaaagaggataataaaacaatcaaatgaaacaaaaatatacaaatatatacaaatgaaacaaggagatttgtctgagaaaatcaacaaaataggaaaaaacctgtatccaaaataactaaaagatgcagagagaatatctaaattaataccatcagaagtgaagggggttatagcaacagatcctgataatcattaagtcatacgttagaagcctgtacttcacaaaattggaaaaccaaaaaaaaaaaattctaattgcctcaaaagttaacacttatcaaagttaaatcaagatcagataaacaatttaaatagactcataaacactgcagaaatgtgcacattcattaaaagtctcccaaccaaaaaagcccagggtaacatggatttcatacagaattacaccatactttcaaagaagagttaatgctaatccacctcaaattattccacaaattataaacagaaggaacattgtcaaattacctttatgaggtcatggtcaccctgatatccaaaacacacaaagatttaacaaagaaagagaattacggaacaattttccttatgaatacagaggcaaaaatactcaataaattatttgcaaactaaactgaagaatacatcaaaaaagataatttaccatgaacaagtaggcttcatccaagagacgcagggatggttcaaaacaagaaaatttgtcaatgtaatcatagaaatgaaatcaaagaaaaaataaaacaaaacataagatcatctcactagatcctgagaaagccttcagtataatccaacaccatttcatgataaaaagtcttggaaagatgagagacaaaagacatttaactaaaaatattataagcaatacacattaaccatacagccaacatcaaattaagtggagaggaattcaaagcagttctattaaaatcagggacaagacaagcctgtactttctccctatatctattcaatgtagtgcctgaagtttcagctagagcaataagacaactaaaggagatcaaggaattacaaatcagaaaggaagaagtgaaagtatccttatttgcagataatatgataatatacataagtgaccaaaaaaattttatcatgaattactatagcagatatacacattcagtaaagtgactggatacaaaacaaaacaaagaaaaacccaatagccttcctatatacaaatgaaaaatcaactgagaaagaagtcaggaaaacaacaccctttagccacaaatgacataaagtatcatggagtaactctaaccaagcaagtgaaagacttgtgtgataaaaactgtaactctttgaagaaatttaagaagatatcagaagaaggaaagatcttccatgctcatgggttggtagaatcaacatagtaaaaatgtaatgaaattttgtttatgttgtaacaaataaagcttgcctgaaagtaagaatgcaaatctagccacacctgttagccatagaggccagacagtggtggtacacacctttaattccagcacgtgggaaacagaggcatatggatctttattagttcatggccaccttgggctacaggagattaaatctgtctgaaaacgaaacagagctcacacaaaattgatcccagaactggggatctgatgcctttaataccagcactaaagtggagacagagttatatggctgggcaaagagaggaatataaggcaggaggagacaggagctcaatgcaatctgaggaacagagcagtctaagaagtctaaggatgcagtctgaggacaggatcacctctttggtctgagcattggtagaggtgaaatctctagttgctgacctctctgcttctcttaacttcagcatcagcatcaaccccaatatctggttctgaattttaattattaagacatattataattcatgctacataaaaatggctatgctacaaaagcaatctgtagattcagtgcaatccctgtcagaatgcctacacagttttactgatctttaaagacaatactcaacttcatatggaaaacaaaaccaaggttagctaaaataagagtgtacaataaaagaacttctggaggcatcaccatccctgatttcaagctctactaaagagctagagtaataaaaactgcacgatattggcataaacacaaacacactgaacaatgtaattgaattaaagaccaagatataaatacacacacctatgaacaccttattatttataaagaagccagaaatactcaactgaaagaaaaggaaagtctcttcaacaaatggtgttgtacaaactggatataagcatgtagaaggatgcaaatagaccaatacttgttaccctgcacaaaatcaagtccaagtagatcaaagacttcaatataaatccagaaagaatgagcctgataaatgacaaagtggggattggccttgaacacattagcactggagaggactttctgaacagaataccagtagcacaggcactaaaatcaacaactaatgaatggaacctcatgaaactttaaagcaaacgacactgtcaataggacaaaacagcaggccacagaatgggagaagaccttcaccaactctaaaattgataaaggactaatatctaaaatatacacagaacttaaaaaattaggcctcaacaacccaaatagttcaattaaaatttgcatacgtagggcctagttcaatcttaggctgggtggcttgggtagtttatggggccactagctgggaaatcagtatttatccctaatgcatgaacttgtgttttggagcccattccctatggaaggataccttgctcagcctagatacagcagtgagggtcttggtcctgcctcaactgatgtgacagattttgttgatttccccatggaaggtctcaccctctcagggcagtgtgtaggaagtggagtggggagaaggtccagggagcaggaagacaggaggaagaaggaacactaggattggtatgtaaggtaagattgttttaaaaataaaacaaaaggaataatggggtacagatgtacacatagaattcacaatggaggaatttcaaattgctgagaaatagttaaagtaatgttcagagcctgcatgggtctatgttaggacctctgcatatatgttagcctagtatttttgtggggctactagcattgggaataggggtatctttgactctttcttctgctattattagtctttttcctcctactgggttgcttggctcatcattgatactatggtttatgccaagtcttattataacttgttatgctgtgttcagtggatatccctgaaaatcctgctcttttctcaagggaaactgaggaagagtgtccctgggggagaggggtggtgggtaactgggaggatgtgtgaatatgtgggactggggggagtggagagaggggaagctacaatcaggatttgtagaaaacaaaacaaaaaaccaaaaatattataaaataaaaatataaaaataagatattgcactttagtaccatatgatgaaaaaattaaacattttgaaattttctcatcactttcagaagtacttatatcaatgacacatttagaaccattgcaaatgccatgaaatataatgcaggataaaaattaatgagataagatgcctgtggtttcaaatgtggcaaacaaagtttcacattcagtgaaatgctctcttttggaagtggagtcataattggattaataaagaaataaagtcaaggtaaaatatctggaacctttttttagtatggctatccatgagtggcaaagcaaaagaggaaggaaaaaggggccagaaacagggatcaagagaaataaagaataatggcaagatatggggttggtctaaaacttgttttacatttgttcagcattttacaatttacatttacatttgttcagcattgccttgaaaatttaagtactttacatagcacttcattttaaaattggtagctgttaatctcagcactcacttgggaggcagatggatatctttgagtttgaggccagtctggttaaaaaaccagttccaggacaactacagttggtatatagagaaatcctgtctcaaaaaaccaaaagaaaaattaatgaaaacaaagcttttaaggacaatgtgtagggcaatctggcttgctagactattttaatggcacacttctagatcagaagagaattcctacctcaaagactaaagttgaggagagccattgaagaagacactgaagtcaatttctgtcctccctgggcagatatgctcaggtgtacccacactttcccaggcttccctccatctctctttctttctaactctgtctctctctggcagacaccacatactcatgagaaaaaaataaagaaacaaacaaaaaacaatcttcaccaatagacatatgtctaatccagaagaaagaattctaaaacctagtacttatttcaaaatatattcatatggttgatttcctataaaaagacattatactgacctaacacattaatgaggcaatccaagagataaaagtgagtttttcttaagagactaacctaccattcattaacttcccaggaagttaacatatggtaacagccatcttgctttcctctcacttcccaggaagcttcccacccaaccctgagtagaaggtcgtcaacctcccagtcactttaatcatttcctttcccagccatcagcttccaagaatttataatgtctaggaaccccagagctcactaagtctaaagacatgagcatgtctgtctccaaatgctgtgcaaagaaaatcagggaacccaatcattgaatttcttttataaagtaatcgaaatgctgtttttcatgtgtgttagttgagttctgagtgcacatgtcagcatcagggggtgtaggttggagtcacaactcagacttctgtctgcagtagactgagttttttgagatggttccacttgtgtgaaatgtttgatctcactacacacacacacacacacacacacacacacacacacacacacacacatatacacctcaccatgtgcctgcatgagcaagtattgagatgatcctgccagccagcttattcagcttactcttcttggacctgggactagggctgcatgttcttttttttctcttcctccccttttttttattattatttcaagttagggaacaggcttgtttcacatgcaagtcccttctccctcttcctcccctcatccccatccctcctccccacctccaacctatcccccacctccaacctaccctccaccctatccacccaccactccccaggcagggtagggcccccaacaggggctccgcaaagtccaccaaatcttcctgtgctgggcctaggcccctccccatgtgtccagagacagagtgcatcccttcacgtgggatgggctctcaaagtcgacccacacacaccagggaaaaaccaccagtccacctccagaggctccccggagtgcaggggcctccccattggcatccatgatcagggcgctggatcagtcctgcactagcctctcagacagcatctggggtcgatatgtatagtgggaaattaccaatacagagtcaggtagaaatataagggtatttaatagggaaaagccttacttacagagcaacctagccagccggcgtggtagtagtctgtacatcaagaagcaaagagaaacaaaaagcgcaaacgcagtcacactacgtcactctgaccacaccctcacaagcatggtcaggcccacctgtagccagcccctaagaaggcatggctacagcttcccctacaattccccttttagtctaaaagaggattaaaacttaacagtataaagtatccaaaattagcaatcataaaagtacaacaatctgtttatttcacatcctaactataactaaaccctaaagtcatctgaaagaggtttccaagcctgaacacctcggttcaatcccaaccaaaaacaataggaagcaatccctaactaggtatatacactatcctaaatgacaacaatggggaaagggggcatagcattctgcaagttactagtacaacaatctgtttatttcacatcctaactataactaaaccctaaagtcatctgaaagaggtttccaagcctgaacacctcggttcaatcccaaccaaaaacaataggaagcaatccctaactaggtatatacactatcctaaatgacaacaatggggaaagggggcatagcattctgcaagttacttcctgctgaaatgggacgatgatagtcatgtgcagtcctgtaggaagaaaatgttagtatccagtccatgttagatgggattcacttgattgaagatctcgcttgaaatcctcaacttgattgaagtcagtacccgaacctctggccggagtgtcagttgaaatggagcaagttggatctagtgcagtcgaggaggtgtagcctattttctttccagggtgtccagggattgctgttatgctttccctttttcaggccaactgtttctgtgggtttctctaacctggtacagaccccttcaatcttcattcctccctatcttcaactaggttccagatttcagctctgtgtatttctgtggatgtctgtctctgcttccatcagccactggatgagggctctaggatagcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatctcgtatcctgctctctctcctctatttttcaccctactcaatatctctactcctccatttcctctcctcctcttctcattctcttattgtggcagcaccctctcccctaccctcatgctttcaattagctctggagttcatgccacttcccattcctggggtctatttagcccttagaatccttcatgattcctagtttctttggtgaagagattataggctggtaaacctttgctctatgtctaaaaatcatatatgagtgagtacataccatgtttgtctcttttgtgattgggttacctcactcaggatggtttcttctagttccatccatttgcctgtgaatttcaagattccattgcttttttctgctgagtagtactccgttgtataaatgnnnnnnnnnnnnnnnnnnnnnnnnnnnnnnnnnnnnnnnnnnnnnnctgcaccctactttttaatttcattgtttggtgttttggtggctaccttcttgagctcgtgcatggtgacaggtatggatcaatctgcaattttctgcatgtccgaatccaattgtgccagcaccatttgttgaagatgctatctttttccactgtatagattttgcacctttgtcaaaaataaggtgttcgtaggtgtatgggttaagatctgggtcttcaattcgattccattggtctatatgtctattcttgtgccaataccaagcttttttcagaactatggctctatagtagagcttgaaatcagggatggtgatgacaccagatcttttattgtaaagagttgttttggctatcctggttttttatttttgcatataaagttgagtattgttctttcaatgtctgtgaaaaactgtgttgggtttttgatggggattgcattgaatctgtagattgcttttggtaggattgccatttttactatgttgattctacctatccaagagcatgggagatctttccattttctggtatcttctttaatttctttctttaaagtctcaaagttcttattgtacaggtctttcccttttttggttagtgttaccccaagatattttatgttgcttgtggattttgtgaaaggtaatgtttccatgatttcttcctcattgggttgatcatctgtatacagtagggctacagatttcttttgtgttaattttgtatcctgccacctggctgaaggtgttaatcagctgtaagagtttcctggtaaagtttttcgggtcactaatgtagactatcatgtcatctgcaaatagtgaaagtttgacttcttcctttccaatttgtatccctttgatccccttttcttgtcttattgctctagctagaacttcaagtacaatattgaagaggtatggagagcgtggacatccttgttttgttcctgattttagaggaaaagcttgagtttctctccatttagtttgatgttggctattggtttggtgtatatcgcgtttatcatgtttagatatgttcctgttattcctgttctctccaagatctttatcatgaagggatgttggattttgtcaaaggctttttcagcatctagtgagatgatcatgtggtttttctttttcagtttgtttatatggtggattacattgatgcctttaggagtttcctggtagagttcttcgggtcacttatgtagactatcatgtcatctgcaaacagtgaaagcttgacttcttcctttccaatttgtagtcccttgatctccttttgttgtcttattgctgctctagctagaacttcaaggccgatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctctggatttccacagtgtctgttgttatatcccccttttcgtttctgattttgttaattagtgtgctctctctctgccttttggttagtttggctagaggtttgtctatcttgttgatcttctcaaagaaccaactctttgtttcattgattctttgtactgttttcctagtttctactttattgatttcaactctcaggttgattatttcctgggtctactcctccttggtgagtttgcatcattttgctttagtgctttcagttgttctgtcaattctctaatgtgacttttctccagtttcttcatgtgggcacttagtgctatgaacttccctcttagcactgctttcagagtgtcccataagtttgggtatgttgtgtctgcattctcattagattctaggaagtctttaatttgtttttttatttcttcctcaacccaggaatggtgcaattgggtgttattcattttccaagagtttgcaggttttttgccatttgtattgttgctgaattgtagctttaatgcatggtggtctgataagatacaggggtttatttctattcttttgtaactatggaggtttgctttgttgcctactatgtggtcaagtttagagaaggtgccatgtggggttgagaagaaggtatattctttttgagtttgaatggaattgtctatagatatccgttaacccctgttgggtcataacttggttctgacagtccttaatctctcttttcagcaggattccccacttttagctagatgtttggctgtgggtctcttcatctgtttccatcagttactagttgaaggttctctgaaaacttaattgacaatggattgatctattttctttattatgttaaataataaagtctgaaatttcaatatatgttctggaaaacagctgaagaatagatctccctaagccatggtagctcacagtcctaccaccagaacacatacttcttcaagtagatcatgcctcttggaggagaaaccaatctaatttaattgctttcagatagttgagttttttaggtcttccagagttgtgcatatgtatttgtgcataatggggagggtgttcttactagagcgcacatgtgaaaatgagggggaaaacttgagtgaacctgtttttctccttcccacatgtgggtcctgaagattgaattcagctcatcagactcagcttggtagacacagtcttaactatctgagccatgtctctccccgactccctaaaacaatactactcagtgtgttgatttgctgagttcattgtgaacaacaaattcattttactatgttgaagtccttctaaagcctcatacaaactgtaatgcttgcttactatgtttagaactctgaaaccaaattttgtcccagcaagttttttattaaacttctcaaatatttgagtgttcaagtgacaatgaagtgaaaatataaatcatcttctggcacatgctctttattaactgctacagaatccagtggagagattgacatttcccctagtccctgtcttacatatgcttccattagactaaattccaggttgcatagaatctattactcatgccccagttgatttcttgaatcataaagcagtataatatttggatgccttaattagatgctctcacttactggaagaacaattttagtgcttaaaattagaaacacaacatatagactagaatggatgaatggggaatttgttctttacctgttttgaaatgaaaggaagaacagaatataaaaagatcagcaatactatttcagcccagatacacagaggagggcataggccctccccaaaaagatgtgacagactttgatgattccccatggaagacctcaccgtctttgggcagcaggtggggaggggtcagtggtattaatagggggcattggaagatgggagggagaaggaacgggggattgctatgtaaaattattgtttctttaaaaaaaaagagcgacaaagtgttcccatgaaaattatgttaactctctcgtgtttgctggtattttctgatttataaagtctacaagttttattctaaactgtagagtcaataaatattattagttaaataactgtcttttatatattatatcattacttaaaagcatttaaaaacagctattaatgtgaatccttttcgtatatgcctaagagtggaattgctggatctcaaggtagactgattcccaatttcctgaggaactgccatagtgattttcaaactggctgtgcaagtttgcactcccactggaagtataggagtgttctcctttctccacatcctctcgagaataaactgtcattggtgtttttaacaccaatacaaaatggcatctcagagttgttttgatttgcatttccctgatagttaaagatgttgaacactttcttaagtgtctttcagccattttggattcctttattgagaattctatatttagttctgtaccttattttttaattgggttgtttagtggtttggtgactattgtcttgagttttttgtatagtttggaaatagccctctgtcagttgtggggctggtgaacatcttttcccattctgtgtgctgctgctttgttttgttgactatgtcctttgccttacagaagcttctcagtttcaggagggacaactgttcaactatgttcacagcagcattatttgtaatagccagaacctagaagcaacctagatgcccctcaactgaagaatggataaagaaaatgtggtacaattacacaatggggtactactcagcatgggggggggtggaatttgaaatttgtaggcaaatggatggaactagaagaaaccatcctgagtgaggtaacccattcacaaaaagacaaacatggtatgtattcattcatgtatggatattagacttagagcaaaggatttacagcctacaattcacacctacagaaaagctaggaaacaaagaggaccataagaggggcatacaagttcccccagagaagtggaaagagataagatctcctgagaaaattgggagcatagggggaggaaggtaggaaaaagaggcaggtagaaggggacgggggaggaagacataagggaccaagaagattgatttgggtgaagaaaagggaagagcacaaaaagagataccataatagacggagtcattacaggtttaaagataaatatggcactagagaaatgtccagagatatagtatgatgaccccaataaagaacctaagcaatagtgtaaaggctaccttaaatgcccttcccctataatgggattgattgctaccttatatggcagcatagagccttcatccagtagctgatggaaagagaagcagagactcacagcaaatcaatgaaccaaattcctggaattcagctgtagagagggaggagtgatgagaaaaggggtcaagactatgctggggagaccaacagaaatagcagacttgaacatgggggagctcatggtcctcagcctgacagcttgaaaaccagtacagaagagacacaggcccccctgcatgtgggtgtcagttaggagacctgggcagtctatggggccacacttaatggaatagcatttatagctagtgtattaattgactttgggaggccattctccacagagggatactgtctcagtctagacacatgggggtgggcctaggccctgcactgaattacatgacagactttgatgatcctccacaaaagacctcaccctttctatggagcagaagagggatgggatgggggccctgtggagccatagaggaattggagggagagagaatttggattggtatataaaacaagattgtttctaatttaaataaaaagggaaaaaactaaaaacagttattaaaagaatcatacaattagtttaatgattgaatgttaggcattccagtagtttggaagaatcaatattttcaatttgtttaaatatttttctctaaaatagcaggatacaaattcttattcccattaatattgataattatcaatgtatactgagtagttatattacaaggtatatgtttctttgattttcttaactcgaattaactaatatcaaccaattagcagcttactacagatggaaaacaaattaaaataaaatagaataaattgtgcagctatttttgaaaactatgtgtctctgtgtgtgcctaagtatatgtctgtgtaccatgcttgttcaggaacactcaaagcaaagactaggcacaagatttctgaaaattgagtcacaggagactgtgagcttccatgtgcatgctgagaaccaaacctagaacctcttcatgctcagccagtgctcttaaatactaagtcaactgatctccagtccatcttagatttcttttgccttcgtttctgtttgcattgttgtggatcaaacttcgggcttgcacatactggatagttgttctatgagtaacctacactctcaggccttaatgacttgattagatgatatttaatagattcccagttctttagtgaagtctcagaatataaaccatgaaacaggatcatctacagaaacagtttgttgagagtgaagcaaatgaagtatatgcttgtctttacaatatttattttcaatttaaatggataatttaacctgtcttcttgtatattatatttataaatgagaaaagaggaggcttgatgaggtatgggtgttggtaatgggtatacattgattccatgtatgtagcattcatttttcaaaacatgagatatctaggaatgtgcacaactctactatttatacacagagtttctgctatgactatggagtcatagcaaataatttccctgagttatttcctctgtccatatatctaaatatcttgcatcttgtaaatacacaccacagtcattctagtaccaaatttgaaaaacaaaaaagaataaatgctgaatttttctctttatcacttttatctttccttttggggtatgaaagctttacttaggagaagagaaaaataaaacattctgcctaatgccttagaacttataaaaagaagctaaagtcatttaaaaccctattatatatccatagaacacaacttagtgatgtatttaacgaggagatgatttgggtgtaaagtatatgcagctgagaaattctcctgcccaatgactcactagttacaaaggaaagtatcaaatgtgaatggcagtggcaatagtttttgtcacaagatgtcatttgtatgtcaagatctcaagggatgtgcatattttatttaaatctaaaagggatttaaataaatcagggggacagccacagcattatgttccagaatgtatgtgtgtggggtaaaaaatatcaactacctatttcttggctatcaaacctttattgtaatgcacggatgtgtacatgtatgtgagattgttttatgtagatctgttcctatgtgtcactactggtgcatgtgtgatacatgtgtggaggtcagaggacagccctgggatgttggtctttgccacaaactgtgtttgacatggtgcctttttattccatgttgtatattctgaaaacctgagctatgagcttcaggagtctctggtctctgcctgtcatcttactatagaagtggatggtactttatatgttttcgaggactctgaactcaatccatcacgtgctttgccctttccagagatccatacttggtgctctaaggatgaataaaaagcagctaatgtgtctggagagaaaggcacctgataagaagtgtgaagagagtgagataaggaacaactttggagcctgaacacacagccataaaaaccaccagaactttatttttcctttgattgaggttcaaagccaaatgaagtcctgaactgaagctttgagaagtgaagttaagtgctaggaaattatttttattactacacactgaagagttgatggagttaaagcacataggcagtatactgagcagagttaagtggaagagattagacctaagatatgttttggtatgctgatatagggctggcacagatagtattctcaatggggcagatgtactccatcaacaactggtggggccttctttccttagctgatccagcataacagagactacctgctttctatgcttcttggttttctagaatgtttgcatatatgactttgaacttaagttttggtatttaagtattttggttaaaataattcttaaacactgtatgagtcaccagaactgaatcataaaaatctataaatctttgtgtataggattaagcaatagagcttcttgacatctcttgggcagtgagtgtagaattaccaacattagaaactgtgtcctgtgaattccaaaatctgtgggtcaggggtgtaaggaagtatcagcagatggtggaaaaatgtccacaacctggggagagtggaaagtcataagatgtcagccaggttgttgaatcataaaaagataccaagtctaattccattggtattcaaatcagtagcagtttaaatgaaagagtagagaatatgttggtcagatgtagctaactggcttagataggcgtaaactgggtgggggcatcaatgaatttagtaaattggaagtcattggtaaaataagaatgaattacaatgtgttaagtcagacttgattatgatcagaataaagggatgaagagagagtgtacacaggatgcttccactatcagctaaaacaaactaactgaatgataattagctagaatctagggtgacatgcaatatcatacatgtcacagatatgtgcttgtatcttaataagaggctaaaatgttacaaagaaatagatggaagatatgtagtatctatattttctactagatcctaaaattttcactagaattctatatgtgttgctattcaaaacttttatattacagatctatagcatggtaatgcatcattaaatatttgctgtatcaaagaaaaccacattgggcttatttagattttgtccaatcattcctcctgtgtcctattttttagggcatggtctcctaaagttgactttaggagaacccaacatatttttacactaggttccttgatctgctttggggtaagtttaaagaaaataggaaagggaacaaattaaaaaccaaaccaaaccatacaaacaaataaacaaaaagaaaaccctgaatccttccacaaacaatttcacagaatcctagtgagataaaactttctgcatgctctgacatatatccaaacctcggggactgtctttcctctcccctcattatgttattagaaaatacagtggttgtaattgttagcagcagttggtaaacaattttaaaactgagcctgagggaactaaaattgaagagctaagaaaatgtgatcgaattagaaagagcatggctagacattaacatttgcagagatgaaatgttttctttgtagttagaagagagttgtctggcctgagtatgtcattctttactgaatgtggataatgggaatctgtatttcaaactacagattgtcagttttgcgatatgcacctgatgaaaaaaaaaatggatgaatgaacaaatccattgatctaaatacattgtgatatatttccatatggaactgaagaacaaacatttttcaaagtgagatcataaaggagacatttgagttcacaaaccccaacattaaagtgctctgaaaatgagttatgtttgaaaatgttaattgtatctaacaaatttatgttttccacactgcagttcagacagtgtcatcatatgtagcttcattctttggaactctggattctgtaaggctgtattcttaagattttatctgaattaattgctgtacttgacatttggatatcgaacacagagaggacatttaaagaaaataataaggaaaaaagaacatacatttcacaaacaaggaaaagagatctggggaatatggtcaagctctcttgattttagagagtctagtgagagttgtgtatatacccttcaaacttacaatattaaaataattattcccccgtgggaggactcagcttccctgagaagtggatgggggttgggtgagagccatgggaggttgggagggagagggaactgggattggtatatgaaataatttttaatgcaaataaaattttatttaaaaaatagcagaatgatgggccattaagatggctcagcaaatagaggcatcagcagctatgtctgtgaaactgaacttgaaccaaaagtctcattcttccaagccattctcagatctcatatgtgtccttttcatgtgcaagcacatatgcaaatatttctatattaaaataattgggataccacttacactaatgtctgaggtagaaagaataaaacaattttccttctttgccctgatactaatgttcatttaaagtaaatatgattgttctagaatgacttcatttaagaccttaagaacatctttgaaagaaacactatcagtaaagcttgaattcttcatgaactatgtgggctcttactggcttaatggaacaggacataaagatgttcatgtctacagatactgtgacattagtttaagccaaacaaaaatcaaatataattgatataaaaagaactattctgtcctgtattgaatatgcccagcatattttcttaccattattccataaatagttactgaaaactatatttcttcagcatctatattgtataaggcatcatacaatatctacaaatgttagatataaaggcacacatacatagaccaaatgtcaaaaactacatcattttatagaacagatttcactacctgtcaattttggcatatgtatataccatgcaaccaacactctggatttcactaaatatacacagtgttgcaaactttcctgtgtagaaagtaatcatattaacctagttggaagatctagttgtcctgataagaactctgttcctactaaagggaaatgactttcaaagctcattgaagttgtgaggaaacagaaactcattcttcgttaactgcaaaacattatgatggttctaggattctctatgtaagcaatagcactcactttgttcctacttcaaatgtaagtgatggacaagtttttcccatgttaactcttctacttataaagttgtatataaagaggggagaggaagctacaagagtgagaagggaagaaaaggaaggatgcagaggtcatcaggaagcagaaaggttgactcaggtgtagattagaagaaaggacatatgctaggtaggattttagttggggggtggtagaggagaaagggagggagacgggaactgagatcatcatgtaattcaatcttgtttgtaattcaaatatataaaaaataataaactaaaaaacatgctattttggaccagttcctaaaatttgtttctataactttaaaaataaaccactttcactttactcttgtatattcctcatgtcagctcctggatttttatatataaaactttaggctttgcattatattctttctgggcgcaatgcttgttttgattaggcatctggtttagtaagaagatagaatatagtttaatggtcctataatggattaagatttcttgtacaaggagtcaagaccatgctggggaaacccacagacacagcagacctgagcaagtgggagcacatggacacaagtcttacagctggggaaccaacataggactgaaccagcgcccctgaacatgggtgtcagctaggaagcctgggtagtctacagggcttctctcagtggaaccagtatttatcttagtccatgaatagacttcgggagtccattcctcatggagggacactatcttagcctagatacatgggggacggcctaagccctgccctaaatgatgaggtaacagaatttgatgatccctcattgaagggttcaccctccctggagagtagatgggggatgggatggggagttattggggggggatgggagaatgggagggacagggaacttggattttttctattttaaaagatttcttgtatacaatggagaatattttcagtgatatgtatttcacagagaaagctccaaataaaaacttctttcactattgaaagatgtgtgtaaagctagtgaacaattggacaaaaatgacacatacaccacacacacacacacacacacacacacacacatgcacacacacacacacacacacacacacacacatgcacacacacacacacaacacacacacacacacacacacacaatgctgtatttgaacattggcttgttgtcttttgctcaaatattatggtttccaattgtgtgttcatgttgagttttgggggatttctgtttgagtttggggggatttttttttttttttggtttgttgttcttgtttgcttgtttttttgttaaaagaaaagaaagaacagacatggagttggatgggtgagtatgtggagaggagtatgtggagagtatgtggcaggagttggggagggaaaagcataatcagaatatattgtgtgaaatgaaaaacatgcaaacaaacaaacaaacaaatcacccttgtgcttagttacaaagttaggaatttttcacaggaaaggatatttacattttggctaccacacaagagaagccaatattctattggcagtgctaatttgcagttgtccttttatgctcttaatacatttatgctcagctactttcaaagactcacacaacaatttgggttctgtgtcatcctcatccaataaaacaaagggaatgctctgtctcaatgaaatgtcaagcaaatgtatagcacaatttgctgagacagatggagaaaataatttcattttgtttatgacatccattaaatttctttaaaatggatgtttgtccagtaagaaactcaaattagctgggctatatatctgacttgagtaacaggtttattaaggcaaaaatgaaactgaagggcccattccatccaagatgacaaaggaacagaaagctaaaatgtttccataccaaactacaaataaagaagagcaaaactgaaagaactgaactcaaatctaacaatcatgagctacattaatatatttcctgcatggattgtgcagaaatttcaaaatcatctatctgggcacaacacctgctcacaggccagtgtctgaagtaagttgaacacatctgtggggattttagatgaaatgaaggctgtctcaatataagaaacaagtgaccttcaggaaatagtctcctgtgccaattcattcaagggtacttcccattttctcttctaagaggttcagtgtggctggatttatgttgaggtctttgatccatttggacttaagttttgtgcatggtgatagatatggatctatctgcagtcttctacatgtcagtatccagttatgccagcacaatttgttgaagatgctttcttttttccattgtataattttagcttctttgtcaaaaatcaggtgttcatagatgtgtgaattaatatcaggatcttcaattcaattcctttgctctacctgtttgtttttgtgccaatacaagttgttttcactactatagctctgtagtagagtttgaggtcagggatggtgatgtctcctgaagttactttattgtgcaggattgcattgactatcatgggtaatttttgttttcaatataaagttaagtattttctcaaggtctgtgaagaattgtgttgggattttgatgggggttgcattgaatctgtaaattgcttttggtgagactgccattttgttatgttgatcctacctatataagaccaggggagatctttccattttctgatatcttctttaatttttttctttaaagtcttaaagttcttgtcatacaagtctttcactgcttcggttagagttccccaagatatttttatcttgtgtgttgctattatgaagggtgaagtttctctgatttctttctcagaccatttatcatctataaataggagggatactgactcttttttagttaatcttgtgtcctatttggtctaggaattatagatttgtaaagatgtattctccagctagtattcctttgtgaatttagagaaacactgttttgaattcataaaataggcattttctttttgtctctgaatgccttatcctaaacaccctgctaagttataaaaataatcacaaatttacttgagaagtgttcacaaggaagagggtcttatgtatattacttgtaattcaagaagttcaataaatacccttcttgacaataccagatacagttacatactgcaggaggttgcttattttgttggattgctatgaacaaagtgtattcatgttttaaagtgtttttgatgtccagttcttagtaataataatatccaataggaaatggcaagtaccacttatgcattaattttgggaatttaaagatggcatgatcatgtattattcctggcatctattgacctgaggatagcatggatgagatgttcaggaattttcctcctattatttcttccagaaagaggaattctcagagtttaatgtttaaaagttaaaaatacattatttgttgaaattattttacatctcttgaaatattattgtttttcaacaattcatgaaagtatcttttatatctctataaaatataatgatcaagtgttataacctttacacttaaatttaattcaatgtatctatattctaaggtaaagaataatgaatttgatatatttgagaacgaaaacatgggcatttgatacatggctatggctttctggaaggatcaatgcaattcctttttatattgatgatgatgttgagacaaggtgctttaactatttctctttaaccctcgacttatggtgagtaatcatggtgttattcacatacatctttctggggagtcaagagtgggataccagcatatgaataaagaagtagggaatgaagacttctcagcatcctggggagcttttccattggttaagtcatcaatggatgaatcctcactagttttaataaattctaagcatggaggctacccatggattaatcatgattctaagattaattcttagttcaatatttggcaaattaagaatttgaacatgataagaataatatgtaaacatcatgttaattcaaattgagtctttcttttttttttccagatgagacaatgcaagtattaacaggcaagatgagttttcctaaagaaattgttagaattggctttgctggattctgagaatgctttatcttcaagaaactgttggtcatttcatcagctttctgacctagctcagtggtagtgtatttgcttaggatgcagaaagccatgcttttaatccccagaatgaaacataccctctcacacatactttctcagtttttctgcttccctctctctcaaacacacaaatggtaataatggcaatagatggcacattttagtatatgttctgccaaagtgagcacagatgccatttttaaaaaatagaattgtttaagtagctatgagagtgaggagcaagaaaataaaagaaactaaaagccaatgttctttatatacaaacatacaaaaattttacccataagcacactttcatttacattttattcatcatgtcaattaataattcaatctacacacactgtacatagatgttagagaaacaaacctgaacataaaatatagaatatgtcacctcagataacatctttctgacatccattttttttgtcctttgtgtcaccttaatatcagttatgtacctttctaataatatttaagagaagaaaagactataatctagtcaatggacagagatgaagaagttgagtaaggaaggaggccactcttgacagatgtaagaagaggaagtgcctgaagataaaaatgactagatgtttctgggaagaccaggtgattcaatcactcattattcaataaatactgctgacctctagtttctgggaactctttttgattttggactctcaagattataagattatgtttgcatttcttcagaaatttactatctatacattttagaagaccattataatttgtagcatttcccagacacaaaggtatctctgccagctttcacttacagtttatcatgctgtgttagggacacacatcagtgcagaaggtttgtaatagctgaacttggactaaattctaccttgcagctcttttatcatgaataaaataaacatatctgaaaacatttcacattttaaactcttccacagagactatagggaagcaaagggactttcttgcaccaaaaacaaccttatcaaaacatacacatgtatttttaatctactgaggtggtaacaagttatcaacttaataaaaaagacggaagtttattacttattattttgtaggtcacaagactaaaatagatattaaatcacaagagctggctgtatgtctacttttctgattaatatgaaagatttttttctcacttgatttgtcattctgttgtggaggtcaaacttcttctaataccattttgtctattagtattctgatcccctggtcttcatttataagaaagattttattgtattgtgtccatagaattaatccaggataattcctcaggatctttagccatatctacaaagctccttttaccattagcataatatgttcacaaattctctcaattgggatgtgaacatttgcatgtcaattattcaaccaattataatcttctatgtgctccagagattcataactggcttatttgcaaaactcaattatcatatcccccaaatttttaactctgtagcactgtcatcttaatatcatcactgtaaggtctcaaatcacagcacctaaatgaatcaagataaggcttacaatgattctcgggaaattttcatttcttcctcagacttgtgaaattggaacataagttagcataggtgaaaaaaattgtattatctagaatgaatggactaccaggtatagaaatggtcattcttattatcaaagtaatctctagtctcagataacttttaaaatcaaacagggtaaattctaggaggtttaaaatcctagaaatttccatttcaaatctttcttttctgggtctgccctttggtttttgtctcttccctatagggaattctttgtcagaaaaacataagggcaaaaatatttgcagacaaatagttttatcagcctctttccacgaccatagatatttggacatcaatagatttcttatgcttaatgtcttttctgatcctttatgtgcatcatgtatttagtttccatgatattatcaaagcatagtggatcttctgtgtgtattgcaggaactcatccattagttgtatagttttagaccttttctaaatgaaatgagaacattttttcttgcctttttgagattctggagcttggcttcattattcacttctggttctctttctcagtattcaacaatgactagttaaatcttccccaaaatatgtcatagtgatgctgacttcatcttcaagtctttttttgtctctgattcttctttgtcttgtacatttaaggttctctgagaattcattgaacctacctaaattatcacaaatactatccttaatgcattataggctagcaaatagccataattccaactgctaccttaattatccctttttatgttacatcatatttagtgtgttttcttagtgttgtgatgtggacatccatggcagatggtttttcctttctagcatgctgttaactctcagcaggccatgaagtacaattttaatttactttcagggacttctcagttcactgtttgttgcatgttgtaaatacaaatgtacgcacactgagttggaagaagtaggtaagaaggtaacagatttctgaaaaaaatgtaaattggtatatcacaagacaatgaaacttttcttcagtgtaaaaatactgttacctacacttcatgcttattctctaaagtaaactcttgctcttcagactttgacacattgctggtagaaagatgctccagggtagccattgctgatactaaatcaacatcatctgaaaaaattttgtgttttatgataaaagtatgctctatgataaaagaatttctgcttaaagaacacagaacaaataaattcatatgctaattaataaaggtttcatgcaagggtatttctcatgctgcagtttatgtggttgggagctacaggaaggctggattgttagcatgaatagtggagggatggaaatgagataaataatgatgcaaacagaaaaaaaaactgagaaagaattaagaaaaatgatctttgacaaaggtgagttaacatagagccaagcaaaacttattaccatagattgtaatttccatagacacataaataaatcaatgtatattttcaagataatatttagaagactcataataaacacattaaatcagttttcttttcaacacatcatttgacaagattgaatttgacatatggagcacctgaattttgaaaacctattggcaagggaaaaggaaggaatggggaaagaaaaataagaacaaaaagtaaataatttctaagtaaaatggatttaagggtatagcaaatgaaagccattttaagtaaagtgaaatggatttgaaattatagattaggggctgttgagagagttcaattgttaagagcattttgctcttgcataggactggccttcatttccctccatgcataccaggaagatccaggattcccaatgctggtcagtgtcaacacacaaagacacatacacacatacacacacacacacacacacacaccacacaccacacacacacacacacacacacacacacacacacacagactcagacaaagcaagaggtctggagggggatgaatgaagagaaaggaatataataaaatttaaatattaaaaaattagtgtcttttgagattgtaatttaatcttatccctctttgtcttcccccttccaaacctttgtatatacccttccttgctcaatttcaaaaatacatcatatataagtatgtataatataggcaagaggaaagcaactgtgtggtgttgaaatatgttttctcttacaaaatatcaaatgctgtatagtcttatatgactttattcctataaatttttcttcacttgaaattagtttcaaatttgtatgtgctataatatatcatttttctttgggtctgttttcaagtctattttataaaccaaatcagaaggtgaggcagaagcaatatattggctgtagctcacagagtacagtcacagacagaagagagactactgatttacataagcttacttatgatttttgatagtggattcaggcaggtcatcgggatactgccagtcaaattcagggaccacttaattttgcctccatgtattattaaaataccattttatgttagcatagtgcctcagagtaccagctctgtagcacaaataataaaagcccagagacagatattgggtttcaagctgaaaatcagaaaagcaaaacagccaaaccactggagagtccttacatctgccaagactcagaataaagtggtagcaatgctgtcctccgagtgactgtagacactctacagaatgctcactgtcaaaatcatactgaccagaggctgtactgagctcctgtcttatattcctctctagtgctgggattaaaggagtgtatcacaaatgctaagatcaaagttgtgagctctgtttctcttttacactgattcattctcttgtagaacaaggtggccttgaattacagatattcatctgcttctgtctcatgagtgctgggattaaagttgtggtccccactccctgaactttatggctaagtagttgtttaggtatgtgactaaatagtggcttagtgtgtatgtgactaactagtagcttagctctaactaggtgtgtggataaccagtggcttagctctgcactctgatcttcaggcaagctttatttattagattacaaagaaaatgccactacacatctctgtgaaaactttgtccttattcatcagcaatgatttaaccttaattaaatcaactatgctcttaccacaactcttatggatatttttatcagttctgaaaatcagcaattattattttaagtttttcctagtaactctcacttgtttacatattaaggttttgaattttataattgataatgattgctttaattttaacaactgggaagaactttgctatgaacagtactagttcctagataggtgactaggttaatatcagatttaacaaaggagaaaaatggtgagaaagaatccaggaattcaatgaaaagttttgaaagattatttacctataccataaagaatcaacatacctaattccaacctacacatcatagctacatataaatacctatttcccaaatatgatgacattgaatataaattaattcagtatcagtttctacaaataataaaaaaaattgaagcataattttaaaacctctatttgtttcatcctacttgatgggggaagtacttttgtgtatatgtttgtcttattggttgataaataagcacttttggccaattgggaaccaagttaggtggggctaggagttgatgcagtttctgggaaatgtggtaaagaggaaagtcatcatgtgatccaggggaagagaggatgtatgctgctggcgacatcgataagtctttataaaatatatagattaatggttatggttgatacttaacacagagctagcaaataaggaatactagtcattggccagcagcattgtaactaatattaatctctgtgtgttatttggggaccctaatatggtggcagaactcaggtggctgacagaaatagttatcgttacacctaatatgttctcatacttcagtattttaaaaaataattattttcattgagacttcttcctgatgaattttttctgtgattaatatgaaatgaccttcttcatctattttgattgattttggtttgaagtctaacttgttagatacttggaatatcttatccggaccctttactctgtgataatgtctgtctttgaatttgaggtgtgtttcttatatgcagcagaaggatggattctgtcttctcatccaatctgttagcctgtgtctttttataggcaagttaagaccattaatattgaggggttagttcaatatacataaatccatcaatgtaatccaacatataaatagactgagaataaaaccacataatcatctcactagatgccaaaaatgcctttgacaaaatccaacaccccttcatgataacggtcttggagaaatcagggataacaggaacatacctcaacataataaaaacaatatacagcaagccaacagccaacatcaaattaaatggagagaaactcaatccaattcctataaaatctgggacaagacaaggctgtccactctctccataacttgtccttgaagttctagcttgagcaataagacaataaaaggagatcaaaggaattacaaattggaaaggaagaagtcaaactctcactatttgcagatgatatgatagtctacattagtgacccgaaaaactctaccagagaactcctacagctgataaacaacttcagcaaagtgacaagatacaagattaactcaaaaaaaaaaaaaaatcgtagccctactatatactgctgacacattggtggagaaagaaatctgagaagcatcacactttacaattgccacaaacaacataaaatacctcggagtaacactaaccaaaaaagtgaaagacctgtaccataagaattttgagtctctaaagaaataaattaaagaagataccagaaaatggatagatctcccatgctcttggataggtaggaacaacagtaaaaatggcaatcttgccaaaagcaatctacagattcaatgcaatccccatcaaaatcccaacacaattcctcacagaccttgaaagaacaattctcaactttatatggagaaacaaaagaaccaggatagccaaaacaaccctatataataaaggaacttctggaggcatcaccatccctgacttcaagctctattacagagctatagtcttgaaaacagattggtattggcacaaaaatagacagatagaccaatggaatagagttgaaaaccctgatattaacccacagacctatgaacacctgatttttgacaacaatccaaatttatataatggaacaaagagaacatcttcaacaaatggtgctggtataactggttgcagatatgtagaagactgcagatagacccaagtatatcgccttgcacaaaacttaagtcaaaatggatcaaagacctcaacctaaatccagctacactgaatctattagaagataaattgggaaataaccttgaattacttggtgcagaagaccacttcctgaacattacaccagtagcagagacactgagatcaacaattgataaatgggacctcctgaaactgcgaagcttctgtaaggcaaaggacacagtcagcaagataaaaatggcagccgacaagctgggaaaagatattcaccaaccctacatctgacagagggctgatctccaaaatatacaaagaactcaagaagctagtctccaaaacaacaaacaatctgattaaaatgtggggtacagaactaaatagacaattctcaatagaggaatccaaaatggctgaaagacacataaggaagtattccacatccttagccatcagggaaatgcaaaacaacataactccaagataagatcttactctgggggggaccaaataattctcatatgaaatattttcgggcccagcctccagcttcagcaaacaggggcactggaaagctccggcccactattgtattgttcattgccagtagggctactattgtttaccatggcctcagggtaatatgcctcctatttgcatctctgtgggcctaagcatctgaataggcctgcacctgtgcaaaggtgtgatgtgtgtgagtaactaggaatgacaggagttaggggccaggaccagaggagagatgagaacaaagagagaaatggttccctcttggtattggcacaatggttaagaaacagcagaaaagatggctaataaagaaatgactctagttctacaacatggaactgagagcactctaaagatagcaagatgcctgtgtttgatctttatcactgctgggttactagcagtttccaggtccacgaacccccactcaggcagaacctcatggattaaagctgagacatcatgggacatgacattactcctgtcagaatggccaaaaaaaaaaaaaaatcaccaatgacagttcatgctggagaggatgtggagaaaggggaacaatttccactgtggtgggagtgccaacttgtacagtcactttggaaatcagtatggtgactcctcaagaaaatgtgaatcagtctaccaaagatccagcaattccactcttaggcatataccggaaagtagtgccggccagcagggctctggtaatttgtgggtcagaggtggaccaggcctgaaaataatgggcgagaaagaagaagccagaccaagcagtgtccttgtcaaggtctaaattttattgataacaaggggtttttaaagagaaaggaggaagcagagaaagaggtagtggggagaggaatgaatattaattgctctcaggccagggcaggtgtctggaacctcctgtggttatctcaaacactaacctaggggggggggtgcttgactaattggcagtttagcaaggaggtcgccagcctctgtaaagaaggactttttatatctgaccagagctggctcctgacaaagaagcacattcatacaacaaggacatctgttcaatgatgttcatagcagcactatttgtaatagccagaaactggaagcagcctagatgcccctcaactgaaaaatggatagagaaaatgtagtacatttacacaatggagtactactcagtgggaataaaaacaatgggatcttgaaatttgcagggaaatggatggaactagaagaaaccattctgagcgaagtaacccaatcacaaaaagtcaaacatgatatgtactcactcatatgtggattttagacatagagtaaaggattaccagcctacaatccacacttccagagaagctattaacatggaggaccctaagagagccatacatgttcccctggagaaggggaaagggtcaagatcccctgagcaatttgggtgcacgggtagagtgggaagggagctaggagaatgagaggggagaaaaggagggatgtagaggacatgagggagcaaaaaggttgagtcaggggaagaatagataataacaagaatggaaataccataatagagggaggcattttaggtttacagagaaatcaggcactagggaaatttctggagatctacaaaaatgaactagctaacaatctaagcaacagaggagaggctaccttaaatgccctcccaggataatgagattgatgactgagggagaagggatctgtgattgtcatgtaaaaaaattcctgtttctaagtcaaattttaaaaatctgaaaaaaacataattattttctttttaaaatacttgtagtggttaattggttaaggatatatagtttttgcttttcagtgagatatattactaattctggattaggaaggaatttttagctcctagtttatactctatatttgattggtttcataaaatttataaaatatctcattttaacatctattgtgtgtgtgtgtgtgtgtgtatgtgtgtgtgtgtgtgtgtgtgtgaatgcttatgtgtttgcacacatgctgaggtccctggtcaacatgctgcggtcactggttaatatgctgaggtcactggtcaatattgggtgacttccttaattgcttgccacatgctctttgaaggtagagtctttcactgaatttggagttcttattttaactctactggtgcccagtcagctctattgatctgcctgtctcctttcctgatacagggtttcagatgtataccaccttgcagcacttttacatggcttctgtggattccagatcaggtcttcattattgtgtaacatatactgtatatgtatatgtatatgtatatgtatatgtatatgtatatgtatatgaatatgtatatgtatatgtatatgtgggctctgcaaagtccaccaaatcttcctgtgctggtcctgggcccttccccaatactgtactatctcttttccctctagttttactctattttccatataccttaccaatgtcacagacccctgaaagtgagactattcttataacatggtttctaagataatgttcatctccagtttgcatatgatcttgttgaaaagaaggggcttcatttgatgactccttggatactttcattttaaggattatagtgttgttaggaatggaaagctttgtaagtacaaaataaactttttgtttgtttctgcataaagcactatcatctctggaaagaattgccatccagggattctaagcaaacacagctgggctgctaaagcaacaattagtaagagtatgcaggaaagataaatttgacccagatcaaagacgcctctgctttggccttctaatatttgaagtgtgctttgtacctaataaccagagggcctttgggggactgcctttaatttacttttatatgtggtagaaatagatcctttggtttgcagttggtgactgtgtcatttgaaaaaacattttaaaaactgaaatcattttccatggcaaatggcaaatcattttccatagaggggcttttgttttatgcctcctgaaaacttcaactcatgttcacaagcttttgtagcatgcactgtaccccttgcacacttcctcatgctcacaaatgtaagccccctccctggcgcctggcatgttgtgggttatttgacagatggaaaaatggtgtgtgttttagtcaaaagggactgattaataaagtaataaaccaggatttaattatgagtctttctctcaaggttgtgttcattccaattttccctgtagcttctgatgctcagaaggacactgttgacttttgcagaatttcatgacatgtctagtcaagtgtgaaacaatcacagtacataggcgtatttacttagaactcaagtagactaaacctgaagctgactgtctgtctgctactttccttcccattatccaccctcatgtcaaaaggtgcatttagcatgactccttattcttcccttccaagttaaccagaattttgtatatgccctcatgttccatctagtgttttgatgcacctattaaatcattaggaaagttttttttctttttttaaaatttatttattagttctagttagggaacaagcttgtttcaagtcccttctccctctccctcctgtcacccccaaccctcctcccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacagcatctggggtccatgtgctctcccttgtgggtttctccaacctggtacagagcccttcgatcttcattcctccctctcttcaactaaattcccgatttcggctcagtgtatatctgtagatgtctgtctctgcttccatcagccactgggtgaaggctctaggatggcataaagagaagtcatcaatctcattctaggggaagggcttttgggttatcctctccaccattgcctggattgccagatgtgtcatccttgtaggtctctggagatctccctggttccagatttcttcttggacctatagtggctctctctgatatggtatctctcatcctgctctctttcctctattcttcccccaactcaatatttctgcccctccctttcctctcttctactcctcttctcttgctcttattgtagcagctcctccccccctaccctcatgcccccaattagttcaggagttcatgctattagtaaagctcttatatgttgtttttcctactcctgtcttgattgtgacaatttctttacctatccctttagatacttttagatggccaaatttgtgatgacacaagatataaaatgtttgtagaatcctatagtaaggaagcagaataaacaccttctgtgctctcatctttctgctaggctaatcatgggtttagtttgctcagagaaagatttggaaggtacagttgagatccctaaacaggcagtaatatgaatccttagagaatgttctaagtggttagtgcagaatagttctgaatttttttgttttgatggatttgtgaaatggtaactcatattaagagttctgattccatttgctttagcattctttgtggaaaaggaaggtaatggtaaaacataaaaaatccaatgtaatcatctcattatgactattaaggaagacaataagtgaacattataatcctccatgttctaccatagactactaatgtcttttttgtttctgtcacttcatgaagctatctttggaatagtatgctattgctatgacattaaggtgccatagaagtatggttttagagtgtgccattgaaagtatgtttgagtttccttaaaatactcatgccctttgagtcttaggatcccagggttaatgtaggaaacacattgtcctacctattttccctgcttaattaaggataggcattggatattggccatcagtatgtcctgctaaagggcccgctctgttgaataaatcacattaataagacccacacaggtgttcaggagggaaagatgcaacactttcctatcttactaacatctttccccccttggccttgggacattacagtacttgttattgttgtggcagctgccataaggttatgcaagactgaagtcctggagtcttgggcctccaattttacttcctctgtaggttctagttgttaaaaactacaacctaaaaggaatttttaaatatttagttgcacaagaatttagctgtgggcttgctgtatatttagtttatcatgttgatatgtgttccatgtattcttggattctctaggactttttatcatgaaggatgtcagatttcattaaagatcccttgttattctacccaggtgctcagatagtttccatcttctagtctatttgtatggtatattatgtttattaatgtacatatgttgaaccattcatgtatctctgagatatagcttgcttgttaatgttgaataattttttgataggttcttaatttttttatacacatgcctagaaatctatcaattatgaagtctgtctgtgtatttgtctactttgggcattgccattctatgtgttaagtaggataatagaaaaaattatcacattgtatatcggttgcatatttggaagaaagatattgacatataaatttaaaaatgaaatgcaaaattatttgatgtagacaaaaactgtaggcatttcagacagtctgagctgaagttacaggttagtaaggttaggcaatgtttgaactggatatttactcatgtatgcaaatataatgaataagattttagtctgtctgaaatcattttattagaaagagtggtttcttgtctgacattttcagattcttgcttcctaatcccaattaatagtttttttccttcttatccaaattgtgacacatgccatctgtctgacactcagaggtgattctacaacctagcaatttcagagaagttttgactaaatgagtggggctttggaagtttgactatagtgagatttggtgccctagttacctttaatagtcatcttgacacagcctacaggcatctgagagaagagtttttattcctcaattaaggattgtctagatcatattggcctgaccatgttgttgggggactgtgatgtttattaattgatattggagggttcatcctactcttgacgataccatctttatgcatctggacctgggtagtataggaaggctaagctaagcaaaagcaagtcagtttttgagccatccctccaaagttcctgctgtatttctcagcagcgagtgaactacctagttagaggtgatgttctgtgaaatagcaagcagtcatactttcaggttcctgcatgagttcctgtcttgatttatttcagtcacatactgtgacctggaagtgtaagccaaataaatccatttctctccatagttatgacagaaaggaaaatagagcacctgggtttaagggatggccaggttattcaccatcataatgctgaagtggcactctctttctcaagtcccttagcacaatctgctttgcatatttagccctttttcttcagagtcaagatcttttttgcaaatattctaatgaagtatcccattaacacatggattctttactgattatccgtctaatggaacaaaagatgaagctttcttcaatcacttattgtgacaatattttttgtcaatcaaagttctgtatttcattttttctatttctcagtttgctgtattatttcagcatactgcatagcaaacaagcaatactcctttatcccctaagagtgccatatcacagttgcattttcctgtgtattgagctttctgttcctgccatgactttcaagaggtacaaatttccccatacatgcagtagttagagcttcatacttggagaactggtgaaatttactgagaatgtccataacttaattaattttggagacaatcttcagagacagaaatagaggcctgtagcatcagtgcatcttaaagcaagcagagtcagaggagagacactggcattacatttcccccctagtccttatagactttcagtgcatattccttgatactcagtaaataaaatatacattaagcagaactcccaacaagttatttgtataaataaattagaaggaagtatcaattcataacaaaatacaattttaaaaattacaggagagtaactaattataaagatgattcagagagcaaaccctagatgaataatcctttaaactccagtgaccagataaatttataatttatgagctttccatgaggttaaaaattaggaaggatttagtacagctgctaatatggtaaaggtactatcttgaaattccaaatggtattcttttttttctggctgctcaaatgacatttaggatttctctactgccaaatacttgtaacctcttctttatgttttattataattctgtaaatggcaccgctctcttattttgcctctgcctcatatatatgaaggaaagcctcatgccttgtgggtctttttatttaacctcttccaaagaaatgacatctttggtgtttgcccagtagaatagccatagagggtgtggagggtgaaggaggactgagctccagctgtcagtaattctcaggaaaggatatttaaggagcacataagaaagctggagtggccaacttcagaatgaggtctacagttttcttcaaatgctggcctcctccacttacagtggagacatcatacctcagattagcttttacttttagtgtgtgtgtgtgtgtatgtgtgtgtgtgtgtgtgtgtgtgtgtgtgtgtcttgccaccatgatgtttgtatactacatatcgagccaggaaccttctagcagatcaaccactgatcttaaccactgagcaatctctccagtcccatgattagtttttaaagagaagcttcatgtaatgaggcttatccttactttaactagagggcaaaaaatattctttcactgcattttataatattatttaagccattcgcaggacaatcacaaggctctcttttcattgtttgaggcaaggaaggttaggccaaactctttgatattttactgaatacaatacaggattttaagattttttattactattacttattgattgattaagatgggtctgttctaaatgccctggttcttctcagacccatggttctcccacctcggtgtcctgagcaccaagattgtagacatataacaccatgctggattgaagatgttctagaatagatttgattctagaataggaagtgttttgaaaatgaatggcttttaaacatatgatctgttcaattatttaaagatcccaaataaaacaaacatccgatggcaaaacataaacttactgtgtttggtactcatgaagaacacatccacctctctctctctctctctctctctctctctctctctctctctatctctgtgtgtgtgtggggtggtggtgtgggtgtgtacttatactttacaatactgtgtaggaagatcaaactatgaaagaagacactccaaatatccttccaaccctaatatttcttgatatttgaatgatctgttcaaattaaacaaactaaaatattcaatggtgatatttcaaaagatattatatgacaaagtaggggcttaatgtcaccaacaaattgggaaaaggtcatcaattactttaaaggtcacttcaaaagtgattctaaagatatattcaaagtaatatctcagactctaatgttaaaaaatggatcaatttcaacttataatttaattgaacctgaaaacatatactttcaagaaaacaatacttataaataagattattttttcttctgattttattaatttaggggaggatatcatcatatatggccagtatgtgtatgttctctttttgtgtaaaagttataaacagtggattacacagcaccatttacagggaaaatataactatggaacgataaacaattatattcgagtgacttggattaattaattaattcatttattttacattccagccactgtttcccttccatcttctcctccaagccccttctctccagacccccttttgtttccaacccccaatacactccccttctgttagttgattctgtgatttttcttgtggtgaccttgaaccctctggctcttacaattctttattcacctcttcaacaggattccccaagctccacctaatgtttggctgtgggattgcatctgtttccatcagttgctgaatgaaacctctctgacaccaatctgtatgtatagaagaataatgttaggcatcattatattgacctttttgacccctccagttatgtttagttctaccctaggtctctggtttatcaagcctgtgggttgtggtgctccaggcagtatcagcagtggacttactctcctggcaaatgttttaggctagacctatcattggttagctactccctgagtatctaggtcacccttaccccagaatatctcataggcaggacagactataggttgaaggttatatttctgggttgttttcctactccatccaattgaagtcttgcctggtcacaggagatggccagttcgagcaacttatccattattactagaggtcttaggtggttttatccttgtagtttcctgggtgattgccttgtgccaagtttttacctgaccctgtaaccacctgcccctttcctgatcacacatgtttttatttgaccctgtaatgccattcccttttctagtagtttctttcagtattctcctgctccatcctcccccacaaacctgattactcatgtttcaatccccatacaacagcaacagttcactcagaaaatctcttccatttccccttcccagggagatccaactgttcccccttgaacactccttcttaagtagtctttcttggtatatggattatagcataattattcttcattttacatttaataaccctttaggagtgagtacatataatgattgtctttctgggtatgggttacctcactcaggatgacttgattcttgttccatccattttccttcaaatttcctggtgcccacctttttaacagttgagtaatactccactgtataaatgtaccatattttctttatccatttcttgtttgagaaacatgggttttttttccaggttctggctattacaaataaagccactcagaatgggataagatcttcaaaaacccaatatccaaaagaatgaatttcaaaatgtatgaagaagtcaagaaactcgacatcagcaaaccaaatgacccaattaaaaatggggtacagatttaaacagaattctcaacagaataccatcaaatgtctgagaaacacttaaggagatgttcaacaaccttaggtcgcatgagccatgtgatttctttggggagcaaggcctgaaaatagctttaatgtctctcagggtggaagaccctggagcccctgacccagttggtaaagacctatggacaattttctgcataattctggccatgactctggaagcatatgtgctaccttctctccttgttattaccatattgctggcctgaatgagccatagagggtcatcaagtttattattagacatttgcattactgttctgaaaagaatgtttttagacactagagtatatgagaaatgttattaaatagctggtttttaataataggagttaattggagcagtctatgaagaagtaatgaaacagaattatagaaacctagagttccctgttttctaataactgtgccaataccctaagaaattatgagagacagacatgagaacaagggatatacactgacaactattaagagtaagtttcctagttgtgttgcttataggataaaaagacaaacctcatatttccccggaagaaacagagtagtacagaatgtagaatgaattgatccagctttggctggtgagttgattgtgagaacccagaccctaccagatattaaccactagaggcaaagctctctttcaccatgcatgacactgtaactgcataagtatatgtagttctacctgtaggtgtgcctagttagaaaaattccttggtgctttgcatcactgcctctactcctaacagtagatcaaatggctaccagtgggaaagttgggaaagaaccaaagtaacaaactggtaactattgtaaccattttattttatttttttttagtaacttgggaaggaaaattgattgtaaaactgttcattcaaaccattaaagctacataaataaaaacatcccaggatgtctggaagacacttgtttgaattacaacaagtggtcacaatttctccatggcaccaacttttcacatccataccaggtcattgtacccttctggagcaaggcttacagcacttggctacgatggaattgcaaatcaaggggactctgagattttatcttatatctgtcagaattgctaagttcaaaaacacaagtgatagctcatcctgaagaggttgtggaatgaagggaggattcttgcattgctggtaagagtgcaaccttgtacagctactttggaagtcagtgtggtggtttatcagaaaactaggaatcaatttaccaaaagaccccgctatactactcttgggcatatatccaaaagatgctcaatcatatcacaagggcacttgctcagactcacattttcaaatcactgtacttaaataatgttaccttctatttcttctaattctatttaatttttaagttgttttgcaattacaaatctatgccaacagaaagttatcataaattaaagtgtgttcacttgacaaatcctgtgagagataccttgggtgaatggtttattagactttttgtgctttactcattacaaaataaccaaatcaactgccttgataaacctccaacattgaattaaaaaaaaatgctgtgttactttcagtatatgaaaagcattcactttgtggtgcactgagtttcattttctctctgccttttccccagtgttgtttatatggctgagtgtgctgttttgattgttgtttactaatgacaagtatatgcttacttggcctaggtgaggcttttaattcactataacatttctggtttggaattccccaggatataaatcaatatcctaactatatttggattgtttgacagaacatgctttttcaaatgctcaaatccttatttaagatgatctcatgcatgttccttttgtaatgtgaaggatttcacagaaaaccacttgttgacagtattgcagtatggcatcattactgggtcaggacaagaagagttcacatgtgcaaactgctagcatttccatgttgtgggtgggagggagcacagatttcagaagatggagcctcatttgtctcacaataaaccttgaaagttacttgaggtttaggttgatttttcaaattaattggtatttggaagttgtttttgttatgacagctagaagaaattgagtttgaaaatataagaatttgaaaacatgaacacttccaaattatgtcagcattaaatgtatactaacaatgtctaactggttatactacaaaaagaaacattaaaatgacacagttgatcaacaattaaaatccacagttgattgatacgtgatcacacatattgatcctttatgatgaatgactctaggaaactaatgcacatttaaactaaccttctgtggacagttatgttttgtcttattcagacattttataggaatcagcacatgcagatatatgagcctcacatgcagaattttgcattttaatgtatgttactttgacaacaacactgacagctgagagggagtctcatatatcttttcttttacattatgtatttgttatgcttatttggccactcactgagtctcactattgctgccaatatgctcatgagtttgaagctaagtgtttattaacaatactttgtttattttatgcatagaattttttaatctcaagtatgtgtgtactagtaatgacagtacaactgtttgataggaactttctttaactatgaagaagagacaaggttcccacagaggtatagaatatttccagtcctaggatttttgtttatttcaagtatgcaattaacccccaatctctttaaaaccacatacagcaatttcaggtctctcctgaagtattttccaccacattatctgaattctaaataaattactttgtttcaatgtaatatctcactgtaatgctttaggatacacttattatgatacacaggcatgtctcttttagcctttacgtcttttgtcacttcgttctagaaagtccaaaaaataggtccctgttaggtcaatctcacaaggccccaacctagatgaagagtgataggcaactgatgactgctgagaaagaaaaataggttttaacaaggaggagtcacttaattgcttatccagggtttatgccggcaaagaaaacaaaagtcataaaatttaacccaggaaacaaaggaagtaattattctcttttggagatgcctaattcattttgacacttctcatatcttgttgatctgtggaagttattctgtgtgctgggataggaataaaggccagtggggaaaaggtttttagaaacaacagacatcttggaatctgaatgattatcatttatgttattgtatatgctagctgactttgtacatttccaatggtattttagtgtctatgattattctggataattagttagaccaagaaaatccaagaaaagttacttggttcttactaatatctctgaattgcttgttctggtggaacaaaacctagataagttaattttacaactacaaagttgatatgattttgttgctgtgtctgagcaccattgggatattttaccttctgttattctataactatgactggaaccaacacatgtactttaagtacacctggctggccacaagccataccagacttattattcatttgtatttgaggacatgaaacaaaacaacatgtgaaagaacttattaaaaatttataatgataattataatgataataggctatgaccaccctctcaacatatttaagttatggaattttttcaaatatttttggagccttcaggataaatacccagatgtctttaactgaatttgcatttttatggcttgggaagacaggacgtgaataatcatgtcctactgattctcctgtggctaacaaaggtaaaatcaccaattcttggtggttgtttacatatttattccatccttttagagatctacacagggtggacatctgttagcttaatactttcattgtatcctctaccatattttatttctttataaaaaagactttactgtgaaggtcatgatcagaaacaaatcgaatgctcataaatattctatgacacactcattgaattacaagtggagaaagtagtatgttaaatttggagtattagcatattaaacatggtcacaacaaatgtgaagaaataatatctgtaagtttacaatggggtcaggctagcacaatataaaatcaaatcttttatcctattctgtctttatgttacctgtgtttatgaatacagcacaaaaagtagacaaaatataggacttccattgctcaaggcttttcttttactttatataatacattcaaagcaaattctctttatactttattaattatccaccaagaaaaatcatatttccaagacagcttgcctctgggttaccaagttgtatgtttaatttcttctctcatataaccataaacaatgaaatctaatttcgattttcaaacatctaatgtgaacaaaattaacactggaaataagtaaatatggaactaaatataatttgtgtctatttatttcttttcagaagctttatgtactataattctccaggataagtcttgtgctatgagagtagttggactgatcacacacaaaaaattaatttgataccaagactcgtcctttgaacaaacaagtctgacgagtctttaaaattatttattttattatttgagattataatataattaataaaactccccctttcttttcctccctctaaatcctttcatacaccccaccttggcctccttcagaacctcccccaatcagggctcagtgagccctgcagaagatgaggtaaaaagagtaagaaccagaagcaatggaggataccaggagaacaaggctttctaaatcaaaatgtcaatgcaatatgaactcacagagatctaggcagcatggacagagcctgaaaaaagtggttacatgtccccatccctaagaaagaaactatctccagttgataagctcttccaagtgaaaattcagttttttttaaagaagtctcactgggaaaaggaactactactaagtgtaggatgaaagcccaataataaataaccaaacagaaaataaactctctctctctctatatatatatatcatcataacctggaactgagtccaatgcaatcttactcctttagtctgctgttgttagggtgtttgccaaacaacaacaaaaaagaagcttgtaaggtaaatcaataataattgaaagagaagaataaatataatttatgagactatatttataaagtcataaaacataaatggtgaattaaatacatgaggtttacactaaaaaaacacacgatgtatctaataagagttgtaaagtgaaaataaattaaagaaggagaagcaattagtatgtacttttaaaatggccactagcaacctgcatttttattttgatgaatctaataatttattggaaactaagtaaatatcacatctagaagaattattttgatatatggtgtcagacacacaaaaatgagagaacctagtctgaaaatttagttaaaaagagaaagcatctctaaaaaaaactaaaaattatataattccagttataataacaacaaagtacatatacatatagggaagataactaatggaagaatttagagaaactttaatgaaaatctgagaattctagtagtcatgtatcaattaaaaaactttgttgttgtctctagatgatttattaggggtggaaaaatggcagacaaggctataatttcaaaatgagaaattagttgatattagtaagtttaaaaaataatttactaagccgggcagtggtggtgcacgcctttaatcccagcattccagaggcagaggcaggcagagctctgtgatttcgaggccagccagttctacaagaagacagcatccaaagccaaagccaaaaacaaaaacaaacaaacaaacaaaaaaacacaaaaatctttgctatgaaaatgttaatggcttaagtgaaagtaattaaaatattaaattaaaaatactagaaaacagaattaagatatttgggatttgaaattgtcatcttatttatttcttagaagtagatacttaatacattttgattggaatatcagttatttttcttaaatatataaatatctaagatgtaaaataataaagaggtacaagagaaattaaattaaaaatttaaatttaaaaagttaaaaaattttccaacaaatataaattgaatcaaacataaaataatttaatgtttcttaatatatcagaaattaaaactaacctaaatttgttacatacacctaatggaagaaaatggttgttttaccttgctaatgaagcatctgaaatgtttgatttgctatatcaaaattattttaaaccaatttagtatgcatatctaaaatgttcacaagaaaagaacattgacagacttattttaaaagattcaaattcatatatcatttaaggtagtaataattggactatcaacagcaaccagtctcatttcagaataatgataaaaacaaatattagtaaatataagtactatgcatttggttatctaaagattattccacataacatgaagagcttttgaaactcactattcagaaacaacgccaggagaaattggggaaaagacatgaatggatgtctaagaaatggatgttcaggaaatactcatcttaactcatatttggggatttgtatctcacacaatattgtcatgaatcactgtgagactataggacttcttcaaagcattaagaaaaaccatgctgggattttgttgggactgtaaaaaggaaggactcgggtctttctgacacagcacaaattagtagaagttaatgacaaagatgcaaatggaagcaaacatatacacatatgcatctatagcatcgtattcatacaactgaattgtggataaaagacccaaattagttggtgccatacatgtctacaaactcacatgtgtgtgtgtgtatgtgctcgcgtgtgcgtgcacgtgtgtgtgtgtgtgagcgcacacacacactgcaacagtatttctgatcataaaatgaaataatgctgttgacttagaatacatgcaggtgaatgagatagggcaaatataagtcaaacatgccatattcactaattaacaagcttgggtactgaaggttccaaagggtcattttttcattgacatagtagctttttttaaatgaacaatgtaggaaatgggatattaagatacacaacatagatcttttctagccatccgccgtggtgggtggatgaaagacctgagctaacctggggttagctcgttaaactataataaagcctcgtgctgtttgcatcaagctttcgaatccgcctggtgattggggtgaccatggtcctgggctgagatcttggaggcctgagcttctgggggtcttacatttgggggcttgtcctggatttgcgaccacccctcacctgaatggattctatcttgtaggtaagctcgatggagctcacaacttatatgttcaatgttatgtccatgtttgcttgttatgtctcttgctgtattgttggtttggtgcaaagtcaaacttaaatttgatctgtgcctgtgacttgtatttggtaatttggacctcagtgggagacagatgtgtcctgtgactctgatgagttctgccccggacgaaattccgagggttgtgtgatttggaccatagggaaagcagacgtgcctcaaaggcagacgtgtcctgagaccccttggtcctgccctggaagaaactccaagggttgtttgtaattttggtttggtgccatgtctgtaatttggtctgccacgcggtttgtcctgtctgttgtgtctgtccttctgtttttgctgtttgtgtctgtctccgtactaaccaccccctccccggattccacctcatctgtgatcggcagatgtgccaggtggatcacaaactgctgccctaggacacccaggaggtatggacaggggccaaggacacttggaccctcctcagttagcagcgattgtagctgcctggttctgccgcccgccttcccagagccattgccttataagtggcgtgaatggattaggttggtgtatgttcttttctgtctattctgtctctctgttttcatcattggttttcaattcaggatctaccatgacaccccctttcgttgagtcatatggtgccacactaagtaactttctttaccagtctttgtttctgtacggtttctataaagcctggagggttggaacaggctgggtgactaggcagttgagcagcagggttgctatctgtggtctgatgtgttgcagcccataccctccctgtctgcttttaggtggtgtgtcagttttgtgttttcaggtctgttgcttctgttaattttgttctgcccaagtttcattcacatttgtgctgtgtgtttgttaagcatctctttctgtccctactgcccacgcacgtggcatgggacaggagttcctctgccatgcgccatgggttagagtgtgctgctgcggagtcccctgaggctgctactctgaactccaaccattgctgcggccctcacagctgagcctggcctatgaaggtgagtctgtttttccatcctcatatgccggtctgtgaggcatgtgaagtagggctgtctctgccccaacttccatcctgcggtgggtcctgtcttgtggcggggggttttcactgaggacatggctgcaaggccaccatttgcccagctgcctggtcttctctgtgtccacacatgtggtatgcagggaaaccatgggggtctttttcccaccccagcattggcagagggtcttcgattaccagcagcacctcccacccccaggtttctaccctgagcatatggatctggcctgctatggacattctaaagaaacagccttaaagttattaaaaaatataaaagggactttgataagagtttttatgatgactgaaaaatgagagagaatgtaggagactaaaataataaaaaagaaaaaaaagaaaaaattgtctaagaatgtctaaggaaatcagagaaatgaactaaaggtatatagaaagttataaaggattaaagcaagtcatggaaggtcagaagaaaggttgttaaaagtgagagaaaatgtaaactgtttgctacggtttctcatgtcttcaaatagtaaattttaaaagtggtaatataagttaaaattttaaccatattaagttaattctgtttatttctcaagtaaattatgcatgcttgttttaaaatgttgtttcctggtataacctaagttctgttacaaacatacatctaaaacaaatggtgtaggtcaccaccattttgtagccagctacatggcaaactggtcacatggctgactggtagccattttgctgaatttgaaaaaagttacttaaactgccatcttgactaaagatgaccacatggaaattagagataccatcttagaaacaagtttttcagttaagatttaaattgttaatacttctatatattacagaaagacattaagggaatttaaatttctttttacaaccagttttttttaatgtttatatttttaaaatgtcttttttattaatgtttgtacttaaagagcttcaatttaaaatcatttttaagcaaagcctgacaatgtaaagttcttgttttataaacctgctaatctattataagatgttacagtttatgctttcagaagttaagtttagggtgttggtggcacatgcctttaatcccagcactcgggaggcagtggcaggtggatctttgtgagttcaaggccagcctggtcagcagaccaaattctaggacaggctccaaagccacagagaaaccctgtctcagaaagtagttaagtttaaacaagcagctaaaatatgtacacgtagctactgtttaagaaatataaggtaactctacgcagttttaaattcagctgtgctaagtttcaaatattttactaagttaaaaccagttacagtcaggctgaaaattaattacagaaattaattagaccttacctagccacctgtatgcttaatgtgtgcttaaggcaagtaactaaaacatacagacctctaatgcttcagagacctgcagaatatggcatttaaactgttatctttaaagtttatattatcagacagactgccagatcctgacagtgacccaaagtctccatagaagattatgaggcaccccagttcctgcacctggaccagtgagtgagatgctgaaatgtgatagctgctgcctgccataacctggccaagactgtggacaaagctgctggacagtggaaaattgactgcaccccctttgtgtagacaaaacaaggtcagtcttttccatgtccctcttccacagagagaannnnnnnnnnnnnnnnnnnnnnnnnnnnnnnnnnnnnnnnnnnnnnnnnnnnnnnnnnnnnnntttgagacatctgcctccagcggtaatggagagacttgggtatggctaactgtatacggaatggcttctgtcactttttagtagatttggataaaatatacccttttcagatctctgaaatattaatagttgtcagcttgacagcatcggacactcagatacacaagactatagtcagcatgttagctgataaagtaatgactacctagtgttcagtcacatgctcaaggcttttaggtttattttggttgtcatctaattataaacttaaagggcttttcatcaggccaaaggcacttctgtccaatccgtacctggctctctggacagaagaaaaatgtacatgcttctagcccaaatctgtagttattgctaggaatcaaaattataaatgtgtttctgctgtttgaacagacatccagatatctgcttttttctacactatgggcttcagtaaataagttttaacttctgttcctactttaaacatgtcttaaacaggtttctgcttctggcagatacttctgagtatatcagttgctgactacaggccgttcctatggagattgcaaaccctgtacttgctgtggatgtgaaccagtccagctgatatggacaccccctgtctctgcaacagaggctgccaacagctcccaatggattccccattgcctaaattcctttttttttgcttttgactagcatttcagccttcttgggtccctaacttcgtccccaaatcaacaggaagtagcatgagaaagaatatgtcacccaatttccctggttaaaatgctaagtcagaagaaactcctttgcatggggatgccaatatatctcactccctgatggggacgctggagagacagcaattccatgatgggaattaaaaaaaaatgagggaatgaagggaccagcttcccatttcggcagccataatagccgaacacatgcttgtctgaccttgtcttagtcactaagatcagatgcccaccccttttggcagccataacagcagaacacatgcttgtctgaccttgccttggtcactaagaggtcagatgcttgcctcgtggcaaggaaccaatcagaagttagctggtagtgctatgctttatggctgtgggtgtgctttatggacaagtgcacagcaatgatgtgcagagcatagcaaccactctggagggcctatgggccataacaaccagttgaccaatcaacatagggcaaaccctccaagcctggaggcacactaatcctgagcctgtgtgtatccctagacacgccccttacactgccctataagatctctatgcatacacttcgagctgtcttttctagccatccgccatggtgggtggatgaaagacccaagctaacatggggctataaagcctcgtgctgtttgcataaaaaaaaagaagatacaatacatagtttgcaagatggcttattgagtaaaggtgtttgtacccaagcctgtgtttgatctttgagactcaaatgtttcaaagagagaaccaactcctgaaagctgtcccgtaacacctcatgtatgtgatgtttgaatgtgtgccttccctctgcaacataaacatacactaaataaacaaataaacaatggatagataataaatgtattttttcttttaaaaagttacacaaattatccagatttaagtgcagattctcttatatatttaaattcttttatatattctttcaaaatttcattcatatgtgcattgcatttttgtatatctgcccctcaatctctgtccaatttccttcagagttccatcacatcttactctcaacttcttgtacgtgtatttatttatttatttatttatttatttatttattgtttgtttgtttgtctgtttttaatttgaactattgctttaatgcactaagccaagtatctgtatgggaaaaagcaataaatttgaaacatgaagctttgtgtacttcccttcctttaaatctccattcatcaaaaacctcaaaccatagaatgtagattgaacatatccttaccaaaaagtaaacagtaaataagtaactgagtcagttttttgcagtgtttccactatcctgggaagaacaaaggctatatgacatagaaatggaatgattttagtgaatcatgatgtgaatcatgaaccaactttcaggagttggttctctttttgaaacatttgggtcccaaagatcaaacacaggcttgggtgcaagcacctttactcaataagccatcttgcaactcctactaatttatgactgttttgtgcacatgtgaacacatgagaaagaaacagaaaacgagggaccaaagagaaaaagtacacttcactttaggatatgtaattccctattttgatactgtgcatcatgtttacattttgtattatctcctgtcaaatatgttatccctggtttgagatgaagctagaaaaaaaaacttaaagtagtggtgtggtaacattcaaatttacctctgaacttattttatatatccttaaattttctttgccaaactgaagattcacatgtgacatgggtttaatgctgctagctctttcttgattagaattagatctcatgaaatagtgtctttttgctattctgcctataacaccctactatctatgaggcataaaaatagattttaaagattaacacaataatgacagaatagaaacagttttaagcaaccaaacttcatagagaaccctccaattatgtgttattattttttaatatagtaatgattactattgattagtgcataatactgactaatgaaatctatctttttaaagagatcttatcaaaatatgagtattttctatgcagttgtagatattttattgtttatatccctggtcaatgaaacaggtggatcacacagaggagaattaatttcctgatttaaaagacaatatacagtgtaaagagatgactcagtagttaagggagattgctgtctcctgaaagtccagagtttaattccttgaacttacatgaagcagtacacacttcctctgagtcaagctccaggggatctaacaatttctagaatgctagagtaaacacacacacacacacacacacacaccacagacacctttaaaagacagtagaagtacagatgactcttgtgtataggcctataagagttaaatcaatcaaataacatttagataacaaaattattacaaagatgaatggttgcaatcacctcactgcatttgcgacagccagttctataatgattttgtatctgtatttagggtttccaatcttgacagagaatatcagcattttatgcatgagtgaattctcatgtcatttttattgttaatgaaggcatatgcaatgttcattctcatgattttttaaatgctgtttaaaatgccaattgcattcaacataggctctgatgtattttttcataacaacttcattattgaattattcagtattttttttaaatttggccaatcattgaaaaataatcctatatagactaatatttttgagacaggatttctctgtgtagccactgtggctgtactggaactcacttttcagaccagggtggcctcagattcacagagatctgcctgtctctgcattccaagcactgaaattaaaggaatgcaccacaactgccagaccaatacatcctaattttgattaagactagaattacttatgccaacattatttgcattttagcttgttattattactcttaacttccaaactaaaggacaaatgagaattataagtaaaatacagcatgttacccctgggaccacaagcagcaataattcagttaactaaggcaagtgcaacattactttttatgatggtatgtctctttaagatttttatttaaaatatcacacccattctgcttcatacatttcagagcatttttaagaaatgatatccattacagtggatttatccatgaatgtcaccatgaaaacatgctttgttcttttttttttttgagacagggtttctctgtgtagctttggagcctatcataacattcgctctgtagaccaggctggccttgaactcaacaagatctgcctgcctctgcctcccaagcgctgggattaaaagtgtgtgctaccagtgcccagtgctcttatgggtttttaacattctaattattaattaacaggaaagttgagagaagcagtctttagtttttggatctctaggaaaaagagttggatttacatgccaggactgagacttcaatctattcatttagcattaatattccctaatctaggatattttaatgtttaaacaagtttttgtgctcattgaactaatggccttgtgtacaatgggcaaaagatctaccactgagacatatacaggctctaaattttatttctgttttagtttgtaatttcatagaaaacagaacaaagttgaatggttaacaactgcccaagaggtatttcaggcagtggagagatttatgagcaaagggtgttacaatatgagggattttattctttacccttgtatctttgctttagtcttcagcattacttgtgttgcttgagatagacagcacagggattccatgagcctggttgatcctagttaataatgcttttgttccacgaagattctggattccatggattctcctttgttgttattcctctaagtctgatttctctaatgctttagaacaaggaatgaaagccactgacattctcatcatgtacctgaacactaaagagaacaacaacagaacaaggagcctaagggcttagcttttgatggatctctgaaatgacaggacatttctcctgagaattctccagtccttgtcatatcagagacattcacagcaactaggcaaccttgtaacttgtgaaataattaccttagtcaatatttcatattttaaaattgtgttttgttaatgaattttagaaaatgtctcatatatcccattttgtcttcagatttgctatttagccaagtgtgatcttgaactcttgaccctcttgtctctatttcccaattcctaggattgaagacaagcaccatcacattcagttgtgtacagctctgtgaaaagaatccacagttttgctcatctccttcaaatgctttaccaagtgagctatatcccaagaccaagggtgttcttttttttaccattattttattataattgttatttgtatatatgcatgttgtgtgtgtgtgtttgtgtgtgtgtgtatgtgtgtttgtgtatgtgtgatgtcatgatgtgcagttgaagtcatgggtccttccataatatctcggtttcctgcatcaagtccatgttttgggggttttaaaaacaagcacctttacactataagcccctcctgacccaaggaccagtttaaaacatggactctgaaccatttgtttatgtattactaatgagataattctaaatagaatagcttgttcccagaactgtagaaattaatttctcccatttccccatgactcagctatttaaaaagaggacaaagcttcactatatttgctctaatgtaattatttcatttgtatacttagtaaaagacctgtgtacatataaattacatacaagcatacaatatacattcagttccacaaaaccaaaacccactattatttctatctaattttgaattgaaacattccctcctagagctgggaaggaggctcaggaacttagggacttattgggttctagaagcactgaaagttccaggattcatgaggctttttaccaatgttctatcaatagtaaacaattactggggggagagaaggtttcctgcagtagtgctgcctgtaatttgattagggggtttcaggggttcatattttgtgattcttcaccattacatgctaggccttttattgataaaggtgcacttgagtcacctttgtttctgaaagtagcctcttgctcattcgatgtttaatcacaatttttaacatcatcttgcagttggagattatcctcatggggcgttttctggattaggctagttgagatgggaagatatgcccagtaggcaacaggcactctcctgtggtagtcaactcactgggtcactgtgcagcttggaattattttcactctctgttctgaggtatttgaagatttaatcacatctgtccaggaaagctcatagaacaacaaaaacatctgtcattcttaacatagttcacatttaaccttagttgtccctttctggatgaaattgatgggtgacctcactattctaacacacaagtctttcaacagtttgattctaatgtgttaccccagttatgggtcagaataacatccatgttctcagactgcactttcaggatggtgtgtgtgtgtgtgtgtgtgtgtgtgtgtgtgtgtgtgttatttcagtgttctttcttctcctttaaagtcctgctccaagttactatttctctggaaggctttaattcatcattcaaaactccaaatatacttctagtatcactttgtttaatctagtaatatagtgcatttccatttctttcattgtgaatacctataattactcttttaggttacttgacattacatatagtggaacatagaaattattcttctggttgcaaagatgtcaatttctataaatgtgtgagcttcttcaaactcaaagagatttattacaactaaagaagaaaggcttgcctatgggatgaaaattttgggtaagcactgatctcgtttcattagtatgaggatgacagcacttaaggtctatgtgctgtgaagagttatataatcttcatatattaggatacagactccatgttatgctttataaattatatcacaaatgggaggtcatgagtgcacaattaattttcagtacccctaacccctacaaaggatgataggacatttgtctattgacaccgtgtccatagaggtgtaatagctaaagaattttatgtaacagagagagggaaatgaaaatgagttatttaatggctcagccacatcactgtggtatgcagagctgaaatttaactagagagatggaagttcatgaccaaaagacagagtcaaaatcagatagcaggtatttttttttttaatgaaatcactgggatagccatgcagtgtctacattaaaaagtagaggaagtggttgtttggataaatttagggtatttattatctagacttgccttactctaaattgagcagcaggatcagaagccaaggaaagaggaagttacattatgcaattgaatacccattaagagagaataaaaactgaattggcattatgaacccagcctacatttctgctcagctatacagattatggagcttatttgctgataggcttggagattaattatgaagaaatatactgtgaatcagagttttgtgagtctgacaggctttgcaagtcaatgaagtgtttagtaagatgaatgaattatgcataggacgtttttcagaggtgatgtaggagtataaaatgtatctgcaacccttcggaactaaggataatcaaggacgttagaattagtgaaaaagacagagattactgacttttcaagaaacttaagtaacttttaaataaatgtaccatattttgtttgctttcaaactttcatttaaagaattttcattcaagataaagcctaaaggtaaggaaggagacatgagtagtagattctttatataatctctttgaatgctaaagtaatgaacataagtactcattataagatatttaacatctcttatccaaaaagaagttttaactgacacagcaaagcacaaaagacataaattatgtgttgatagtcattctattctcacttttcaaaacaaaatgtaaaccatcctttacccataaattagaccaaactgattagaaagattctagccaccctacaataagtattttttttctttttatgtcattttaagatccatgtttcaagaatcaaatcagtctttatgcccacagtgtttctagctctatgaaatcatgtctttagggattcagtccatcataattggtgcactagtgagaatcacttttattttgatccaatctcctagaaatggtaattgtgcattgcatgtgtctctaatgaacatcactatttttctctttttttcatttatcatataatatatcctgattatagttcctttccacatctcttcctatttggatctatacactttctgtctcttattagaaagcatacatagttttaaatataaacaaagtataataaaacaaaaaccaatatattgaaataagacaaaacaaacagaataaaaatatcccaagagaagccacaagaaacaggttcagacattcaagaatctcataaaaactagaaaacacatcatatatgcaaaggactcataggataaaaagaaagaaaaaatataaataaaataaaaattttaaatgagataaataagaacaatcaatatcttattttactttaatgcccactccaagaactgaaacctacaatttacagtgcttgggtgaacaataaccacagactagatagcccagacacctagggaaaaacaaaatactaatgattttaaaaaaatactactgataaaataactcctagtactattctgcaatgcaaaggacagtgttttattcaccccaaataatggaagttttctcttccattagatagaaaaaaatatactgacccatagccacacattactcatagagagaggctttggaacacaaagctctaaatggtatgtctacataaaatcccttccctaagatttcagggaaccctcaggaagtgatggtaaaaagaatgtaagaaccagaggggataaagaacactaggaaaacaagtctatttaaattaactgagcaaagctcatatatgctctcacagagattgaagtagcaagcatagggtctcaacaggtctgtaccaggtcctctgtgtatattaatagctttgagattagtattttatgggacttctgagtgtgtgaagttgtgcgtctctgattcttgtgcctgccattgaactctttccttctgttggcttgcgttgtccaaattctgtataattttcaataaattcattgagtattattttattatatattgctataatttcttagaggcttattcttttataaaaaagagacagaaaaggaattgatccagagagaagaggaagtggggagcagctgggatgaatagaggaaggagaaattataatcagaatatattgtatgagaaaataatttgttttcaataaaaggaaaaaataaaaatgtattaaataaagttgaaacaagcagcagcaacagaaacaacagaagctgtaacagccatgacaggacagcatgagacaggaagccttcaatgaccctgttaagtttgttttctgttggctatctaaggctgggaatgaagcccacctgtaagagtagtttgctttcccatcaagactcccttggaaaaaaagtaaatactatttacaagtggatatcaatagctcttgcattagagatggggtgcatatgtttatttctacttacagttgtagcactttatttgttgcaaacactgcaatctgcttcagtatctgtgtgttcatatgtgcatcaacaatgttgagatctttgttttcttgaggtcctctatctcctctgtcttttatataatactttctggctcttctggggcactccctgagcccttaaaagaggactttgatggagacatcttatttagagttaagtattccaaggtctcttactttctgcataatgtctgtcatcagctgcaggaggaagcttctctgatgttggctgagtaaggcactagtctgaggatagcagaatgtccttaggagtcagtttgttgctacagatttttctttgttttacacagaacattattatttggttttactctgtgtatctgggttatctagtctcacccaagtgtcagatatggggtccatcttatatagtgggccttaagacaaattacatattgctttatgcccacaaactttgtgccaccattataccagaatatcttatgagcaggataccattgtgtaccaaatctttgtgtctgggttggtatttatgtttttcctttggtaacattcagagtacctgcttggacaaaagacactaacacatacggaagaagcctccatgaaggtaccagtttgccttttctgtattcaatgagttgtacatgtgttgttttcatcaatggggcattgctgtctctttgtggagagcaacctatagttttggaaatagccttggttctttgggatttcccctgggacttgcttggccaataactgaattagatggaatccaatcttgagactggaagcttcctttggtgacatgcctagttggtgcttttttgcccctgttattttatgatttggtttacatctccatatgcttttatatttttggaaacttctactatattagattttcatactacccttcaaatgtcttaattttatctattgctgtattgcctccctacttgatcttctttttaagtccttctcatctagctgtaactatcccttccatttccctatcctagggagatttatccatcagcatctagcctcttactctacactgaacctctgcagttctacaggttgaaacattgctatcattgtcctaactacatacaagtgaaatagatatcacatttgtgtttttggttctggagaaccccactcaggatatttttctaaccagatccatttacctgaaaatgtcatgatttcactttttaatgtctaatatattccattgtgtaaatataccatattttctttatccattcatctgctgatggacatctatgttgtttccagtttctggctgtcacgaatagattagcaatgaacatggatgagtaaatgcctctgtggtaggatgaagcatcctgtggatatatgcctaaaagtcgtcattggcatttctattgctatgaaaaacaccatgattaaaagcaagttgggaaggagagggtttatttgacttaaacttacacattgtagtccatcattgaaggaagacatgagaggaacccaaacaaggcaggagccaggaggcagaacctaatgcaaaggcaatggaaaggtgtggcttactggcttgcccagcatagactgctcagcctggcctgctcagcttgctttcttatagaacccacgaccaccatcgcagggaaatgtatcattttgattggtgggcctttctccattaatcaataattaagaaaatgccctacagctggatcttatgagccattttctcaattgaagttccctcctttccgttaagtctagcttgtgtcatgttgacataaaactgtctagcacaagtggtatagctggattttgaggtggactgattcccatcttcatgagtaactagcacactggtttccttaatggctaggcaaggttgcattcccaccagcagtggattagttattcctcttcttctgatctttgtgaaaatgagctgtcatttgtcttattatcttaccattccaataggtataagatgaaatctcaaattattacaaaaccttaagctttaacaagcactcaagattagttgtaggtgtctttctaggactggaatagctctgtgactttttaaacaaaggaacgtctcttgtcaatacaactgagaaactccccaatgacttcatcatgtgttatagttccttgcttagaaagtcaaagccatcattcctcacagttttgtaggactttctaaacattctgatttggcttatactagtgaaacttccaattacatctcatgagaagacaagagaagacagagatctttagggcctttaaaggtaaggatgcacatgtttattgttcagaaactgaagataaatttaggggacacaaatttcataaacagagaattagcatattttatttctaaaaacccttttagaccacacaatttattgattatttttatttttaagtgatagttaatttttaagaattaaaaataaaacatatcatttgaacttgagagatggctctgtgggtacagtgtttgcttaacaattatgaagaccagaattcagatgcccagagcccatgtaaaattagtacattaattgcttgtgtctgtaaccccagagatggtaggcaggaatgggaagatccttggggtttcttggaattcttataaactagaatagcaattcaacaaagagactgtgggtcaaaatgcaagggagttcatgatagaggaagatttccaaaatctacctctgatctccgcaggctcctatccaggtaactgaacatcccccacctcacatacaaaaatcataaaaagaaaaaatgttttaagtatgcacatatttatgactcatctgtgcttatgctttttggggatgtcaatccctaaatacatcagtaaatgtcctatctgaagagtgagactcttagcctctgtttcttttctctctataacattactactctgtaaacttgataatttcttatactgagctaaaaactagaaaccatatgttgcctcgttcacaggctttctggctgagtatttttatttgtttatttttaattttgatttgttttttgattttttaatagatagcaaagaatattgtcaagttttcttactaatctgtgtccagtatcacttaagatgcccacattttcacaagaaactcccagggatggtctttgggaggattatagaccccaagcctgaagtctctgaatctctggatgttctatagttcatgagactgagcagcaacctaatgcattcccgaggaaatacagaaattggtctttttcccagtatcccaaggaatgagtacacattccttaagtgtactaggaaattcatctctctgacaacccagagaaagaaatcaaacaggctcctctggtatgttctttacttaatgactaaacatttttaggcaattttgtgtgtttttcaaaaaatatcttcagagtcagagaaaaaaatgactgcagtaatcagaggtagatgactcattaggacttgtgctctgcaatatttgaggtcacataactttaaacaaaacaattactttgggtcccatgaggaaatatgcctcactacttatgacatgcatgtgtcctggttaagtgacaataaaaaccaatttgacacacactacagtcacctgagagaaaagcctccaatgaggaatttcctacatcagaatggccaagtgcatgtctgtaaaggattgtcttgattgttcaattaggaaagcacaactcatacttagaagctcaagtactgggcaggtggttctgtgctgtattaacaaaagccacataaagttgaacatgtgaaagaaccagagagtgagccaacaaacagcattccctggtggtttctgcttcagttcttgccttgggctcctgccttgtctttcctcaatgataagttgagaccttgaagtgaaagataaaataagcacttcctgccttttagacacttttagagtacttcatatcagcagcagaaatggaaatgagatcagcagggaattctaaacccttgctgttcagtgtttttccatacaactaatgtgcttctcctgagagcttcaagaaaatgaaccatctcacatgagaacaaacaaacttcccaggggatctgttttgatatttgcatttgtgatatttctctgaatcaaggaattacccatgagaatggctgatcaaataggctccaaaaacagaattcactctaccatgttgacctactgcacattagatgacaatttccaccacaggagaatgaatccattttacctcactgacaacaaaagttcttatgaaccagacaaactcaaggcaaacattctgccggcaatgcatttttaaaacattaaatgatgttttccttttgctttgtagtcttggatgttgttaaaccctagggcaaaacacctcaatgaaaattttcataggtaaatatggctgtgtgtgtgtgtgtgtgtgtatgcatacatacaagtatatagacacatatactatttttgttgttgttgtttttcaagacagggtttctccgtattgctttggagactgttctggaactctatctgtagactcacagagatccacttgcttctgccttctgagtgctgggattaaaggcgtgagtcaccaatgcctggctaaaatttttatgatatttttctgagaaataatgatatgtgtctgtgcaaagaggcttataaacaaagaaacattaatcatctattaccagactgggatttaatagctcaagagattttgagttacctcatgaactttgacaatgctgaattagccagctcacactgtctaataaaataacgctgtgtgactttcagaaggtaatacatgatacattaattttcctttatttctgatggctgaattgtgagttataggatccatcatgatccttggcagaaatgaagagaaaggtagggtgctaggggaatcacataaccaaagattgatgcctagtcatgatttaagtgtgatatgttctgtacttgttctccagctggtgttattctttgggggaagttatgagaactttgagaaatagagacctgactgatgcgaagcgtgtttgtgttagtctttaatgatatagtccaatctgggtctagtgtagtgtttttgcttcctggtatgttattcgtggaagtcccaggcatattctcatgatattaggaatctgctgtgctatacttcccttgtcaggataagcttcatgtcttcaagccatggggctcttccattctgttgaatcttcaggtatttggtttcaaatatgaaaaaaatccctctcttcttcttacagcctcattcaatatcattgtctctccaaagtccttaagttcaatatgattgcatggaatattagggctccaataccaacaattaatgaggtaatttagtgtgtagtaaccatgaagctacatacagaaatcagaataaccaaactaataggaagtactggaaaaatcaaataaaagttcattttatttaataaaattattaaattagttgataaaatacctccttatattcctccctcaacccagaattagaaataaaataatatagatttagatgtggacatattataaaagttatttttacttaaatactcgtctattgttttctagttctattatattttctttaagctaataagtctattagaatatatgttttgagcactgtaagttttttatagttcctttcaaactgttttcttttatttttaagattataatacaatagcgttatttctccattccctttcctccctccaaacttcctatatatgccacttactctctttaaaatcattggcctctcctttcattaattgctattagaaacctatatgtatgtgtataaaaatatatattccatatacaaactactcagtttgaataatgtttcatgtatgaatgcattcagggcttaccactgagttttggataaacagttgtacttttccctaaggaagactgtttctccttctctgggcatttctgagttgcctgtagttctttgtgtcgggttaagtgcctgtgaactttttcctgttcagtatgtctattggtgccatccttattcaactcatatttaacagccagacatgagattttatgtgtgtaagtgtgtacatttttatgagacataatgtacagcttctgacattactaggagaaacaatttacagcaaaatccctggtcctctgcctcttgcatatttctgtccccacttgaacaatattccctgaatcttaggtaggagctgtctccattgggactagggacttttcaactcttcttattgattgattgtagtttcctatagtggtcttcccctgtagcaaagagaagtttctttgatgaggggtaagaattccagttacctatgtgtgtaaggacaaaatattgagattgctgttggagattatgctggtttcgtaaagtagagattgtatattctccttcaataactatgactttactagcactgaggagttaactatgtttctagtaccttctagttcaaggagtcttaaatccaattagagaactgtttgataccatcagtgtatgaatgctactgttgttttcttaagtcataaaatatgttcactaagaaaaaagaaagcattgttgatttcacctttattccttaaaatacacttcaaatgcaaacagtaaaacaatccagaatgcacccagctgttcagctataattatgactgttgtcataggaactacacctgtataagaattcaatacaaggtattatagttttgattttgcaagtaagatatcttatttactcatggataaaatagaataaatttcatatattgttttaaaattcttcaaagtgttatctgtctggttttgagaacaacatgatcatggaaaataatctcaaaagtcttcttaagtacccatgttgcttgtttttctttatgcatttgttatatgtgacagtcttagtgtttctattgctgtgaaagagacaccatgaacatggcaactcttataaaagaaaatatttaattggggctgtcttacaggttcagaggtttagtccattattgtcgtagcaggaagcatggtggctcataggcagacatggcactggagaggtagctgagatttccacatcaggaggggcaagcagcaggaagggctagagagacacaggatttgccttgggaatttgaaattcgaaaggctgccagcctcctagtaacacacttcctctaaaaaaaatctaccccttcttcaacaaggctacaccttctaatgcctctccctaagctttcagatatgagtctatgggggcaattcttattcaaacaaccacagagactgtccaatgtaaaattggacagtcttgaatacaagtactgtcctaagcatcttggtccatatatgtttaaagttttcattacacaagtccttacactgaaaaaagtgaagatgacatggcttcaaatacattatgcccagtgcattacacgaaggaagtctctgtagcacactgaactcaatgcggacaggattaaaatgcatgactgaaagggctaagagacctgctacagtccctattcagggtcccaaagttgaaatcctgcttaggagcaaaggagggtaaaagatttctataggcaacaatctgagggtcatgctctttatttcatgtgatctttattgttctgtttctcctccaaaattattttcctacttctaacttctccattcttctagattcctctattctaaaaccttttcttcttcaggagccttgaagtgataaagaaatttctctcattgttcaaaagcacatccaagaacaagagataaggagctgagccatttaccaggacaacacaagtttccaagcccataagaactaaaccattaccagaaaggggagggcatagtacccaatggcaactttaagacaaggacctattgttagtagactgacaaatgaataattggcatgctatttttagtaacattggtggatatgtgtgactctgatcttgtgcaagctgtaaagattttatttgtgtgttttttgtttgtttgtttgttatacaaaaagtctttagtctagtttaacttgctctgaggtgacagtgaactaattgtgtgtagtagtctgagcaagagatcaaggcaggatgttaagagtacaaggtccttgtgggacaaatagatcctgttatgaggcatgtctcagtatacattctaaatatcaaaactgtgtagttaaatgaaaagacatcctccagaccatcacagagtatgtgcccagtaaacaattaacacagtgttaattttatcagcttctataatgtttagttactgagacagccatgaaaatgactgtggtatactttcccaattcactctgttggcacttatctatctcactcaaaaaacctcagtttttgttttaagttatttaagaagaactaagcatttaagggtatggtaacatttgataactgtcgattatttttagtgtgttaaaatttagatttttctgggccatatggaagttgaacctgacaagtcttttgataagatttgaatatatcagagagaaaatggaggaggaatagatctagggaagaggggaagggtggggacaagggaggaatggagggtggtgaaactgtggttggcatgtgttgaaaacaaaattaaagacctctctgccacatacacaaacaccctcttctccttaagagttatagaaagctcacctttcaaagcagaatgtccatgaggtctgatatttagcgtccttcatgtgttataaatatttgtttttgtatttatagatgtatgtatttatttattagtggatttacctgtgagagggtttgaacaaatataaacactgtgtgagcaggccagaagaaggcacagggtatcttcagaattatcctcttgtacatgcccattcagcaagcctcagcaaatctcttatctcaaccctacatggagctggggctaaagacatttgtgtggatgtcttcttcattatttacatgctgggatctgtattctggctcttctgattatggagcaagtgctcttaacaaatgagccatttcttccttccctgtacaaccatttaaaagaatgggcataaatagaaattgaaagtgcagggcaaaatacatgattttctgttctcagttattggaaaaactgttggctttctagtcacattctggacgatgtttatcaatcactcataaaggggctttggcattatctgagatctcagctataaatataaaaaatgaccaggggtttaaatcagcccaaagtttcctaacccatatttctggtacctacttacttatcctgctttgttgttcctttagtcatacacttcataaatactctctttcttccccttcaccatgctcatccttgttcctttttgttttcctcaggtgagcaatcttcactttcccccatggaaactgtgagtagtgaatgatgtcaatgccagtcttctgctgagttatgggtctcactgtggaaaaacctatactcagaatatggaaaatcactagatgataatgtgacttatttggagaaagaggcttatgatttcaatatggacatcattagcaggatattctaagcacttgccacacatgccattgatagaaatgtgaagaactgccttttcatttgcttgattctgtttagtataaggaaggctttgagatttcactaattgtagttttcacttcccatctacacaggcttgtaaatgcatttcccggatatttttgtccaattagaaatcagttaatttcaatgtagtatccacttattgttatatccactactttctccaactccctactgtgacaaggacattaaaaggcttataacattttgtccacgagacctgactatactcccacatacaaaatcaatttccaaaatgaaaaaactcacttgcacatgaattaatcaaattcttgttctgttctgtgaaacacaatgaggctcagaagacagagtacaatgtttaccctcatgtcttatgtataaatttacataatacaaaattggatattttattctctatcattttagctaccaattagtaaaaagaaagcattaatgttaaaagtattccttctccttttactcaaagtcttgttttaatataacccatgaaaataaaatgaaggagaggggaagaaggctcagaaagaaaggtgcttgtgagaacatgagtttaaactcatgaacccatgaacaaataggccagcatggtggcatgcatttaagataccagctctgtgaatgtggaaactcttgaggcagccagactagcataattggtttgtttttgaattttaggaacttgtctccaaaaggggaaagggggacagtgtcttaattgtctcctagcctcctcacacatgcacgtgtgtgcacaagctacacaaacagatacaaaaattttcaattaatcaaaggaagattaacaccagccttggctgtcctggaattccttctgtagaccatactggacttgaactcagagatccacctgccttttcctcctaagtgttgggactaaaggcatgcaccagcacaacctggcccagcttacagtttttttaaattttatgtgcatttgtattttgccatcagtatcctgtctcctggaactggagttagacagttgtgagctgccaggtcggtgctaggaattgaacctgcatcttcctgaaaagcagtcagtgctcttaactactgaacaatctttctgccctccaccccagtttatgattttgaaaataacatgcaaatgactttttctttttactctaaagggcattgttggtggaggtttaaaacatctgatttgttatgttttcttagctcagggaataatacctgctgtcattctaccatggtcctcgactttgctagtttagaggcaataatattgagagtcctatgagaattgatatagaagattatacacagagtaggcaatagcaggaacagagtgctgtgacctgaaatgctgagatttggcaaaacatccagtagccacacctctgtaaagcaagtgcaatctatagtagattccactttgtgctgtagaagcatggataagaaacaaaatcaaggcaaagaagcaatagttcttattagtctgataatcaagagaggtcctataacttagacctacaaaggtatcacccctctattttcaataactcattttcttatggaaccaaattaaatacatttataattgataaaataaaaacaatgagtctgcaaaatgagtgtttcactttatttagatgtgatttgcttttgtatatgtaaactcacatttcattactttaagtaaggcttacagttatgaatgattattcctacagacaaacagaaatcttggtttctttatacattttgttagtgcctaagctaacccaggaaatagtacaccagcatttttgcatgcccagtagcaaccagagtctcagtttaatcagaaactatcattattttgtacataatatatatgtaactttccaaaacatcgtctgttttacaaaataaaaagctgcattcttcagcattcctctgttattgaaagaagcaatagcagatcatttgagagccaggtgtggtatgattttaatataggtgtttatatttatttgcctttgatatagaaacaatctcttgaggaaatcattcatttgatttactaatattacaaaagccacacaaccttctcctgacatttttattttcccatttcaaaattatattgcttttggagactatttgattcctgtgttttgtcaggtatgagctttgatgtgtattttccttaccagcatttgaaaatgaggaaaagagaacttggttctcttcaggacaatctttaagaaccaggttgtagttctccatgctttctctgccacagttcctgcagtgttggcaccaggactctgcccagcacaggttctagcatgaagagagtatagtgtggaaacagcattcattggcagcagagagcagaccctttcttggcagtggtattcaggcagggtccttctgagatacctgtgtattattgtgccatgatttgactcggagagtcagtgtcttttaagaaaagtagacctgaagcaaaaatctacgatgtttagggaaaaaagggacattgaaaagtgctaatgagctttatatcactcaagaaataaccaagaaaaaagccaagatttagctaatatcctttactatacatctactgttttatgcattttactataatcattatttatacctttagattgttttgatatgcccctattcaacaaacatgtagtgaaattctgctgaattcttgtaaataaactagtaggtaaattgttcaaggcatagagattctaacaatgaggaggggccatataaatgttcttaccaggaaagaatagaaaatacaagtattattaaaatatggggaaagagaaatccttcattctgatgagggaacaagagggcacaatagtcaccctgaaaatgaaagaagaatttgagggataaaaggcagtgaaccaaaaagttacacagccattataaaagaggaactgtagttaatatctacagcctgtctcaggaatttcaattttctcatgcaccagatattgtttgaaggaaagcattataagataatacttgatagacaatgtggcctagagtctctgtcaggaagcactccatatttgggaattctcatcatgtatcatcttctatatacctccttttattttattagcaaggtcagcacaggaatcagacagggtcattaatttttcaaccaagaccatgattagtatcctttgaaaatgattctatgtatgttgtttctgtgggaaatagtaaacatggggatttgtttcaatgctgataatcaaaactctaaagctagcagtcactttttccaattagaaaattgagacatattgaaagttaatggcagtgatattttcagaaagttcaagagaactgaaactacataggaaagcaccaacccaaatctacaataacagaagaatgacatcacaactgacatgcctaaatttatgattttcagatggcacatttatggtatgcatttagtaaaaacattatgcttgaatttcatgttgtgatcttttttggggcttgtattgtaaggtgtgatgttctcttgaaaatagccacagcatcaaacccactcttccccctcacacaaacaatatggggggggggacaacctacactctttctattctgcaggtaatctgggatgttatgtaagtcgcatatgttaaccacaattttcactttgtgtagtgtcagtttatgagttatggatatgactccatcctacataaataagtattcatacaaagagtcaaatggacatctatctaaatgaatcagaaattgggtgactcttagagtgcaaggaatgtttaaattgacatgctgattcaatactggaagtagactgatactttccaacccttaaataaatcttgagttgtttctgggatttagacccagaatctcacccatatgtcatcatgaagacacttaattttgggtcttttgttatctaaaaacaaaacaaaaatcatcactgtttaacacttaagtaaaaaagattacaagcctgatgattctggtacctgcaaagtacagaccagcataaagccagcatctgaggaaaggccttcctttgaatgtgttgaaacaagacagagcagcaacacattgaaaattcccttatggaaaggtgtcatgctcacagagtgggtttatattataaaaatccttggccataaaatcaaatgcatccttaggagttccagcccattcagtgagcatagcaacatcccattaacctcatggactccacatttggtgtaatattaaaacactgttcatcaagataccaatatgtgagtcctcaagaggcacaaccattcctcgagcaaaccacatcagtgtcatgaaagctttcttaaggtctggcaagggaagtgtaaaacaactcaaaatattctcagacaaagcctgcattcttagcctccaggaaaaagaaactcatttactcaacttaagctcttctttccatattctttcacatgagcagacaaaatccttactgaaattcagtggcataggtccactacaagtaaagagttttttcttctaagatatcaaactttaactcattaatgttttaccttcataccaacagctgttattacaatagtatttgaatgagctataataaacagagggtttaaagagacagaaatggtggagttggaaaaaagttgtgtgtgtgtgtgtgtgtgtgtgtctgtgtgtctgtgtgtctgtgtgtgtgagagagagagagagagagacagagagagacagagacagagacagagagagacagagagagaaagagagagagagtttgtgatttacatgaagaaatgaacagggaagatgactgtaacaaagcatttaaggacttaaagtaatttaaagtgggataacacctatgccactgcaatagcaaaaaaaaaaaagcaaaaacaaaaaactaagagagaacagaatagaatagaagaaaatgatggtagctatttttttaaatgtgtaataagtaccaaaattccaattcaagatgctcaaagaatacccagtgaagtggagagcaaaatattaagtcagactaaaaaaattacttggacctggggaggtagctcagtcagttaagcacttgtcaacaaatataagaacatgagttctatacccagcacccatttaattgttttcactttgttatcttctctctatgtacattgtaatgtatgaatgaacatacttgcatacacccgtaagcatgtttaaacacaaacacataaaatgcactttggcatatgagtgaagccagtttggaaagtctatattttgcataatatattggttttgaggtaggaaaatttagaacgatgaagcttagaaattttagtataacaaaaaatgattctgtgcaacactgtatgtatggaatcactatatacctattaaaacaattaataatccataagatacaatgcacagacatacacggttttaaaaagaggatagttatgagcggtagaatgtatgtctcagggaagaataaatataatagattctgggaggagacttggggtgggtgggatggaagtgggagatgtcaggtcataggagggggagggatggagggaaagagttctgagaaagacaggtggaatttgggaggtgatgtggaaacctagttcagtgacaactgcctagaatctacgaatgtggccctagtgaggactcctagctatggagggtatagagtctgaactggccatttttgtaggcaatcaagagttcctgtagtgagactgggatttattgaccagggaggtcctgtgaaaatacccattcaaactagcctaatgctagggcagaaggtcagtctcagcgggtcccattgctgaggacaactttcacacagctcattgaacacagatcaagatggtgcagatttggaaccctcaccctatgttctagtctctttggcataagaggtactttgtaggctatgggaagagaaacctcaacactaaaccagacacaaaacaattcacctacaaaatgttctgcctgcaagatgtgtttggaaaatggttacagaacttgtgggagtggccaataaatgatgagtttaatcttaggttcgtgccaggagaagcccatatactacactgcctggggggggcaggaaacagaggctgaataagccagagacaggatttgtgccatgtccagtcaccatgagagaggcttccttttgcagcagatgggatagacatagagattcacagccagacactattcagagggagactccaaacttaaggttcccattgggttcctcacctcagagattggagtaccccagggaagccagggatgaaagacagtaggaatcagaggaatgggcaacaccaggagaatatggcccactaaatcatctaagcaggcccacatgggttcaaagattgaaacagcaagcaggggctccaagggccttcactaggttctctctgtgtatatgctatggctgttagtttggtggatttttttgtcagactactaccagtgggattatataccaattagatatattatcattggaagcaggggtatctctcattctattgctggctcttgagactcttttgttcctactgggttgtgatatgaatgagtttaccttgtcttattgtatcttgttttaccctgtttggccttagtatattggaggcctggtcttttctgaagacaaaatggcggtggaacagaccttggggagtggggtggtggaggggaggatctgggaggggtggagggaggcgaaactgtggttggggggtattgtatgagaggagaatctgttttcagttataaaacaagtgtcatttctagaaggaagagtgaacctcagtatatacacattttcaaaaataatagatgagtaataccagtattcagactataaaaataacattaatacatttatttatggtttcattgaagtggatagtaagaaatattattgataaaattgcttcagaagttagtggatgttaaaaaaataaatgtaaaaagaattgaaaataaacactatggtcctggttatggtgttttttacagtgagtttatagttatcagtattcatcatttaagtcagaaaatgtcagatggtaaaaggcaattttttttctaaaggagtgagcagagaagtgagcagaagatgttagaaagatcaatgcattcatagattgcagattgatctgtcagggctcacttgtagatccagaagtttgcatgctgacatgtttagagatctgtgtatcatacaaacaaatgcaagcattagttctgttatccctctttagaaggactgttatcaattcatcagtagcaatgagcatacttggcatccgtatctcagttcatcaatattctccacaaacagaagtggatttccatggataagtagctgatttgtgggaaggagaataaatgagatgaattgaaaacatattttactgtgagagcatataaatgacattagaaacaatttacatccagtgtattttttgaaagagacaggaatctatataagtgtcctgagtagtagaaactggaataaacagaataactaaatggttggtgttgttttatagtacgaagaacgaaataatggataccatagttctcactgttataaatatattattgaactggtcagtggttggagaagacaaggagtatctactgcagaagaaggccaaatgattcataaggctactaagctcttttgaggacaggtatagttcttgatgcttaactaaggattgagatttgatttcataaaacacaacaaggaaaaagttgactttatggaggctaacataatatgtttaactgaaggcaggtgatcaagttaaaactcagtgtcatgaatgtgtaatgtaatgtaatttaagatgacaccttttctctatgaactttatctgctatcccatgtttaacatgctttaatccatgcaaaagtatactataaatcctaatatggaaacattctacaaagtacccagcaaggacttctaaaatctatgaatgacatcaaaatcaaggacagtctgaatcacagtcgcagccctgcgacagcgaagaagccctgataaatcacagccattgggtttactaaatcatgtgctagaacagaagatgacattgacattaattatggtaaggaaataagaatatagatttgagttaataatgcacagttttcttgactataataattacagcacactaatataaggtgtgtataataggaattatctaaatttatcctagacataatccctactaaacttaaaatgttatttgtggttgataaaagcataacatcctcagtgtccaaggcaaaataatgcttcaataaattttgctttttttacatctatatgaaaataagaccatgtctatgtttcttatgtttggcttatttctctagaaaatggccatcctgatttatttatgacattacaatgaaacagcttctcttattaaaatggttagtattctatttttcaacatctctagaaatggatacattgctttcatatccctgtatcttggtcattgtgagtaacattaacaacagtgatgcagtgatctctgagatactgtcttaaattgcaaatgtgaacagaaatagggtttctgggttgcatggtacatcttaatttttccgaattatcattccatttcaacatcaagaatgtgtaattttttcatagccttgctggcatttgtattaacgtcagtttcatcctggtactaaaatgtatacatcaaggtgtgcaagacatggcatactttacattttcttggagattatttggactgataatcatttcatatgccttttagtcaatcaaaatatttctttgagaaaacaagaaatcttctttgcctctcctcttccacttctgaggaattgaggtggaaaatatttcactgatacatctgtatcctcatttactgattccaattcaccaacattttactcagaaattgaaacacctatcaaattcccacactgaaattcaaaaaccatcctttacaggcaccctttctcctagcactgtgttgccagaagagatggtatcagttaaaatacaggcctgtatatccctgcttaatatcctatgacattatttatcttcttagtgttatttattattgtactattattcctcaatttcacactgatgaaattttattttttaaagagaaaacaaaagctgcaaaacacaaaacaaagggaattatgagcacctgatgtaaagtgatgccttaaaaattatttttggagaaggcctaaaaaatggccatagtagactattcaataaaaaaaaaatcaggaaatgtttctgtgggtttctccagtctggtcttgacccctttgctcatgactccttcctctctgcaactggattccagatttcagctcaatgttttgttgtgggtgtctgcatctgcttccatcagctactggatgaaggcactaagatggcatataaggtagtcatcaatctcattattggagaaaggcatttaaggtagcctcttggctacttatattgttagttgggggtcaaccttgtagatctcaggacattctgatagctgggaaaccagcataggactgttccagacaatctgaaggaggaagtcagtttggaagtctgggcaatctatggggccactggtagtgggtcagtatttacccctggtacacaaatggactttgggagccctctccacatagagggatatctcagcctagacacactggggagggtctaggccctgatccaaatgatatgacagatttgaagatccccatggaatgcctcaccctccctggggagcagaaagggtttggggtagggggcaggggaggaaaggagagagagagaactgagtttgacatgtaaaagaagcttgcttctaatttaaataaaaaatcaaaatcaggaaatggacatgcattggcactgaggaggttacgagcaaggggctaatctcttcagcactgtgttgttttcaacaagaatttttaatactgctaaattctacggtgatcttgggtgaaatagacccctctttttcagtaactttggggaatgtaattaaaatttagtttctacattgacgtcttcatatgcaatatcaacttatacagataagttttatttttctgcacgtatgtactgatacttatttagagctattcaaccatgaagaaaaaaatggtaaatttatgactaacatagctgcatgatatgacagatttgaagatccccatggaaggcctcaccctccctggggagcagaaagggtttggggtagggggcaggggaggaagggagagagtactatatatagtactgattatttactaatgcattgaaaacatattcatttagtaacataaaatacaaccttattgctcaccactctgagaagttgaatttgtctccaggatgaactgaccttcatctcagcaaatgtcaggctttaactaacagataattatgggcctaatattagtctgttctttataaaaaaaaaaaaaaaaacagtaacatgttttctctctacctttatgatttgatacatgttaaataaataattatatgaatttgatacctgggagctataacaaaatggaaactacatgtcaatattatttatgtaaaaaattttaaaaggtcacttttatgctatgagacttatttgaagcaaaatataaagacaggttacatttatacttttaacattaggaaaattcaagtaaaggggctttgtctataggcaaacaggctttgcatagaaaaccactagtaatgttgatatctaaattgtattttgtatttcaggcatttaatgtcataaatattctttgtgcagataggtttaatgaagaagcccacttgttgttcatacaacaactagtccagataccctgaagtgaattgtgtgtgtttattagatttttctcaaatcttctactgctttactgacaatgaatatacctttttaaaaacgaagtatatgagtcacttttctttaccttaaaacgttattgagtgacttccaccaggaattaaagaataaaattctttaaaatctgtgtaatatttattttaaaattgttattatctgttcctttgttggtttcacaaaatttcctagaaagtagttaatcctctagctactaggacataaatatcaatgttcactaagttaatgtgggatcaagggccacatataaaatgcatgatttctggttagtcttttaaagattatttccattataagtacaattttaaaactaccgggtggtgattttataatttccgagttttactgatttcaggaaattgttttatctagatgtttaaatgattttcaaaattttcttcttcttatttatgtgatgcttctacctgtgtgtctggttatgtaccatatacatatgcatgtgcccatgaaagtgagtagagggtgtcagattccctggagttgtagttacaagaggctgtgaaccacttgatgtgagtgtgggatttcagctcaggtcctctggaagatcaacaggtactattactggctgagccatctctccagccccaggttattgtttattatattttgtcacaatttcacaatgtactgtcatttgaaatgttaacatttttatgcctcatttgtttttggttgacataccaatcttgtattattaaatctgttagatatttccagaagacacatactttacatgatattaaaatttccatatgagcttaaatttgaaaatgacttatatttatactttgtttaataatcattgaaacattttgacaagtttctttaaaaatgtgaatctatggttatcaaaatatacacatttttatgtaattctatcttacccccaagattcataatcctaatattttatttccttctctatttaattaatacgttttctaatgtttaattttaaacaaaatgttgtgctaataagacatggctcaaatggtcaaagagatgccagtcaatcatgagcagctgagttcaagcccaaaaggtctggtgaaaattttgtcctttatctttatcagcagagggaagtggtggagacaaaagcatagttggagctcaatggcaagccatggccacattggtctctcagcttcagtgcgagactttgattcaaaattaaaacagagagcaattgaggaagacaaaagacattgtatctggcttccacaggagtgtgtatacatgtacacacacatcttcatgcacacaagcacacacagatacatttaacattcatgcacatgcaaataaaagtaagataaaagttattaaattaaaaaagacttctttaagccaggcgttggtggtacacgcctttaataccagcactcgggaggcagaggcagactgtgagtttgaggccagcctggtctccagagcgagtgccaggataggctccaaagctacacagagaaaccctgtctcgaaaaaaaaaaaaagacatctttaaaagatacatcttagaaaatcttctattgctacttttattatttaaattggacatcatttttgttcaattcattacgtagatatgaaataaagtttcactaaagtagtaggggagaatgagggaatgaggtatgaaaagctttaaaaagagattaaggaaattctgatttttatggagggttaaaacagaaatggaggctactttttatgccaccctagagccctcatacagtggctgatggaagcagaggcagatacccacagatatgcactgaactaaactcgggaacccagttgcagagagggaggaatgaagatcaaagaggtcgggaccagtctagtgaaatccacagaaacaacttgcctgaacaagggggagcacatggaccccagactgctgcctgggaggactgaaccagacccctgaacatggatgtcaatgagaaggccttcacactctatggggcccctggtattggatcagtatttttttcctggtgtaagaagggactttgagaccccatcccaagtgaagggttgctctctcggcctggacaaatggtggtgaaacaagcttgttcctaatttgaactaataaaaaaattatacctttttggaagaaaaaaagtctgtattataatgtactgctttataagctaatgaaaatgtaatttaaaaaagtgcatgccaaggagttatttttttgcagatgagcgattctcccataagttacaggtatttttaatgcaattgcagatatgggatactccctatgaaattctgtccagaaagcctggaggcgcccaagaccatgtagatattgctactgttccttgtctcccataagaaatgaatgataagaccccattactgaagacagcattaaacctgtttataggacacagataaatgaagctggcactgacccggaagctgtcttcctggtagctagttttccttattccagaggatgctatgaaggctactttgggagaaagctcatcaatgtctcacccagatgtggactctacacggtacagactgacctgccatgaaaaatatacccaaagctgcaattaggatatgaatctttgggagataatcagtttcttttagatttgtgtcccactttatagcaaagagtgcgaactgagaagtcaaacctactgaaaagtcttctggggaggggaggttccataaagaaacctactactattactttgttaagtgaaagcttattaggatttttgtctaaatatttatatttataccacagactggtgctgctgcaggctcaggacagggaatcttttgcaatgattgatggttaatagagaaactcacatctggccaaagtgctgaaaataagtgactactgagtgattatccctaaatgggagctctatatcatcccctttaagactgagaaaacagtaataaggaaggggcaggaagaatttaagagccaaaaaatggagaggagtgttgagacacactgccttctaacagtggccattgtactcacaagcacacagctgccaagagacctggacaggatttgcagaagatcaggccctacaagattgtcatgaatgagagagaattacatggtacactgtttctttctgagaagatactggcattaatgcttgccaatgtgtgcacaatttccttcagtaactctactaatgtttgtaccagtaaccctgattaaagtctgtgggccaaaagagaaaaggacatatagaaaactcatacatatctttctcattgaaagataaccatgtgcatgacaataaatcaagtgctatctaatgttttaagtttgaagaaatgagagaattaatttgtcataaaatatctacattcgtgacaagaaacattgcttttataaagtttcattggttattctgtatgaaattactataaattctttattcaagaactaccataaatttactaatctaccaccaagatatttgaaactattctgaactctaacctatataatcctttagtaattgattagtatttctttttgtttcctgattacagcttccctccctttattcctcccatctggatccagtccattctgtttctcatttaaaaaagagcaggcttctgagctggatgtgggtctctgcatgtttccatctgcttcaggaggaagctgtttatgatgaaggctgaataaggcacttatctatgagcacaacagaacatcatgaggagtcatttgatcactactttatttcaagaccagtaatacttgattttaccctaggtaactgggctatttaatctctggttcttgttcactctaggagtatcatgcttgggttccatctcatggaatgggctttagccaaatcaaatacttgttggttactcttacaatttctttgccactatcaccgtagcatatcttgcatgccaaacagattgtgggtcaaagctttttttttttttttttttgactcagttggtgtttatgtttatgtttattttcttttttctttttttttggtgtgtgtgtgggtagcctgcagactgcccagacctaagacactaaaatgtattgacaaaggctgcataaagggaccacattgacttctccatagttaatgatttgtgggagtattgtccttgacaatgggggacagctttcagtttgtagaggacagcccattgccttagtaacaccctgggtagtttggggatatcattgataccctcttgtttaacaactcagttgaatgcaatgcagtcccagtactggggcacctcatttggtgacaagaaatggccagtttagactttgtcactcccgttactaggaggcctcatttggatcaaattcacataatttaggcagtttccaatgtagtagctttccataccaccccgcagatacctctcaattcctgttgtctcttccagtattcctctacatcaaccctatctcccctctctctccatacctgaacctccctttaataactaaaaataaacaatatatgtttttgtatggttgataattaacagtaaccattttatgtcttaaatggatgattctttactaatataaactcggggagggctggtggctaacagcacttgttgcacaagactttgattcccagttctgaaccccatagcccacacaagagcagaattagctcatacatttatgatccttggcttgcttgggaggagatgagggatggggaaaggaataaagctccatgtcctggcccttgccctctgacttccacatatgtattgtgttccatgcatgtttgcaagcacacaaacttattccccctgctcctctttggaggggcttaatcgtggaacttcagttgatataaccctttgtccccaagctgctatatgtcagaaggtgaattttttattgttgtttttatcacagcagcagaaatagaacaatgggaggtattaaactctaaacatgattaaattgtaaatcacaatggagactcctatatatcataatagagcctttttagatatttgcttacttattcctttctgagaaagggtctttttggcctattcagagtcagcaccccacaacattcatgccattttacatgtgatgtgagagttattatttgaattagtcacatatgaattatcaagcattgctcattgtcttttgaaattattactttctcttcccagaagatgtataagcagtctccttagctcacagcagattgcacctcagctggcaccaacaaagccttcggagtcacaagggcttcagaaatgtttgtcaggtgagtaaaatgcaaacataaattggtatataacagctttactcacagaattaacaataatttatgaagtaaacacccatcagtcaaaactaaataggttacacatgtaattagaggtttttctatacctgattttgaagaataggaaatataacacctctcaaaggagaaaaaagaggatggccaactactttctctcaggtaacattgtgtgctatagaaatcacgtataggaaaaaaagaagaaatgttacctttcttcaagttaatttagggccagatctctccaattccaataaacacctgactcataacctacactggcatgacacagaaacaggttccaaaatcccaatcacaaatgtgtcacactctttagggatagactccaagtacctaagggacatgaatggtgtcaagaaaccaagaatggccagaagaatatttagaacaactacataaaagccatgggtgcctgaattaaggccatcagagttttggtaaacccaaagtttctacaaagttctgcaagtgcattattcctaggcacaattagtatgtttatatcatgtgggccataactagacaaataatttcatccatattcccaaagatcttagtcacagacaccaaagttaaagtcaaggctcaaaccaagacgcaagcatagttgcaagatgtaacttcatttcctccttccatttgccacatgctgcagagacaagagttctgtcttctgactacttgttacagaagtctggtgatctgtagttctgcttgaacaaataaatctgggatagaagaaaaaacaaagaactaaacatcttatacacacatctgtgcatatacatacacacacacacacacacacacacacacacacacatatatatatatatatacaaatatatacacagaaataacatatattattatatattatatataatatgtatatatatataaataatttgtgtacgtgaattttgtaagatgggcataaaaagaatgctttatcatacattaaaagactagaggcatataaacaaatgtgtatatacagttgtttataatcttagaaatcttagacctgaaccttgatatctagttatctttaaaataatcttatagatatttgtgtggattaaaacatcattgaaactaacgtcagctgcagtgacaaatccattagcttctaacataaatcttgtgaaaacttataccataattcttcactgggtaaggtcattttgttcattttgagaggctgaaagatttaaaacaaacagctaaaacctaagtcaactgaacaaagtttgtgactataacttctagttattcaaaattctatgcactcttttaaccttcctagtgaacatcaaattgcagacttttaagtaatgtaatagctcaataacttttacatttgcctcagctttttttctccctgattcaatccctaaaacatcttcttaaactgttttatttttgaaatgttatttgaaggatattaattctatggttaaatatttaatatgtccttattgcttcttcctatgccttttcctgttgccataataaaacaaaaacctgcccaagcagcttcatggggaaaaggtggtaggagctagaaaatgtaggccatattttgtctatacttgggaatattatattttcatgattaattgcccaaaattttactgcattttatcctgctgcattattggtaacgttcctttcctttccttgtacttttctgtgcatcgctgtttcttcttgaatgtgaatgggctgcttctgtttttcagttgaaagacaaagaaatctttctttacattccacttcagccccacacacttgactactatggcctatggtatagaacccagtattcacttatgtacaaacaaggcttccacttcccacagtcttctttagctactcaaaaccacagacctgagaagttcttgttgagcataaatcaagtctcctttgcagatctgtactgttttgtttgtggaggtactgctgataaaattcaaatctggctagtttgatgtatctgctccatgcaattggaaatgttgttgcaagatgactgtatttctctgtgtttaaaaacctacagaatatggcatttaaaatggtttaggggttttcttgacagtgagactcaactgctcctggcaataccaattacatctgagaggaagatgtacttcaaagaaactcatggtgtttgctttcaatatggcaagaatagtcatttgggcaagaaaccactcttgcctggactgtttgataaactggacatgcaggatacacaggaaagagactgctgaacttgatgggaaagtcctaaatggtatctacttcatggaaaagtctgacagacattctacagaactcagagaaaaatgactgacaaactgccaatgcaagcagacagtttaaaattttctgcttcattgagaagtcttccagactcacttcagtctatgggctgaagatggatactccaacgttacaaaggaactttgggtgactgtccaggccgagagatgtctctgtcaattctagagtttatataacatctttctgtggtctttggtggagttgaagacagatagcgttttagttttccttagttaggattaaagataagttacatataagattttagactcataaagataggatagatgatagaatattttctataagttttaccaaatgttaatggactaatgatggggaatgttcttctgggtatgtttgtcttattggttgatgaataaaactctattagccaatagaagaacaagataggtaggactaggatacaaggaggattctgggaagtgtaggcagagaggagtcatcatgtgatcccaggaagggatgtagctgggcagaaactagctaacatactggtctggaggtctgtacagacagtcaggacatgacttcgttgggcagaatcagtatataaacagggacaaacaggacattgctctcttctctgatgagatgctgagcagttgagatgtaggatgccagaggagaaacaggtcccgagacctttctccagtaagataagactgcacggaaatacttagattaatagaaacaggttaataattaagacagagctagccaaataagaagctcaattctctagccaacagttttataattaatatagcatctgtgtgcttcattggggcatagaggggtggcaggaccttgaaggtcaagaaaactcacattaaaacttttactacattttaagcctttattctctttagaaagtcaagaattgtgagcctctgctttaataattcaagtgactgaactaaggtatatggggaattaaaataaattcactttgaaattacatgaagtgtcattcgtggttttaaggaggggtaaaatgatggtagcaagtaatgccaatattggcctctgagttttactatttgttttacaaatattttcataaaaactaagctattcaacaattcaaatttaactaaaataatacaaaatatattcttgactgtcaagcattgactaatgattaacagaaactcctatatactcagaaattcaaaaattcaaataatgtgccagttagagaaaacattaaaagaaaatagaaacatatttaaattaataaaaatatagtaaatcaagttggttaaatatacttagactttctgtattgaaaacttataaaattatttatgaatataaaaataaagaaaatctgaaatgataatatctatgaaacaatgtagaaggaaaatcagaatgataggaaatattaatgctgaatacaagccattgctgaaagtaaaaactaaaaaggactaaagcctaagcatataagtgtacaagtttaatagaaaagatctccaccacataaacaagctgaaaaagaaaaaccacatgataatctcagtagatactgaaaatccaacaccccttcatgataaaggtattggagagatcaggaataacaggaacatacctaagcataaaaaaggcaatatacagcaaaccaacagccaacataaaactaaatggagagaaacacagtgattcctctaaaatcaggaacaagacaaggttgtccacttgctccatatctcttcaacattgtgcttgaagtccttgctagagcaataagaaaacaaaaggagatcaaggggatacaaaatggaaaggaagaagtcacactttcattatctgcagatattatgatagtttacataagtgacccaaagaattctaccaggaaactcctacagctgataaacaccttcagcaaagtggaaagatacaatttaacttaaaagaatcagagcccttctatatatagacaaaaagggggctgagaaagaaaccatagaaacatcacccttcacaataaccaccaccaacaaaaaatttcttggggtaactctaataaaacagttgaaagacctgcataacaagaacttttagtctttaaagaaagaattaaagaagatacccggaagtggaaagatttcccatgctcttagataggtaggatcaacatagtacatatggcaatcttaccaaaagcaatctaaagtttcaatgaaatccctaagaaaataccagcacaatacttcccagaccttgaatagataatactcaactttatatggaaaaacaacaaacccaggatagtccaaacaaccctttacaataaaggaacatctagaggtatcaccataagtgatttcaagctgtactatagagctatagtagtgaaaagagcttggtattggcacaaaaactgacaggtagagcaatggaatcaaatcaaaggccctgatattaacacacacacacacacacacacacacacacacacacacctatgaacacctgatttttgacaaagaagctaaagttatacaatggaaaaaagaaatcatcttcaactaatggtgctggcataaccgaatgtggacatgtagaagactgcagatagatccatatctattgccattagtcatgcacaaaacttaagtccaaatgaatcaaagacctcagccacactgaacctcttacaagagaaagtgggaggtacacttaaaagaattggtgcaggagacagcttcctgaacattacacaagtagcacagacactgagatccacaattataaatgggacctcctgaaactgagaagcttctgtaatgcaaaggacacagccaacaagacaaaaaggcagcctacagaatgggaaaagatcttcaccaaccccacagctgacagaggactgatttctaaaatataaaatgaacacaagaaagtagtcaccaaacaccaaaataatttgattatgtgggctacagaagtaaacagggaaatctcaataagggaatctaaaatggctggaagacatttaagaaattgctcaacattgttagccatcaggaaaatgccaatcaaaacatgtctgagataccttcttacacctgtcagaatggataaactcaaaaacagcaatggaagtttattctggagaggatgtggggaaaggggaacacacatccattgctggtggtagtgcaaacttgtacagccactttggaaatcattatggaggtttctcaggaagaggagaatcagtctacctcaagatccagcaattccactcttaggcatacacccaaaggattcaagttcatacaagaaggacatctgttcaactattttcatagcaacattgtgataaccagaacctggaagcaacctagatgcccctcaactgaagaatggataaagaaatcatggtacatttacacaatggagtactcagtggaaaaaaaaaaacaatggaatctttaaattagcaggcaaatggatggaatgagaagaaaccatcctaagtgatgtaacccagtcacagaaagacaaatatggtatgtactcctcacatattgatataagacatagagcaaaggattaccagactacaatcaacacctccagagaggctaggagataaggaggcccttaagagagacagacttggtcacatggtgaaggggcaagtgacaagagctcctgaacaaattgggatcatgcagataagggtgagaaaggtaagagaaagaggagggcagaagaggagagaggaggagagcaggatatgtcaggaagattgagtgaagatgaatactgaagaacaagaaaagagacatatcaattaaaggagccattatatgtttaaagagaaatctggcactaagaaattgtacagagatccacaaggatcaccccaactaggatcctaaacaatattggagaggtgaccttaattgctcttcccataaaataagattgaggactaccttaaatgccatcatagaccctttttccagtagctgatgggagcagaagcagatcacagctaaacactgagcagaattcctggaatccagttgtagagagggaaacacacagaaacagctgacctgaacaagtggaaattcatggacctcagtctgacaactggggaaccaacataggacccaaaccagtacacctgaatgtggatgtcagctaggaggactgggcagtctatgaggcctctgttagtggaaccaggaggtttccacagtttccaaaggacttggggagctcattccccatggagggatattccctcaccctagatacatggggtaaggcctaggccctgccccaaatgactccacagattttatgatccctcattgaaggcctcactcttcctggggagtgaatgggagatgagatgggggggtcggtgggaggtatgggaggatggaagggagtgggaactgggattgatatgaaaataagattgtttctaatttaaacaaaacttattttaaaaaagacttagactttgatattgctggatgttccatccatggaagttgtaattcaggagttggcattgagatgtaaccatccttgcaagtgtgcataattcacaatgtcagacttttgaagaagattttaatttgaactttcttgagtttgcagactttaaagtttcttttcattataaagaattccgtgctcttaagcttggccagttttctaaaagcttggattagtaaagagaacctggacaattatctggttcatactattttggtatatatctttctgcgtactatattactttatgaattagcagaaataaaagatgcctttagaaaaaaattctatgttttaaatctgcatagaattaagtgggtcaaataatggtgttttggtaagctgatgagactcagttacattcaaaatttgcagtgtatagaagcatacagacagaatagccaacattataaaggacagatgaacttatgagtagaaaataagacaatgaaagataaataaaaataagatcataatggaatattagttcatagtcattaatgatactaaaatcaaaagaatgatttcaccaaatgctggaagaatatgaagaaaatcgatcaattatcagtgggagattaaatgactgagcacagaggaaaattaactatttttttatttttcaagacagtgtttttctgtgttcctggaattgattctgtaaatgagcctggccttgaactcagagatctgcctgtctctgcctcttgagtgctgggattaaaggtatttaccacctaattctctctccctccccctctctcttctcctgtgtgtgtgtgtgtgtgtgtgtgtgtgtgtgtgtgtgtgtttgtgaaggagagagcaatttccatagtggccacaagagggcatctgattcaattcagctgaaattacaggttactgcaagcttgctggaaattgaacccaggtcctatggagagccgtgttcctagcacctaggtgtttaattttaattgtgttggtacttacagaatttacataagcaaaagcatgctaaaactaccatatgtggcatgtgatatcttagtccataataaatgaggaaaaaattggaaaaactcacatgaaagtgtatttaaatcatgtcctgccattattgaaattttgttagttgataactgttttaaggtgcaacatttttaaaagtattttgctggaattagaagacatttgtaataattagtaaaatgatgtcataataattggcagatgagtaaaatgtcttgtgtataaatattcgggactagaggtgtacacataagggactgtgcacattaaaatttagagagactgctatggggataaaataaattgatctacaagccacatatatagtgtaatggtgaaaacaaaagaaattaaaacctttctgtaatttgatgaaaagtgcatttcaaatcacaattaactatggcagcttggtatttattctaagttttctgtatgtcatgaaaggtacctggtcttatggcaaatatgtgttctgttcaaatatggcaaggctctgatttaagaagcctgtgagagcttatgtagggcacttcccatgcaggagagtaactgagtggggacatttgtaagtaattcctgattggttggtgcagaccacagagtactcaatggcactttgagatgctccccttatttacatttctgatatatgtcttaggaaatgcacaggtcagtagttcttctctgctctacccctaccaccacagttcttaggttgcaccctcagaaaagagcataaaattaatttacactaaacaacaaattaaaaagagctaaagaatagctgtggtctttgctatgacttaactgcttgatattgtgagcacattttaagaaaagtgtcttgaccttttaggggtttatatactttggctttgtgggtgtatttaaatcatttcaatatggtaattttttttacttttttcagtttatagtttgttaactctttttaacataatcaccaacagagtctataatttaattgaatgcatgggtggacattatacactctagtcaaataattggctggcttgagagattaaattgtgctgctgaaatttaacaattcgtagaatcatagaattttcattgttggttctaaaaagacaagtaggaagcttgcagatgagagaaactcccaagagcagtaaaaaggggtgttggtaggggtaaacacttagcagagtatttgaagtattctactgatacgaaaaattcaagagaagctactattagggttttaattagaaattgggcagatatgtaaagcattttatactctgaacccatgggaacgggctttccagcctattgtatgacaaatctacttaatacattagcaaattagatgtttcttagtaattacgtaggcatatcaaatgccttattttacctttctgaaggttttcttaagagaggagaaaaatattcattttctttgtttttcaatgccaagtgctgtaatatcactgcaactaattaaaagaaatactagattattttgaaaatgtagttctttgtatagacgaatatagagaaaataaagattaatggatgatggaactaattttgtttctactccccagcccttgcatttcctaaagtgttccaaaatactacatgaatccagcatggaatgtaagcaaagtgaatcacagagcccatctgcatgctgggagaggagctacaaaaccaggaaggagattatagggccttgacatagcccattcctgagggtaggaaaaatgtccaggttcaaaaaagaaagtgtacaaagaaagaaaagaatgcttaacaaccaccacattatcacagatacaagttgagtagaaatgatgattcagttataaaatcaatcatggggaaagtatacttgtaaaacggtactgaactgttgaagaataagctttcactttaagaatttgaagtgggaagagagatgtcccagaaattaagagtgactgctgttcttgaggagcaagatgtcattccctgcactatagttatgcaggaaataactgtctacaattgctactccgtgggtaatgatgaaatattctggcatccaggagcacccacataagatgtgaacatacacacagaaaggcatgaatatacacaaaaggaaaaacatatatgaatgtaacaacaattaatgaaaaagaggacatgaacttgcaaagagtgggttggggtacacataagggtttgaattaatgagaaaagagagtgatgtaattctactatatgaaataaaaagaaatgactaaaatgaaaaattttttagcaaaacacaaaacacatcaaaagatgatttcttgcattaaaaaatcaccagaattctgtaaatatgcctcctgatattaaattgacacaatacaaatattttagaaattgacaaagtaattaggtgttatgattctatttttaatctgaggaatctacatggtgaggcagttagatgatcttcaggttgtcctgcggtgggcacccaaacctcaggtgagtctgggtgctcctcccaaaaaaacaaaacaaaacaaaacaaaaaaccctgctcgcttctgcctgagaccacacggataagggtgtacctgcccagactggaagacacacccttatctgaacacaccttacccctgtccactttctgccctctgtcctgcttcgggtgcgtgagcctcaggtgagaatgggcactgctctgcttcccaaccgcccccatcaacccctgcttgcttctgcctgagcccactggggcaagagtagacctgcccagaccaggaaggcccaccctgagtccagacacaagtcactcttgtctacccactgccctctgccatccagctgccaccagaggctgagccctccaccagccactggagagagcgagagatcccaaatgcactctctggaggaagggatgggaagaagacaaagtaagaacacactgaaaaacagaaaaaccaatatgacaccaccagaatctagggactccacaccagcaagatctgaaaagcccaacacagatcatgaagaagagatggacctcaaaaattatcttaggaagatgatagagtcctttaaagaggtaacaagaaaatcccttaaagaaataaaagaaaaaacaaggaaaatttacatgagatggaggaaaagacaaacaaaagaattcaagaagtaaacaaatctcttaaagaatctaaagaaagccaagaaaaagcaaccaaacaagtgagggagcactagaaacagttcaaggcatgaaagctgatatagaaacaataaagaaaacacagaatgaggtgatgatggaaatagaaaggctggataaatgattaggaactaaagatgtgagtataaccaatagttgttgaagactttctagaggatatacagtcattgatcaaagaaaatctcaagtccaataaatccctaacacaaaatatccaggaaatatgggacatggtgaaaggccgaacctaagaataataggtaaagaagaaggtgaagaaatacagttcaaaggtacagaaaacatgttcaacaaaatcatagaagaaaacttccccaacctacagaaggttatgcctatgaaagtagaacaagcttacagaacaccaaacagattggaccacaaaaagaagtcccctcgacacataataatcaaaacaccaaacctacagaataaagagaaaatattaagagcagcaaaggaaaaaggctaagtaacatataaaggcagacctatcagaatcacacttgacttctcaatggaaactttgaaagccagaaggtcctggatagatattctacaaaccctaagggagcatggatgccaaccaagacccagcaaatcaataaagtataaactaggaaacattacaaagaataaatgaaacatagagttggttctttgagaagatcaacaagatagacaaatctctagccaaactaaacaaaaggcagagagagagcatgctaattaacaaaatcagaaatgaaagaacaatactcaactttatatggaaaagcaaaaaacccaggatagccaaaacaactctgtacaataaaggatcttctggaggcatcaccatccctgatttcaagctctattatatagagccatagttctgaaaacagcttggtattggcacaaaaatagacagatagaccaatggaattgaattgaaaaccctgatattaacccacataggtatgaacaccttatttttgacaaagtttctaaatctgtacaatggaagaaatatagcatcttcaacaaatggacccagaaatacagaacattgcagatagatccatatctgacaccatgcacaaaacttaagtgcaagtggattaagatctcaacataaatccagccacactgaatattctagaagagaatgtgggagatacccttgaaggaattggcacaggagacagcttgctgaacattatgccagtagcacagacattgagatctgcaattaataaatgggaccccctgaaactgaaaagcttctggaaagaaaggacacagtcaataaagcaaaacgacagcccacagaatgggaaaagatcttcacgaaccccacatatgacacagggctgatttccaaaatatacaatgaactcaagaagctaaccagcaaaataccaaacaatgaaattaaaaagtggggtgcagaactaaatagagacttctcaacagaagaatgtgaaatggctgaaagacatttaacaaagtgctcaaagtcattggccatcagagaaatgcaactcaaaacaactctgagataccacctcacacctgtcagaatggctaaaataaaaaacaccaatgacaatctaagttggaaaggatgtggagaaaagggaaccctcctccatgttggtgggagtgcgaacttgtaagaccactttggaaatcagtatagtggttactcagaaaaatgggaatcagtctacctcaagatccagcaattcctctcttgggcatatacccaaataatgcatgttcatacaacaaggacatatgttcagccttgtttatagaagcatcatttgtaatagccagaacctggaaacaacctagatgcccctcaactgaagaatggatagagaaaatggggtacatttatatattggagtattattcagcagaaaaaaatcaatggaatcttgaaatttgcaggcaattggatgcaactagaagaaaccatcctgagtgaggtaacccagtcacaaaaagacaaacatggtatgtactcactcacatatgagttttagacatcgagcaaaggattaacagcctacaatcctcttcaccaaagaaactaagaaacaagaagaactctaagggataaatgaatggacctcaggtatgggaaggggcaggaactcagctaattgggagcatgagagtagggcatagggagctgccagaatgagaggaggagaaggggataggagaggaggaaatggaggagcagaaatattgagttgggggaacaaaagaggagagcaggatgagagataccatattagagggagctatattagagtccgaggagagatctggcactagggagatttccagagacctacaaggatgacacaaactgacaatctatgcaatggtggagagaataacctaaacacccttcccctataatgagactgatgactactttttatggcatcctagagccctcatccagtgcctgatggaagtagaggcacacatccacagatatacactgatctgaactctggaacttagttgcagagagagaggaatgaaaatcaaaggggtcggtaccaggctggtgagacacagagaaacagctgttccgaacaaggaggagcacatcaaccccagattctatctggcaggctagcacaggactgatccaggtccatgaacatggatgtcaataaggaagcctctgcactctaggggtggccctggtagtggattagtatttttccctggtgtaagaagggactttgagagcccatcccatgtgaagggatgcactcttagcctggacacatgggggaggacctaggcccagcccaggatgatgtagtggactttggggagcccccatcaagggccctatcctgccttgggagtggagggtggatggggtgaggggttggtggcaggagggggaggggtggggggaggggtgggagagtggaggggggagcgaggaaggaaaagggattgacatgtgaaacaagcttgttcctaatttgaactaataaaaaaaataaaatcaaaaagaaataagagatgatcttcagtttggggccagctgaagctatataacaagatattccctctttcaaaaatgaagccacaaattataatatttaacataaaaattaattctctgaaagtgaaggagaagacaagaaaattttgcaaataataatgagttgaaaaacattagtagattgctcctagttctttaggtagtaaatagaaacacaaaaaggttcagaatggtcaggctggatagtgcagtggccactgagcttctttccaagcctgaaacctgagactctggagagtaacaaaaagaaaggacagaaacatctcctacatgttgtcttctgaccaccacatgtacattatggcatgaatgtgcacacatgtgcatatgtgtgtgcgcgcgcacaagcgtgctcacgcatgcgcgtgcgtgggcacacacacacacacacacacacacagagagagagagagagagagagagagagagagagagagagagacagagagaagagagttaataaatgtaaaaatgtaacaattgtctaatgcccctaatggttagtcactaggatatgccaaattaagccacagttattcagttatgtaccattatgaacatgtcagccttattaaaattaagagttcaacataaccaaatactggatagaacatagaacaatgacaacttgaagtgcaagtgaaatgctgagttatcccatcttgccttctgtttttaaggcaatccccaagggttctgtgtgagtatcaatcgctgtctccacataatcatcatcttgcaaaatgtaatgtaaattattagacatttattttctaactgccactaacttttgagagactcaaacaataagaaaaatggtaatacaagtccatatttagagcttatgcataaacattaaacgatgcagacttttaaaatcgtgaagtgaatcagagtccatctgcttatcttaaaagcattttgaaacagacgggattggaaaatctatacgaagattagcttttatgactagcctaagcagactacctttgaaaagtgtggagtaattgtgtttgaattctttttttataatttatttattcttttaaatttaattttacattctaagcacagttctccctgctacccttcacctgccccccacccccacccccagtccacttttcctcacttgtaagggctcccatgaggagtcaaaaaggtctaacactatagattggggtggggccaagcccctcttccatgcattaaggctgatcatggcatcccaccatagggaatgggctacaacaagatagttcatgtaacaggattaaatcatagttctagtgccactgagcatggcacctcaccataaggaatgtgctccaacaagctagctcatatactaggtttgtgtcatgatcttactgccagggacatctctgatagtccaagcttcaaaactgtttcccacacatggagggcctagttcagtcccctggagtatccacagctgttggtctagagttcatgagtttctataagcgtggttcattggtctctgaaaatttctccaccatgatcttgacctcccttgctgatacagtccttcctccctctctttcattggattcccagagctcagccagatgcttggttgtggatctctgcctctggtttcatcaatttctgtataaagtctctatggtgatagtagggatattcaccaatctgattacaggggtagttccagcatcatctccactattgctacttttcttagctggggtaatccttgtagattctggggaattaccttaacacacggtttctcttaaccacatagtggctctctatataaagatttatttttcattgttcttccactgcatcccctcccctagacgattccattccctcctggccacctgtcccagttggcccagtacagctcatctaatatccctcccaagggttatccatgtgtccctcttgggttcctccttgttatctagcttctctaggctgaggattttagtctgtttatcctttgctttatatctaatatccattcattaatgaatatataccgtgtttgtgtttctgagtctgagttaccctactcagggtgtttttttgtttgtttgtttgtttgtttttttttctacttccatccatttgcctgaaaatttcatgaggtcaccattatttttacagtgtagtagtacttcattgtgtaaatgtaccacattttccttattcattcttcagttgaggagcagctaggatgtttctagcttctggctgttatgaataatgctgttatgaacattgttgagcaaatgtccttttggtattatcatgcttcgtttgggcatatgtccaagagtggtattgctgggtcttgaggtagattgatttccaattttcttagaaagcagcacactgatttcagaagtggctgtacaagtttgcattcccaccagcagtgaatgagtgtttccctgactctatattctctctgacataaactttcttcagtcttttttttattagtcattctggcaggtggtaagatgggtttctcagacttgtgattttctttccctgatgattaaggaagttgagcacttccctaaatgtcttttggacatttgagattcttctggtcagaattctctgtttagcgctgtaccccatttttcaattgggttattatgtgtttcggtgtctagtttcttaaattctttatatattttgcagatcagctctctttgtgatgtagggttgtgaagatcttttcccattcattatgctgtcgtttggtcttattgatagtgtcctttgcctttcagaaaattttcagttctaaatacctattaagatacccttcgaatagtgtatcattaatcttttatcaaagcagcttttttttttgcaataaatgaagaacattctagaaaagaaaaccagtcaaaaaagaaaaagcaaaggttttcataagttttctgtccccagttgttaaatttgcaacatggaacttatatctaagctttggaaaacattgtggcactgtgtgtgtgtgtgtgtgtgtgtgtgtgtgtgtgtgtgtgtaaatattggagaagacaaaaaccaattatacatgctacaagatggtttcttcaatatatgtcagagaaacatcacctataacttccccaaaatatggtagcctaaacaaaactgaacatatgacaacatcagtaaacatgacaacatggatagggaagatctcacaatgctccagacatagacaaaaatctagagacatttatcaactgacagaaaaggaatacactgtcctcaggaatgagcaatctaattggtgatccaatactgccttagttatttttgtcttgtcaagacagaaagactaacgcaagttataaaagaattaatttacttaggagcttacatttccagagggtagcagagtccacgactatcatggcaaaaagtatgaagcagccagcagacactggtgcagtagctgagagcttccacttgatccacaagaatgagtcagagaaagagagataactttgagtggtatgggatttgaaatttcaagtcccacccctactaagacactttctccaactaggctacacctcctaatactttccagttttaccagttgcagaccaagcattcaaatatgggacatttgtgggctactatcattcaaacacccacaaatatcagtggtcagtcctgaaattgtgtacatataatgacactaaatggagtatgcagcttgtatttttgtagttgtatttgtgtatgtatgtatgtatgtatgtatgtatgtatgtaataaagaaaaggagaaaacagattacaaatgtatatgactacatgcacaattaaaagttacatatacatcaattcttaatatgcctataactgctgtcctgcctgtcatcatttcacttggaaatttcattggatacagtcaatcagtactattttttctatagagtaacaacattgaattgacctattttcttttgttataaaataaatgatagccaatgggagactacatcagttttataaggaaggttagtaaatataaaaatatgaatttaacatttagtcattctggtcagaaagaaaattattctttaaagattaagtttgcttagtggtttatagatcaattttagagtagaaaaatggcaaaaccaatgcttttgtcatatgtagtaaacattgcattgctatataacaatatacaatgaatactattttcttgaaatcttttggtaagataaatttttcctctcctatccaatcttctatttgtgctacttctacaaaaacaaaaattaaaaaagtaacaatgtatatggtaaaatcaaataaactaactttcaaaacaaataagaatattgacctaggtattttttctatctttgtggtttcaaaaagttttaaagatgtacacatgttatacctttatctttacaaaagtatgtatatataattcggaagaatttgttaattattttagtcaagcaagttgtaaattaaggcttcaaattaaatatgattagaaggatttttgctgttttcctgatggggatattctcctttaaaaataggtgattggaaatatgtggatgaaaagatatcttgggaagttaaaagaactaggtgggctctcaacatccagagtttgcttcctatttcttaactccagatccagagggtcagacacacatgactgacttctgggggcacaagcacatataatgtgcctacaaatcttttaaaaatttgcaatatatttaggaataaaatccaattatatgttgatgttggctctgcattatcacactttattctcggggtgatggtgtcacgtttggaaggctatggactctttttcaggtatagcttaaatggcagagatagatcaccatgggtcttagaaggaaatacttagatcctattatacttcatgctttcagatctgccatgagggagaagctactctcacacctttactgacagtagtgtctacatcacctcgaaaccataatccaatagatctcctgactctcttatactgtgtctgctgtgtgtcatggtcacaaaaacaaaaatggtaaataataattaataataacaataataatgaaaccctacattgatagagggaatgtgattcatataattaaaaacccaaggagtagatagattcaagtttgttttactgtgagataaaaaatggaagaaacacactaaggtcaacatacagtctgaaacagacttagaagcttccccagtcactgagtcatttgttagtgtaaactcaagaatcaataattcaattccttggttttatatttttatttttttgttttttggacatggtttttctgtgtatttccttggctgtcctggaatgtgctctgtagatcatgctggccttgaactcacagagatttgcctacttttgtctccttagtgctgggattaaggtgtgggtcaccaccacccaacagtaactcagttcttaattcaaagaactggatacacttgaggagcttatcagtcaatcacatgagatctgtggcttctgttttcacagtatgtttccaccacttgaatttaaattttgtctagattggtattggtattaagataatttgtgccttattagatttacaaagaaaaatcttttctcctaatgtttttactcagcaaaattaatctatgccctaaactaaaataagttcagaaaattaccatagtgaatgagtgtttggctatatctttgacaaaattttctctgcatgctatgaaaatttttacctgatgagtgaattgtttgccctgattcatttctctcagatggcataatctcttcctatgcatctactcacttaggaaacagaaattaatgtaatgattatattactattttctatttgttgttatttaaattggttaaaaattctctttgcacaacatattaagtgctataattgtgcaatataaattcattagactgatttcattttttctttttttaaactttttaaattttaattagaaagaaaattattttatatgtcaatcccaggtccttctccctcctctcctcccctgttcccccaactaacaccctacctatccataccctttctactccccagggagggtgaggctttccataggggtcttcaaaatctgtcatattctttgggatagggcctagtccaacccccttgtgtctaggctcagggagtatccctcaatgtgggatgggctctcaaagtccattcctatggtagggataagtactgatccactacaagaggcccccaaagatttccaaggtctcctcactgacacccacattcagggggtctgcaaaagtcccatagtggtttcccagctgtcagtctggggacaataaacaaatgttatggcaaattctcctctcatccaaacattcccaagcattatgagatagttctatgactaaagaaaagtgaaacaaaattcttttagttacaggccctttcatgtctcattccacactcatagtaactcaagctcatctcctttattttgttttcatgtacatgtatgtgcttctatgcatgtcatacctggtccctacagagaccagagaagataccagatagtgagcagctggagtgagagactgtgtgttacctgatgctcagaactgaactctgttcctctgcaagagcagcgaatgctcctaaccactcatctttctcttcagcccatccagaaacctttatagttccacttacacaaactcccataagagctgaagtatgatattcatggtttataacattttcatgaattaaaatagatactggtaagaaaagataactaatgaaaagagctttcaaattctgacatgtattattgaatttttgccatgtacataaatgcacacataaacttagcacatactgtattggcaaacagacttgcaaataggtaagtttgatgaaattagtagaagaaattgttatatattttgcacagattgacaaatataaaatgaattttccttgttatgtggactgattctgttcaaaatgctatatcttgaattaattggggatctatctatctatctatctatctatctatctatctatctgacatctatctatcttagtatctaccatctaactatatctatttataatttcttactgaaattataaaatttcaaatttttgagctccttttattttcataaaatttgttatcctaaaaaaagaataaaaactttcctgggggaaactattttagaaagtagtaggaaaattgaccttttagatgtaattcaaatactaaccatctaatctccactactacaagattactaaaattcacataaggactgttacccaataccatatgatgtaatatatatagtaattcatctctaactacttattcagtagcatacaatgattcagaaatcaatctttttttaagaatcttaattcaggaatgtttttatagtatcatctgaaaaaaatgacctttcttggtgatgagatttctcaagttcaattcattagagccacaaaaactctacacaaaccacagcacacgagactataaaacctctaaaaacattcttggtgcagctaagtatagtcaaacccaaactcagtccttattacttagtaagtactatcatattatatataaagatcattaaatcttttccaagaacataaaaaaatcatgtgtacaatctatagttttcctctgagatttctaaaatctaacacatcattgctgagctttagctaagatatttttaaatatttataaaattaaaaacaatcacattttacaaaccaatcccagttccttctccctccagtcctcccatcggcccaaccatctccccatctcaaccaccatccactcctcagagagcatgaggcctcctgtgagagatcatcaaagtctatcacatcttttggggcaggactggggtcctctcctctgtgtctaggctgagagagtatcctttcatagggaatgggctccaaaaatgcttttgtaatctagggataaaaactgcttccactgccagagactacatatacttcccaactgacacccactttcagagtgtctgattcagtcttatgaaggttccccagctgtcagactggggtccttgaactcccacatgctcttgtcagctgtttctgaagatttccccagcatggtattgacccctttactcatctctcctccatctttacaactggattccaggagtccaacttagtgcttagctgtaaatctctgcttctgcttccatcagctactggatgaaggcgccaggatggcatttcaggtagtcataaatctcatcataggggaaaggcatttaaggtagcatctccactactgcttagattcttagttagggtcatccttgtcaatccctagagatttccctagtgccaggtttcttgtaaagcccatgatggctccctctatcaagatatctttttcccagctctgcttctctgctcttcccccaactcgaccttcctaatccctcatgttcctctcctcctttctctttcccctccctccctccctccctccctccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatatatatatattcaatggtttaatgaaaatgattaagcacataggacaattttcataggttgacacttgtttttaagtccaaaattctaacattgggaaattagactaggtgttgtaatcttggaaagtctgaattcaatagtagctttccttggagtcactatgattttctttactttatcttttgatgtcctactgatgtaaacagtatgtagaatacctcttagcctgagtatagcatgtctggcaatagaaaagtataatcctgtctttagcatagttggtatttatcttaagtctgacttgttggtgatacatgaataatataagcatgaagaggggttgtttctttctagtcttccttcccaagtagtctgtacacaatctttgtcagatttgacactttgatggtagatgttattctgtataggtttctcttattggttgatgaataaaacattgtgtggctagtggccaaacaggaagaataggcagggctaccagatgaagagaattctgggaggagtagacagagaggagtcatcatgtgagtgtaagaagagaggacacaagtcaggaattctcctgtaagataagaccatgtagaaatacatatattagtagttatgggttaattattaagacaaagatagccaataagaagcacaagacattggcctacaatttcataactaatacagcatctgtgtatttatttgggatctcaagggtggcaggacactgccaggataacgaacacttttttacaacacttagttaatgaagatttaaagcaagactttcacatgaatataatctaaacgcttggatttctgaatagtattcacagaaggagcctttcagactaaactctactaaataaaatatgcctcaaagagtttttcatcttttactgattggcatgatttgcctaaatagcaataaattgtattgcttcattcaaagttgaaggatgttgtaacatattttctattatactagcagtgttttacagtttgtcaatgcatcctagaacaatgtcaacctgcttcctttttcagtcacatgttatttaattagaactgtcacactcagtcctgaggacagaaaggattcaataagaccaaagcgtgaaaatgcaaaatcgcaaacagcacatttgggtgctagaaacatggatattgagtcagatttagatcaaaaggagagaagacagtaatgttgccaaactgggtttttaaaattttgaatacaactataatattcatatcacttccatatatggaaaggtaactatccacactgtcacattccatttcattttgttttcctcactcactgtgcttccccaattaaagagaagaacagattataaaatgtctttttaggatcggaatgctcggtggtacagagcacttacagctctgtgtcaggaatcttggttcgattcccaacactgtcatccagtggctcaggactgccaaaaatctcagttccagagaatcccacactaagttatagtgtcctctgacaccaccatgcacatgaggcacagaaagtgattcaagaactcatacatatacaaatacaaataaaagaaaaataaatacaaacaaaatactaaaagtatcctctcccacaagattctcctcaagacacaactcaagacactgatgcaactgaaactcttgcccagtgttttaaatcactgacttctgaagattttccaaaggagaaattaattcctactcctcaacatgatggagtttttaatgagtaccttatatagcattcttcttgttcatgtacatttgtaatagctgatgcagggactcattgactcaagattcctgagttttagagtagtttatgagtatttttaaataatgtttaaatttgatgtcacaacaattactttcaaagtgcccatattttacctgcatttctgctctaatttccctctttgcatctccaaacagctgttcctccctcttcccactgatcttgtttcataagcatcactaatgagcctctgagaagtgtgctaaatgccctaaagctgcaataaacaggaagacagcttttaaacttacttttatttgtattccatttaaattttaagtccaaaataaaacacacacacacacacacacacacacacacacacacacacacacacacacacaagatgagaagaaaagattacagaaattaattacccccatttttattttccttttacatcttaaaaacaatgcattttttctatacaagtgcattacattgtgtttaaagtatagtacacatataaaagttaagtagaattaacacaaaatatttgtgcacacatggacatatttcacatgtgagtgttcaaagctagtatttaactacatggaatattctttgaagctggaaagatattcaataattaatattattggctgctcttgcagagaacttgggttcagtttccaagacctgcattgtgtatcataacagtctccaggtttagttctaggggtcaaccaccctcttattaaatctgaaggtacacagacatgcacataaccaacatatccacacataaaaaaataaattaggaggtatttgtttttagaaaaagtaagtatactcttcagatggaaactatattattttgaatatgcacaaaaaatctcctttcttcttagagaagttatatttatttatgtttatccatagttaagtcttgtttatttcatcttttgattcttgtaatctttcaggattcttattgtaagcatacatttacaacaattaatttttataattattctgacaatatctaggcatcctatctttaggatggtctatatggtaccatctctaaccttcacaaacattgtatactgtctaatttttagctaacaaatatatgattgggtacctgaggcaatgactcaggtgtcaaaaagcatgtatttgttacaaatttgttttccagcatgtagtaagaggcttagtgttacctgtgactccagtgcctaggcacctggtgccttgggccatcatagggacggagatgatggagacacaattgaatcagagcacagaaggaaaaggtggatttttagtaaataatgataatttataaaccatcaaaaccttagcaactaacatttccgttttaggacaatgcatatttcagtgaaattgagatcactaagttttctcagattcttgagagacaaaggaactaagatttgaagtctatctatactattactctagagagatacagatatctgaaaatcaatgttaaggtctatccacctggagaattaattgttaaaaccataaagaaccatggatacactgacttcaattttgatgaatttcaggaaatgaccccaaaggatgccagaaacttgccttcagaggagatctgaggaaaaaaaaaggtacttgcagttctagcaggcaatgaagagaaacacctcaagctttgtttatattgcaaatgtaatctgtaaaaattcttgagagtattatgtcagttaaaagaagaaccttgcttctctagtcccttccagagtcctgtactgcatgaagggtaggaagatgcaatcattccctgaacatgagtcaattttaggaaaatgaatttgaaacacaacaacttcattaaagatggggagaaataaggaaaaaaaaggctgtatgtgttcttgtgaaggtgatgttccagtaactggggcctctagcaactgtacaaagcattcaagcatagacaaccttcccacccctgaaatattcatatttgtaaccacacagaagtctaacctgcctcagttcttagtacatgctacatgtccatcttttaacaaaacccagggggttactaaaggcaagatgaaacaatctggagtgtcaaaaaaactagtcaacagtggtggcagagacttcaaaggtcacaagaatcaaaatgaaacattagaaatcaagcagcaggaagagaaatgaagatcatgtttaaagaacttaacagtaaatttgaccaagacaatggcttagtaatcagtgaacttcagttgatgtattaataaaaatgtcttcaagtgaaatgtcaagacagaaaataacagataattgatgaagaatttaaaaatgtatctatatatgtacatatatacatacacacatatacatatgtaagtatgtatgctgtggtatgtatgtgtgcatatatatataattatatatatatatatataattaaacaaagcagaaaaacaacttgaaaaagtagaatccaatgtcttcagaagtaatgattatcattaaaatcacaggtataaaatatttaaaaaataaaacacacaaaatttcaggtgtgtatagcacatttgaagcctaggaaaattaagtttgaagcaacaagtcttgacagaagctgttttgtatatacaggaaaacaccttggtcctttttatgttcctgtcccacaaacaacatgattaaaaaatcagaataaaatatagtgatgatgtataggtttatttttttagcattacctaaaaatgattatacaaatacttacataaaaattttcagttataattaattcaaggtggtttaaatagaactggacatgcacataacttttacaagtaataataattttcaaataataacatagagcctctgtggatttgggtatatgttgatgaaataattcatgttaactgacaatttgaaagaacctagaatcacttgagagataggcttctggtcatacttgttggggagtatcttgattgtattttttgaagtgagtgggaaagccacctaccatgggtggcaacattccctgaatggaattttagatttgaaagcaccgaggtggttattgagcaggaatattcattttttgttcttacctacttttcggtggctccaatgccattggctcctcttactgtgatttcccaccaggatggaccttaatttgaaagacagaagaaatgctttgtcctttgagttcctttttgaagtttattttatcacaggacaggaaaagaaattaagactgagaggaatcctctaaccagtaacccctgtaccaagagatgaatgtataaaagcaaaatttataaaacctgcatatcataagcatatgaacatggagtaaggtttatctcatctgggacaaataatgcaaattgaaaattttacccaattcagtaatctatcaaaagtttatatctccactttaagaatttagaaaaataatagcttaaaccttaaataaatcaaagaaaataagctgaaatagtctacacaacaaatttgattacagatgaaatggagcttgagtgtttaaaaatactcaaagtcacacaaagaaaaacacatcatttgagcagtcttatgcctgttaagggaattgaaacaatgctttgatagggaatgtcattctgtgtgctgtgaatatatgtttctcttattggttgatgaataaatgctgattgggcagtagccaggcaggcagtataggtggagctaccataataggagaaaggaagagagagagttaagagggagatgccaggtagctgctgaagtagaactaacatgctggagcattagcagtaagccacagcctggtggcaatacatagtttaatagaagttgtttaataataagtaagaagtagccaataaggggcctgaaccataggccaaattgtttacaattaatataagcccttgtgtgtttatttggtactaaacagctgtgggattgggcaaaaagtaacctctgttttaaatgcttagtcactctttcctcaaaaatcttaagtgccatgtgattacattgataaattttggaaaaggaaacctcttccagaaaatagaagcagagacactaatttccaattcatcctattaggtcaaaaatcaaagctagataaagattctgcaaaaataaataccatgtattaatataggctagtatacctgatgatataaaaatatacaaaatatgtggtttcttaacatataaataatgagctatttttacccttgtccttaatcaggattattatactcatgaaatcacagaagctgtggttgacattgcaagatcaagccattcaaaatataacatgccacaaagattctttaacaagaccccaacaatatctgtgaggttattgacaattgatggcatttggatgggggaaatccagttttctttaaggtgttctccactcttccactttagagtggatcatcccacactcttttatgtgggcaacacaatttatacttggtgggttattaaaaaaaacaaaaacaaaccactgtcagtgaaagtgtcctaagctaaaggactctatcttagaaaacagaatcctaaaagtgggttttctgtttaccaggaacatcccttcatctgccaggacctcccttagtcttccctcaatatcaaatacctcccaacagtctataagctcaaagacttccattctgcagattgttgtataaaatgtgcttgcttttcccccattttgtttcactttgtctcccacagtggtaaccttgttagtttaacctacaataaacctttctttctacgatgtgtccaagttcagtgatttcatagaaccctcactcacatatacaaattttggattagatggaaaggagagcatggtgatttataatttatgatttgtcaaacttgcctgaggattcagaaagcaaaggcagactcaagctatagagatcaggcaatggtagaacatacctttaatctcaggactcaggattaagaggtagatagatctttgtttgttcaaggtcaactgaccacacaaaattgatccaggccaattttgtatcaagcagagtacagcttcaagggaagctattcacatcttttccttggcatattgcacaacacctctgacacttagaaattctggtgagtttgagaattgtttctatatgccctgcatcataagcaaggtgtgtcttaagcaataggttcttcctttctagttatggcttgcaactaagaacaatgacaatagcctctgttgattggagtatttatgaagcctccaaattttaacacaaagtatcttaatatcaaaatatttcttgattttcccttcaattttttactttctctgattttcaggagtaaagaaatacatttagagtccaaatagaggctacaattctaaacattttccaaaggaattaaattgtttgtgagttgggatggtcatattcttgaagatctcctttgtcagagaatattttctatttcacaaaatttatcatgccacaaattggcttcagtcagtataggaaatgcttcccatccctgaacctatactgatgtaaatgattactgattcaaagaagactgatcatcaaataaaatacacagtattcctaagctggtggcctcagcactgatggaatctcactcttatacttccttctgaaactgtaagatttaacaatgaagtgttataagtgctttgattctccatgattacatgtgaattggaaggattattcttttataattaaacttcagatcatgatttcaaagtacactgcattggtaaattgtcctatgctgttttagctcactggtaagcttgccctagaagcaggcttgtcttcctcccattttagatctaagttccttttcttaggttagtctcattagttctgtgacagagtgaaagagaaaacaacaaaaaataacaacaacaaattatcccccaaataagaacatcttgtcttttcaaacagctagaaggaaagtcatttccaaaagatgttactatattttagcccatgatatgagtgcccatattggcataaagtagcagaagtccagccttgggacgggcattcatggagcatatgctcaatcaggaattccagctgactggctcaacttccctagttagttgccactgaatgctgtaagtacccaatttgatggtgtcatttttttgtggcatgttaccctgcttggacatccctttggggagggggtgagaagaagcagcaccaaggactcaggcaccatgagtcagcgagtagtagagcatggtgcagacccatttattcaggaagttaggccttcctttataccctctcccaaggtcctattagctcaggcggctgactctgctgtatgtccttttctcacaaatttctttttgacagactactgtgctacaaggcaaaataagagaccttaggaatgatgcaaatctctaccatgcctgactctgtcttctctggatgagcagtagtcttccagaagaagaagctgcaaattttatagccatagagattatcaactttcatgaaaaccacaagttatttcctaaaaaatgattcttcatatctgcctctgccacacatgtgttcccatcagtgttgtgaagtacagaccaacttaaatatgctaatttcatttaaatatttattaaggtattttgtattaaatttccctagtaagtttccaaaagtaactgattccatggcaagattttatgaaacgctgccaatcataaattgcattctagatctttctttctgtgccatttatagtctcatcttaaaggttttttaaaatacacctttgtttatgtgagtctgtgtgagggtgggtgggtacacataaccttgcatacacatagaggagacagtagtagttgggtgacttctttatcccttcccacttattcctttgaagtagtgtctttccctgattccatagcaaccaatcttaaacgtaaagttatactttctgtactttatttcttatttaaaaaaaacaaagatgctcttagtcattaaaattagattggcacatttgtattgaaagagaagtctctgacactgtcacaaatctttgattttccctttgtgcattcaagaaacttattgctagtctcagatttagaccagaataaaaacatacaggagtttctatgatctcatcttgtttgtgtatgcataatagtttgaattataaagcaagagtcttggaaattagttcctggtgaattaatcagcaaggagagcaaaggtgaaatttctgcacttgaaaataaaagcttgcatggagtcactgaacgctgcctctgttcatgttaatcatttgtcttgagaattggctagaataattcctatgatgatacaggatgcaaacaagtagctaggatcacagaagactcaccaaaactctaagtctttgtgaatgtggaagaagatactgtgtgtagatgatcctgagagagagagagagagagagagagagagagagagagagaggaggagagacaggtacaaaggttgacaaataatgagtacaccttgctaaagatgtatttaggtcaaacaactatattcagaacagatttttatgttcaatcatattcatttgaatataggtcttattagaggtatctctatgtgacttattctatgtagttatgatatccttgtctctgtaatattataaaagttagaaaagaaggacagttttccagatctctgtactagtcagttatatccaacatcatgcctctctgaatttattcttttcattttaaaaaaacattgtctttaaaatatagcaattaagaaggaaaataaaaattccaaattgttcactagttggatcaccttctgctttacaataattatctgtgtaaaattatccattttgtcaatttcaacattttaagtttttctaaatatttgggttgaaaagagatgactataagccaggggtggcagcacatgccttcagtcttggcactttggaggaagatgcacatgccaaggtgatatatgtgacttcaagaccagcccagttcacaaggaatttgggggcattcatctattacctaaaaggcaacgtgcctcagtttctgtctggaagcttgactactcataccttaaagaaacgtaatcaaagtacaaacctaacctgttgatttccatgtttattcaattcttttttatttacacttttttttctggcttaatttagggttttggtgttgttgttcttattctttcttcatgttgccaacattttcaattattcactatgactattcattgctctactttattcttttattagtttcctttaaattctaagatgctattttgaaaattgagttttgcccaatgggcttactcagttttcaaataattcaagaatttgaggatgctgaatattccacaatcccttttgaggagtttgttagactgtggtccacttttctttcattgtattgcaaacaaatatatatttgtcgctttatattttatgtgtgtatatgtataagtgtggtttgtgcatgtgtgtgcttggtgaacatgtatgatatgcttgtgtgtaggcacatgccacagttcctgtgtggagaacagaacataacttttgggaggtagggtccttcttacatggtctgtgctatgaatgaaatgatatctggccttctagtttcagatcattctcctcaatcacttacctctccatagcaaatatgcatgctcagctgtgcaaccaggttttttacatggattcagggatctggtccaggcagccaggcttgcaccacaagtgattttactcattgaggcatctctctggccttgaattttctttcactttggtgctgctactgctatattttattttagtattgggcaagtgcttcattgtgtagctcaggctacccttggatcctttcaatccttctgacaagtgtagagactttaggagtgtcctagaataaatcatctacatttatacttttccgtgactcttcttcaatctatttttaacattgtttggaatatttttctgtagatcaggagtaacaaactaatagactcaggaaatgtgtcaggacacaggcaggacttgcacagattaaagcctactgagtccctgtacagagaaaggaagcagatacaggttcctactcctaacccataaagtgttacaggtttcattttctttcttttctgttttgctttttgagacaaggtttctatgtgtagctttggagcctatcctggaactagcagagcagatcagggcagagaagaattgtttaacactttcactttccaaggggaaactttcccctactggagcagaggtgatagactcctggggaactaagaagagctttaacacttttctggagcacagaagagctgagctgcaacaacttcacttgggaaatcctcccctgcccaaccagagttgttacactgggaaaacacttccctggagcagaactgtaagttgatacccttatactgactttatggtattccttggattccagctaccaggatacctatccatctgagatgcaatgcttactgagagtcccatgtccatctgtggagtacacaaatgtcttcaggtttgtccttgagattaaattgtcctctctgtatatcttctctattttaccaatgctattgtaccaagcccccatgcacaactgacaccatggtaaaagaatcattcacaggagggaagaggcatgagggaccaggaatattgagtcgggggaagaatagaggatagaaagaatggaagatatcttaatagatggagcaattatagggtgccattataagtttaaatagaaatctggtactggagaaatgtccagagatttgcaagtttgatcccaactaagaatctaagcaataggggagaggctatttcaaatgccattcccctataatgagattgatggctaccttatatgccatcatagagccttcatccagtagctgatggaaacagaggcagagcccccagctaagcactgagccaaatccctggaatccatttggagagagagagaggagtgatgagcaaaggggtcaagaccatgctggggaaacccacagaaacagctgacctgaacaaacagctcatggaccccagactgacagcttagaaaccagcataggacagaacctggccccctgcacatgggtctcagttaggaggcctgggcagtctatggggcccctggtaatgaaacagcacttaaacctagtgtacaaatggacatttgaagcccattccctatagagagatactctctcagcctagacacatgggggatgtcctaggccctgttccaaatgatgtgacagaccttgatgataccccatatatggccttaccctttctatggtgaggatgggatggaggttggtgggggcatgggagaataggagggagaggatactgggattggtacataaaataagattgtttctaacttaaataaaaacggaaaaaaagattcattcagaccttggatcctaataggttggcatcaacaccttccaaaataagaacataaaccacttgcctattttggcttctctagttctgcttctgggtaactgctcttgatcatttggatgtgtcatgccagcaagtagtttttgtatttgaaagcccaacctgaggaagactcggggctccaatggggtcctgaacaccatccactactagcctcacaaaactatcttattgtctttgtgcttagatattctttgcaatgctttttggtgtatctcctactttttgtatttggtaacaggaaattacccccagaatgaagtctgcccttttctgtcctttgagatttctgattcagttcctatttcttttgttttgactagtttctttagttttacagtgttcttgaatctgtggtcctaatttccattcttgcctctgtctccatccttttagtgatcacaattagaacttagttcacagaagctacattgtcttggttattatttcgaaatatagtgtatagtgcccttagaggacagaattgggcaactcatctcctgggactagagctatagatggctgtgagctgccatgttgatattaggaatcaaattcaggtcctatggaataatatctagtgctaataacctcgaagtcatcactccagttcaatattggtcattattgatcatatggttaattttatttataggtccttttttatagtttagaaaacagaagtgctgaattgagaggatgtgtgattgcctatattgctgcagaccctaaattttgaaccaagacttaaatcagacaatctgtcttcataacacctgccttcattttcaggccactttgtccattttgtccattagaccaaaaactgaagaggtgactctccagttaagagcactggctgggcttcaaattccagtacccacatgggaggtcacaattgttggtcattccagttccaggctgtagaatactcacacatatatgcatgcaggcaaaataccaatgcacataaaaataaaatgaaaaaattaaaaatcaaagaaaaacaaatctcatttggcagtatatcccacaagatgaacaaattggaacacattatctctgaaaccaaatctgcagtctctatttttcttgattacttgattgtgagcaccatccttttagctaactacatgagagattggatatattatgattttctctgctattccttactacattctatcagtattccttaatttctgtgagtcttgtgataaaattactttatggacatccatagtaagtttccagttgtcctgcaagttccacggtacttactgagtcttccacacttgtgttagagaagttaccaccaccttatacctgtgtccatcctttccttatcatctgccttaaccatgttaatcctacaggatgaagtaactgcattatatcacaaatattcaggtgttttacactatttttcctctgtactactgtcagctgttatttgacagatgtttgagagtccatatttataatttttgtctacaaagatctatgcatatataagcttatatgattgtcagtgaattttcttgttcctagtaaatcatcttcatttatatatgagcatccttcattgtttcaatatatttatctcttataaaacaacatatagtagattaactagaataataagttcttcataaagcacagaattgcatgatgaaagttaaaggaaaataaaggaggggtggaataagaaggggaaagcataaaggtcacttaaaaaggagaaaagtaagagaagtatggatatacacagaagagtacagagtatgccatatgcaagcatgagaaaagtaacccattcctcctgaccatctttgaacagacatcttggaatacctggattgcaacagataattagcaaagtcagggaaattttctagatacctttagagtttaaatcagaaaagatggttacatctttataagcatatttcagaaaggatgattttctctacaaattcaagtgtgttattaaagtcagttgataagaatttggaatcaggaacagtcctatgctggtttcccagctatcagtctgaggtcctcctctgagcaacctccttgttcaggtgagctgtttccatcctggtcctgacccctttgctcatcactcctccctctctgaaactgcattacagagctcaccttgttgtttagctgttagtgactgtttcagaccacctgaggatttcagtttggaggtctgggcaatctatggggcctctggtagtggataagtatttatccctagtacatgaaagactttgggagcccactccacaaagagggatactctctcaacctagacacatgggggagggtctaggccctctaggccctatgacagactttgtagattccccatagaaggtctcaccgtccctggggagcaaaaaggatttgggataggggttgggggctcaggggaggaggggagatagaaatgtgattggtatgtaaaagaagcttgtttctaatttaaaattggtattatttcaattattaaaaataaaataaacactatagcatagttcagataaaaaaaaaggaaaagaaaaacaaagcaaaaacaaaggaatttggaatcaggatatccaaaatatacagaattaaagcccaacatttggcattaaattgaaatgcagagcacaatcaaagagaagctgttagaaaattacttgcatgtacatgagggacatgtaaaatgcattttactggtgtttcataaatgggggaaggctgaagagagaagacaatttaaaccttatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatatatatatatatatatatattaaaactaattctatatttcactgaaaaattttaacctagtatgaaatattacacagttccttgatgacatggggaacctgaaaatgtatatttagggtcaggatccacaaatacatattttaagttatttatacactgtaagattatgtatgtgaccattggttcttcagacttaaagtgatttaatcctaagaacaacttctcacacctacagagtttgcgctgttaattgacacagacagtagagtcatttatgcaatcaatgaacagtgtcttttcaaagaatatgcttctgaagtcagtaatttgtatggaagatctttgcttctttcttagattctatttggacattgcaatgttcatatacattttctcacctttaattggaaagtttttagtttagttaaacagtgcacattaaagtacttactaatctttagtgaaacatttttaaatatatttattttattttatgtgtatgaagatttgcctctctatgtgcatataaagcatgtgcattcctggtgcccaaggaggacagatgaagatgtggataccctggtacttggttctggggttacagacagttttgagcaactctgttgatgttaggaatcaaacctggatcctttgcaaggacataatttccttaaccactgagatagctctccggtccattttgaaacattttgaatcgactaagtttattttacaactacaacaaccaaagcagaaaagaaagggatttaaacttctcagatttgggatttgcctcatttagcttggaggtaaggatccattttatctattaactctatctagttttcaagtaggatgttgttaaggtaaagtgcatacattcagcaaaagcctagataaaaaataaaagtttatcgaacattaagagtttgaaaatagcttggattaatgatcaacatatcctttttcagatgttttatttaccaggagagtctcataacattttatcttttattataagttattatctcaaatcctcaatggaaataattgatagacaataatttgatgtttttataatagaaacaaattcctttgatgactaaaattacagaacataaataacaaaggcaaatgattagaatcatctaattgtttctatttatgcatttattttgagagtcagaaaaagacagctaaattgttgatatttatttaaatccagggaagatagttctgattaagaaacaaacagttgtatcaaagataatcaaggaatattttaaaccatagaacaatatacagcatggcaatatagttcaatgattatgagcacttgctgactatgctgaggatgcgaacttgattcccataagtgatagagtgcctnnnnnnnnnnnnnnnnnnnnnnnnnnnnnnnnatctgacttacacagagtatatgttagaagttagaggggagcatatggaaaggttggttttcaagtaattttgactttcacatccatgaaaatgctatccctaatcctgatagttttagcatttaagataatgcaaagtactgatgtaccaaaacgcttcacatggagtcccaaaagaatgttttatatattataaacacacacacacacacacacacacacacacacacacacagacacacacacatatatatcctatctcccactaaacataaatgctccagatggtttcataaaatctttgtatcatatatgtatgtgtttgaacatatgcataataatggtaagaaataacattaatttgtgtgtactggtgatagggactttactatttagctttcacagtgggtacatgttgactaaaagaaagacaaagacacatgcttagaggccacataactctgggatctttattttaggcatacaatcaatcatacccattgatttttatcatagtacacacttgatgtgaaatagaaattttaaaatagcagtgggccacatgtctgttccaatcatatacaggatttccttgttgatgactgttggatagcaggaacagctgtaagacaaagagactaacacctcatttttctttaaacatttgcttatagtggagtataagtggggtctgtcgtttatctatttacacaaagaaatataatggcagacagaaatagagccatcagtggtttggctacattttcagttttgaattagtaaagatgcttgagttgtgtatatctccatgacagaagagaatttttaaataattattcgttcgttttcatattttcaaatccttacaatactgtgccttaagaaagatgtgatcattatattcattttatagatgaaggtttgaatatacagtgcagttaagagactcacacacacctggcaaactatgaacatggggcttgttaaatatacgaacactattctgtaatggcttttttttttcttttctattatagcttcctcaagattctaaagtaattcatgaaaaattccatttccatatagtgaaaataacagccaacccaaagtaatggaacagcaataaacactgacacttatatattgctatagatttccccaagcacttcaacaaacattaaagactataacattgctaaattgttggtcgcatagatttgttactataagcttacccaattctcagctttgacaggaaaattaaccttgaagccagccagtgacaaaagctctgcccttctgtgataaagtgctgtgttgataatgttgcattgtagacacacatcaatagctagggatatactgtgaacacagtgtgaaatcagaggtaggtaaagagttcacaccctttgctatggaggagacagcaaccccacaaagcaatggctttcattctactgccatatgcaattttctctgggaattttaggtgatggaaaatgataaatattgaatgtaatatctgaataacaggcaaatcatgaaacaagtattagcagaaaatgctactaatactaacactaaacaagacattagagtaatgctttgaataaaaaacaataatgttaatgataatgatcacagttaccattgttattaatactattatgatgactcctgttataatggcatttaattatttattaagggtttgctagagactttgctaagcattttcacataaaatatattactagattgttgagacagtccactgatttgcatgtaaacaactttaaaactgaaatttttagtggagttaaataatttacttaaagtaaggaggaaagtggtgcaaaatttgattaaaaccaagttcatttgcctgtgactggagagtgttctcaaagacctgaaattatggaaaagcaaggtagcccccttgtatgctacatgccccttcgagttggctttccctgagtacttctgcctcaatatcctgaatggaatattaggcagggtgcctgctcacccttgatcactagaacacagctttataattgaccttttttctttgcaattggctgatagagatacacatatattattacttacttttgaaattgttcttacaaaatatccacaaaagcaacgtagctgaggtttctattgctttaatggaacactatgactaaaaactatgttgggaggaacagatttctttcacttactcttccaatttcattatagaagccagccagtgtaggtcaggtcctgaagtggaagccatgaagaagtacaacaacatattcctttctttgcaagcctatctagaggctcacatgtaccccagaggtcatctcctacatgatcttaaatccagtcatgttgactattaataatcagtattactcattacaaattttttgttcattagtcaagatgcattcagtctcattagactagtcaactcctccagtgtctttctttctttgaactttcttccttcctttctttcttccttccttccttccttccttccttccttccttccttcctttctttcttgtagcatttgaactttaaactgctaacagattctttgacatatcactaacgcaacaagtatttcctgggaatcatccattcaaaagaagaataaatgagctgggtcctagaattgggtacttaaatgatattagaattaagtcattatttgtaaaaatccaagattttatgggtaccttgaatgaatcattataattagacagtcttgccttcttgcttaccattatgataataacaattttatattcttatcacatggctttaatttatcccaatttcacaaccaatggaaaacctgagaatgttttcacattgtaagtagtttattgtcatttattaatgtgctaacactactttcagttccactgaactttatccacaagcttggattccagaagagctagggagtttattcaaagtggcagaaacatgagaaaaatcagatggatttatctcaggaagtttggtgcaaatagtgactgcagagtaatctcaaggagttgaacttacagcaatccaaccactatctttggacaacttgtcaaactttaagttattgcaatagttttacaacatatatttctgcagtcaagcttcagttctgatatactgactatgagacccaataactggcctaacatgaaattatagaaatccatgaaggagcacaaagtaacagttataggtgagaaagtagtagaggtatggcatgtaacttgatttttccatttcccactcacttttatttttcctgtatatagagtatcatttacctacttaatctcttcttactggattcttagttcctaaatataagaaaacttaatgttcagtgttaaaaaagtatcaccattagtaaatacatgagttttcattttcctctataaaagaattaccatcaaaaaacagagaaaatctggaatccaggaattgtgtctcagttactttgtgctgtgaatggtcctttatctaatggaatatttctgaacacactcttgagaagtgaattgccctctcatgatattacgtaaaactgaatgaaaagctaagtagacttaacattatgaaggatgacaaattttcataataagaaataggaatgtatgatatgttgtgacacaaaaataattacagtgtaaaaatatatttggttgtaaagattgtgatacagggagaaaataacaaaaataactaagttgtcagaaaatgtagaaggaaaaagcaagcaatgtatactgttttatttcaagagtaaaatgaacaatagagaatcattgagccaaatgtattgaatgggtgggagcgaaccaaaagaaaatagataaatgggaagatccatcaataggagcacaatctcgctgttgactgaggccctgtgtaaaaacaaacagagaaaatagtgttaactttctaactttggcgtgacatataaaaaaggcagaaagaattgccataatcatgtcttcagattgaaagaaatctgactgcctatcaaatgaaaggttgtagtcttgtgaaagatttgaggtctttaactcacacacttaaactcaagagtacagattatactatctagcacagtgagacacacaatagagcagaagcaccaacaaaatcccagttgtgaaatctgcacttctttgagtattgtattacaagtgtgtatgtgtgtgtgtttgtgtttgtgtgtgtgtgtgtgtgtgtgtgtgtgtgtgtgtgtgtgtgtgtgtgtaagagagagggagagagggagagggagaaagagcgagagagtgagcgcagggtgaaggtgatctgtgccttccatttgttttgcagatatatatatatatatctgcaaaaatatacagcatacaaattcctgggccgcacccttgatcctgcttctaacgagggactgtttgtcgacaaggctgccaggtaatactgatgtctgtggttctatacctcaagccagttctttcttccctatgttctggaattaaattcagattttcagacttgattgcaaataccttcactctttgcctactgacctttcccattgaatatagctatgatatttgtacctaaggcaacgtgggaattcctgcaaatacaatgactggtctttaattgtcctggttggaggtatgatgtagtccatgtaggacttcttgcaacaatccaatgcataggttgatcctaaattgagtacaaggaccaagagaaatgcatcattatattttcataatgcaaatttaaatgcaatctagattacataatttttatggatttgacacgcagcaaagaaaagagatatatcatacacaaatggatttacttagaaataaattatattttatgtgtatgtaaagcaatattctctcatcgtttaagctaatttgagaaacaatagcagtgataaaaagtgatatccacctcactggtttttatggaaactataatgcatgtaaaagaatgacataaattataacataacttgttttgttgtacaagataatttatctcttttgataactatcaggccatatgataaaggacatttttatcatcgtatcttgttctttgatgaaaaggagtatttaaattgtactgcagtctagctacaattagttaattaaagtagtatttcttctttgtgtatatgtgagagatagataagtgggtctatgtgctagtcacaggacaatgctaggtgtctccctcagttgctctctacactatttactttcgctaaggcacttatccctggatttagaatttacttatttggttgactgtctgtcctgttagccagttctggaattagaggcagatggttctgaccctagttattacctaggtgctgaggatgaattcaagtcctcatgcttgtgtagcaagcactttatggactgtgtcatctccttggcctcatggcagcagcctcagctttcactattgactgaatggaaggacttaactcagcagatgtctttcttgtggaatcctagaaaagagctctaaatttttattttcccttgcttgcattatatgaagatggcagcatattctgataaatatgcaaccaaagagaggtgctgagttaacaagaagtgcaccagggctgcccttcccagatcttactgcagtattaaggtttcttggctctattaatactatctcatgatgtgtgattaagtggctctgtttcaagattttcttcaagcttacacagcatgagtgtcagccttaccagaattatgtaagaatcaggtaatttgcgtatcacaacactgatattctcggctgagtattacagtgacgcaattatggatggcaacaggcagctaaagagatttcataaacttcttaattcttttgtaaagatttattttactttttaatgactgtgggtgctttgcctgaatgtataggcacgacttgtatgcctggtgcctgcagatcctggaagagggcctcagataacataaaactagggttagagatggttgtgagctgccatttgtttgctggaaatcaaaatcaagtcctttggaagactagacagtattcttaacctctgggcctcctttccatcccaattacttgtcttttttttcacatctttgcctcaatcttatttttctcttattgacattagatttttctcacataatatactctgattacggtttcacttccctcttgtctccctagtttctccccacatcaccttctttccagagctatccccattctatctctcatttgcaaacaaacaggcttttaatggataataataacataaaacaaaacaaataaaagaaaaagaagcctaagaaaaaagcaccggaaacatatagatgcagatacactgatccttacaatcaggaatcccatgaaaagcaaatgtagaagctataatatatacaaaaaaagaaccttcaggataaaaatagaggcaaggaagcttcaaagatactgctgttatttttgttttcttttggccatatactgctgtgcatgcaacctacccttaagagtagtttgttcctccagggatactcttcccttagagaaaactaaattttcatttgcaagtgtttatgaattgaaagtagcttctgcatttacaatgtccagttgaatttctttagtcttgagaaaatgttgaacagtaacttaggggttgaagagtaaaattaggagcatttttgaacatctatatgtactgttctgagtattctcttgtctatattaggctgttttgagatttcctctgccaaaggaattatacaattctcttcactacagcctcaggcagacccttgggacaaggtcaaaaaagagcgactttcctcaaaagtatctttaagcatgatcttaaggcaacatactaaaatttttattctgaaatctcttgagacaggcccctgcatttcaaatattccatgatcctactagtatgtcttattaagtcttgtttaaagcctttcactgttttcttaacccaaagtaccaaaatccaaattcctccaagtagaaacattgcaggcctatctcgaaaataacacaatccttggtaccaacttctctgtctcaggatttctcttgctgtgaaatgataccatgaccacagcaactcttaataaggaaaacattcaattcgggtggcttacagtttcagaggtttcattcattatcatcttgtgacatggtggcatgctggctgacatggtgctggagagggagttgagcgttaaacatctcaattcacaggcaacaggaagtgagctgtctgtgtccatgctggacatagcttgagcacaggagacctcaaagcccacccccacagtgacacaatttctgcaaaactatacatactccaacaaagccacacctcccaatagtgcctctccatatgaacttatgggggggcaattacattcaaattaccacacagggtattttgtttttcattgctacatacatcaggctgcctggttccctgcataccagggatacttctatctctgccctccatcttttcataggggattacagggatcacagacaggtgctactaattgtgaatttatatgggtcctgggcatctgaccttaggtactgattcttatgtggaaagcaattcacatacagacccatttccatttgttctaacttgtaacttttgatacagagtaaaaactggggaccaaaaccacgaatctagtgaaagacagttgagtgttttgaagtgtatgtgtacataggttgacatccttattagctgtttcaaatatcaggtagttggtacagttgaacttttagcattctatcaagatctgcagtgcaactctaataaaaggaggtcagattcactcaggtcatagagattccaacaacaaaacagtcaaggacactgcattaccttactttctattgctgtgataaattaccatagcataaagcaacttgaagaatatagtgtttatttcaccttacagtttatactgcattatgaaggtaggtcaggttaagaacctggaggtagaaactgaagcagatataactgatgagcaatgcttatgagcttgcaaaccatggcttgtacaacctgatttcttgtaccacccaagaccaggggtggcactccccaccctgtgatatgggtcctcccatatcaatcatcaattaaaagatgccctaaagatttgcctataggacagtctgatggaagaattttctcaattaaaatttctcttcacatattactctacattgtgttaagttgacaaaaattgctaagcaacagagatacagtagagttgaaagtagagttgaaagtgtgagggatcaactgaaaattcataacctctgtaggttggacttagtggtttgttattgcagcttccaaggggagaggtacaacaaaagaatgaaagaagctcctggcttgtgacttcagagagattggcacatgggtgcatagaaaatttggtctttaagttaagtggttgataaaaatatgaattttttttagagcattaacctgccactcgtgaaatttatctgaaagagaagcatgatacaaatgctagtttatcagtatgttatttgacctttccaacaaaaagcatatctgtaccaaaaatactaaatccatttaatatgaattccctgaactatgggcaccaataactgagccatattaatgtaagtggtcaaaatttgcaaattttgctatatgtgtttattaagtagtaaactattttaaggtataatttccttttatattttttccaggatccatgtgtttgcatttaatcaagaattgccaactctaactgaatcttacaaaagatatgttcagttgagattatgatgttgccattttgttaatgaactcatccaattcactaattaggacagaaattcaagtattatgccaccttaatattttttatattttatgttatctactgtataaaaatcttcaatgtacacatcaagaaagggcatttttggatgtcagcactaaggagaacctggacatatgccttcatccctaacctgaaagctattgccaattgataatacgaggaaagttactttctccaatgaagtctcattgggtatgcaaaacacatttaagggagaccccacacccagcagtaaatggccaatacaaaatggatataaaagtatttttagagatgttttgtctcatattgctttgcttgggcacttcttttccaagttattgttttttatttaaaaagaacatgtttagttttatatcccaatctcactccttctcctgccctccacccttctcaccctgatccactcctcagaggggtaagaccgtccttggggagtcaacaaaatttggcataccaaattgattcaggatgaatcccctccctgctgtatcaaggctgagtaaggtatccaaccatagccagtgggctcccaaaaagccagtttatgtccttcagtacttttaaaccttaattgctgatttttcagttttataagttttttgtgtgtgtctttgtgtgtgtgttgtatttgtgcatgtgtgttttgtgatttttaattttttgttctctctctccctccctccctctcctggtatattctatcattggcctgttttttttcaaagttgaggaagaaagcttgaaattggatgggtgtatggggactgtctgagaggaaatgagggagaaaaaactgtgatcagaatatattgcatgaaaaatattttcaataaaaagtttaaaggatacagaaacaaaaagagggaatgttctggatatttttctaacaaattacatattgtagaagatgtaatatttccactgttcttcagttttgatggggcagatataatttatttgtcaatgtagttgacacctaacaaataggcattaattttaattctgcactgtacctgagactaaagtgcttattctacactaagaggagagagcaaattaaaactaaagacaaatgagttaaaagttaaaagttaaagacaaataagtcagaataaaaatgtattgattgccaccattccatgtgcaatgctaatatcttcaaacctgtgccaactgccctacaattacatgtctgtattttaatctctaagagattcataactctaactggaaacaatccttcacatatcctacaatctccttccccccttgataacagacttcagtcacagaagcttattgttgcaacttgcttgaaagattcaaatgaaatgacacattgtgagcaaccccttgttcaagtcagctgtttctgtgggtttctccagccaggtcttgacccctttgctcatcattcctcgctctttgcaactgggttccagaattcagctcagagtttagatgtgggtgcttccatcagctactggatgaaggctttatgacataaaactttattttgcattgttacagaagttcataacttgacaaattattaaatgcttaagtcctaacatctccatataaatttgccttcccaaatagtcctcacctacacttgttgcattaattgtaagtgattatgagacctagctttcccatattctgaaagctataagagaaagtggaagcattttaaaattattttgatgagacatctaaataatggaaaggtttgcaaacacatatacagtgcataaccccagccctagccttaaatcactcttccattgctggtagtagtacaaacttataaaaccacttagaaaatcagtatgatggttccttaggaaaatttgaatcagtctaccacaatatccagcaattccactcttaggtatatacccaaagaatgcacattcatccaacaaatacatttgttcaactatgttcataaaaacattattcataatagctagaacctggaagaaaactagatgcccctcaactgaagaatggataatgaaaatgtggtaaatttacacaatggggtactacccagtggaaaaaaaaatggaatattgaaatttgcaggcaaatggatggaactagaagaaaccatccttttggaaccaattctttaagaaagtcatttaaaatgacagttttaaagtcaaaaataaaaggcaaaagtaagagaagaagatacatcatctaataaaatacagcacaaagaacaatgcatagtgaaaatagaaaataccaaatctaaatcacagacacattatttaagtgataatcataacatgcagatcaaaataatatgtgataacaagaataataacaacactatttaatatttatatgaaccttaatacttgattggaactatttgcattcattgtatcatttacctcaggactgcttagtgaaatggttgtgtcattatcaattccatcttaaagagaagatggagacagatgaaaaaccatgtaaggagtggagcagggtttgcaatgccataaaagatttcaatctcatgcagcatgattcaggaactgaagagaaataatttacccaccccaagcaagagatgtataatcaaacaaaaattgtactagagatggaaaaatatgtcagtagaaacatatgatttaatttaaaaaggcaggggcaagcagaacctacaactcaattacatgaatatttagatcttcaatgaaataattaaacattctaaagttaaaagaattacatcatagatatttaagaatgagaagaatgtagaacaataaaatgtagaaaatttattattatacatttatcatataaaataaaaaataaatatgaagtctcaggggtatttttgatttatttaattataatgtacacaggttggattcagaggatgctcagcatataccaatccacttcccaagaattaactgtaattatgaaaatagcatactttaatcctatctttctcctttcctaactgttcttggtcttccctatctcccagcttagccaacttcatgttctttttctcccttgtactttccctgaccaaaaaaaaaaaaaatgagttgacaacagaaacctaaatagaaaacaaccaataagcaaaagaaataaataataaaccatatagaaacacacacacacacacacacacacacacacacacacacacacacacacacacgtgcacacacacacacgctcccacacatggaatccactgtatattggtcatctgctcctgactgtggggactacactaactgtggataaaagagtgagaagtcggaaaactgtgtcctaaataggatgtcttcctcaaacccctcgatagccaaggttcacgaatctatatggaagaagaaagtgaatgattttatgaaccagaagttgtagatgaatcagaaaaaagtgtcatccagacacaacaggccggatacacatattaactcagtcactgtgacagcacataccagacctccacaggttccaacctagaactgtaatttaattgtaacagaattataagtggaatcactttcagtttgtgctcatttaggatactgttggttatggaattttattatataataagagctatatagctcttcttgaattcagatatgttctttctatatttgcttagagatttcatcatcagggcatggtgaattatactgaaaatattttcaacattgtctgtcaaaaatcacatatttgggggtgttcattctgctgatgtgatgttattatctttatgttcatctaatgaactatttttctatttctatggcaatgactacatggtgatagcatatggacttattatttgtttgtttgggggaagggtgtgtgctttggggtactcaggtaacacagcacatcttttgagatcagaagacaacttctgagcctggatttcctctttccatcatgttggttgctgagataacactcagggtttcagacctggcaaccagtgtctttactcactgaattgtctccgtgcttccatataatcttggagtgtgttgttggctttgattgctaactctatcaaaatgtttgaatttatcctcctataggttattgatatggtgttatttttgtcttgatgtctagataccattggcatcagacaaactctagactacaccaaaagagttccccttttggttcttttagaatagattgaaaatacttagtgttcctgctgtctagagtttaggaaaaatctatcactgaacaggtcaggttcttgatttatttttcttaggaaaatttattttgttcctatgggggagtgtggtatgctgtttgtggtggagagcatgggtgttgttgcacttgtggtagtcaaagaacaactttcagtaattttttctttctttactacttgttgaagtagtatgtgaacttctgggtgagtcttaaaactctctgtggtcttcccaaagttctgagactgcagatatatcacacatatgactttatacatggtttctggggattgatctctgaccctcaggtttttgtgacaaggttttttatttgaaacatcatgccagctatcataaagtaatatttgttatcagttcaatcatgacatctttgtttggagtatcctttctgttagtttataattattcaaaagaattcccaacgattttctagatttctatggtgtataagatgagctaatcataccagttaacagaattcctactctgagagtgaccatattcaaactcattccaacagcacaaattttactgtctaatatttttatgtcagtgagtaatttctgtttacatggtctttacttcaacagtttgatggatatacctcttacccatttcttagttgttctatccagagtgggcaattcttgtcattcctaacatgtttcctcagaagcatatcaaagtttctctcatatgctttaaaaaatacgcaggaaaatacaaccatgtgtgcgtgtctgtgtgtgtgtgtgtgtgtgtgtgtgtgtgtgtgtgtgtgtgttcaatttgtgaaagaatggcaatttttttatctggtgatttttgtaatagaaacatattaatgctatcaaaaataagtaccacacattccactctctttagaatggagagtatgatgtaacaactcaggttattgtttctaaaatgaagatgttttagatatgaagccatcagtcagaagatttagtgacactggagatatttttgtagactgtttaagaatgaacatctgctaagacaattgcaaaattatgccaattttgaaatttagctggcttgttctgatgttgaaaatgtttaggaagaggacttgaccatgtgtctgaaggctgatttgctagataggtacaaaattttagaatgtctaaatacttcatagtgttatttctaattacttttcaacatttagtccataattgaattttacattaacttttgctttgaagacttgtgttaggatatcacttaccttaattattatttagtagctcattagatcttggcctctgatttatatgaaaatatttaacttatgtgaaccacattgctaccaatcatacaatgcaacaaatatttgtaaatataataaaggatgaatagtcagtcattaaatcttctgattattttgaggaggaatataattaaccatttttttatctgtcagagacaaggccttttatgaaagtctactcatgtttttattgacagtgaattccttcggtgcccttcagccttttcactgccctccattttcaaattattccaggattttagaatcttacagaactgtcagattgacttctgtgttcaaaatggtgcatggcagtacaataagcaaacatccaaacaaaaacaaaaattcaaaatttcaaaaaattataagatttaaatactataaaacattttgtttatcttccccctttcttttctccttccaatactcccatgtcctttctcttcaatacatcccatgatgccttctacttactcttaattccattgcttatttgtcattgatatatgtaaccatgataatattacatgtgcccatcccggctgggttcagcccagccagagactgtcagccaacaccagagtccctttctctgcccatgggatgagataagcttggcctatttctggccaaacttgtggtaccatgttcagagacacctgaggcctggggaatgtgtgctgtggatcccatccagcccagccagagacttccagccagtgccacagtccctttctctacacatgagacaaggaagaggcgagccaacagagtattggagttgcttccacacaccagaagggaaccttgggtctgtgcctaccaggagaggaagagaatccttctgcaaccacaggaagaagagatgggaagaagacaatataaaatcatattcaacaatagaaaaaccaatatgtcatcaccagattctaccacagcaagatctgtacatcccaatgaagatgaagcagaagagaagcaccttaaaaacaacttgatgacaatgatagaggccctcaaagaggatataagaaaatcccttaaagaaatggaagaaaaaaaacaaacaaaaataaatacaagaaatcaacaattctcttaaagaaagccaagtaaaaatcaatcaaacagatgaaggaaagagatcaagacctgaaaactgaaaaagagacaataaaaaaactgagggaatgctggaaatagaaaagctggaactacaggaactacagatgcaagtataaccaacagaatacaagagatgtaagagagaatctccgttgttgaagatacaataagaaaaatagattcatcgaccaaagaaaatcttaaatccaacaaattccttaaacaaaacatgacaaactaaagaaacacatgccaaagaaagtacaaaaaagcttacagaaaaccaaatagaattgaccacaaaaatgttacctcatcacataataatcaaaactccaaaacatagagaataatgaaagaatattaagagcatctaaggaaaaaagtcaagtagcatataaaggcaaacctatcagaattatacctgacatctccatggaaatccagaaatccagaaggccctggcaatctatagggcctctggtagtggatctctatttttccctagtacatgaatggactttggtagcccattccacatagtctagacacacagaaaagggtctaggccttgctccagatgatatgactctgaagatcccccatgaaaggcctcaccctccctggggaagagaaagaggttggtataagagttaagggggggcaggggaggagggcaggtattgagaacttggattaacatgtaaaaactcatttctaatttaaaattgttcaacttacaataaaaatgaaaactctaatattatatgcaaaaatattttacatacattatatataatatgtgcataaatataaacacaaccttgggagtttgtttagatttgcttgtgtgtatatgattacagggatgtccacttggtactggataaccaattcaggggtccattcctagaagaagccaattctcctctaagtattcattagttacctgttgttctttgtctagaggtgggatgccataagatttcccttactgcattagaatctcaactgatattaccattgctcaggttttatttttaagtattaaattgtattgtcatatcctttaagtgtcatgagcttaaattctagtcatttcaagaggacagactctcaaagcagatttatttgtcttcttggtatgacaactttctacccctcttacgctttccatgatgttttctcagcctaagttatatgaattttattatggaggtatccagtgcagctgcacaaaccacaatcagttgacctctgcattttgacttggtgtggttttctataattttctcattctgccataaagggaagcttaggcaatgagagacaagagctactcttgtctctgtatgaaaggataagttttagaatgcagttaggaattttgctgatctaaaagtggcatgggttctctaatccatgagcctgttgttgcctaggtttctagtgtgagacatcatgtcctccagttaaatagacattatgtccaattagagaggtgttggttactcacaaatatgaaggctactattgcatcttaagcaaaagcttgccatgttagtcagtactgtgattcatagttatcaaagttgcttagggctatttattgcttctctccactggcaccttgtatagagcagtcaaaagctaaaactcagtaaggagcttttagggcagatcctgtcatgtctttcatgtcctgtgcaaaagtgtgtaatgtctccagaaataaggacttacttactttcaacctatgagaggcaacaaagaacattgacaagtgtctttgctattttcaggctctcttgggctactcagaaagaaatttctcaaatggcatacatatatatggcatatatatatatctttcatatgatgtaaatttattcaattataaaaatatgatatatttttaattttgtattcttgtttgtgaaaaatggagtagagaaagaatgagtgtgtgcagtatgtatgaatcccaaagaagaccagaagaaagcatcaaatctcttggagctgaaaatacagtcagatatgggctagccaagttgggtatcaggaaccaaactcaggtcttctggaagagcagacagcactcttaatcactgagccatgtctcctggtcccagttttttagtatacaaatacatataatatataataatatatacactgtacaatatattatacacacatgcaaatgtactgattccatattatatttaattaatatgtgagtagaagatacagttagatgatatactggaaggtatatattatggttaaaactgaaaacttttgttgaatgtatttgtctcttacctcttctaccataaactcaagttgctacttgtcaataataaattataagttctagcttacaatgttcacagtgatcagtttcttaatcagccatgttcacaacttcctttcttggattctaatgtgggataaggccttcaacacagcttaaagtcaccatatgagcctttcaaatgacattttaaactgtccttcatgtcaaaagtcaaacttactcatccttcacataaaggcatatatagatatgttgagatgactcaacaacccaatgataggctttctatgagcgataaatcccattttatattatgttaaaattttatagggctaatttactattaacagacaggaaactattttaaacttaatttcctactgcatattgaatgtgcataaaaaagaaatatagcaactcataaataaagtggacataattgtgggcatgtgatttaaatacactggtcatctacattctccttttgcttagcatgctattttcttaccttctctgtaggttactgacatattttaactttagtatggccatacaaaagtctatgggaaagatttaagttaatcattgttttaaaattaactttctgtttttcttgatttatccacaaaaagaggaaaattcagtcacttccacaactggacttttcttctcccaattatgtacttccctttttataaaaaccactttttgtgtgtgtgtgaaggaactgccatattgtgttgactctttagcttgaggaatttgcaatgtgctgtacatttctttccacaggggaacactgaccttcagtagcaacaaaggttagagggagaaagatgaagtctaggtaatctggaaaggaagataaacaagaataatttcataggacctcagtctttctatctgaagtaactgagttactgtcatattccttctttcaaacacatacacacatactcaacacatacattgaaccttaagttttatcataacacaataacaatgcattaaatgaacattatttcctaaacctgtgtatttcccaactgcatctaaatgcccattcttatactcacagataagtgttccctcatcccttacaaaagaatcttctttttgaagtatcagaaaatatcgaacacattcacaggcagttacaatgcagagaacaactgactttgggttgccccatcccaattgatacatcaacagctcaagtaataaacataaggctgatggaacatcatagaagagggagcagaaaaattataacatctagaggaccagggcatcttctttcagatagaattttctacatacaataagaacttaaactcatgaaattttaataatatgattatctaaacaagacctgtaaaatgacaacaccatttgacatttcaacctgaattgggaaaatttcacattgccccatctctggatgaagacctaaaaacaattaatgagtgctaagaaaggggtaatcagttttccccagggataagccctctgatattttatctaatctaatctaatctaatctaatctaatctaatctaatctaaagtggttgggtctaaacacatacccacagaagcaacaccaaatggagtcagcagtttgtatttatgtacatgtatccacatctgtgtgtgcttaccaagaataattaaatcaggagtttccacgagtttgagagtgggtgcataaaatgggttggaaggtggtgaaagtggagcagaaattatgtaaataccatacaatatgtagtaaattctcaaaaatgtaaataagtaaaactgagtggtgtatcaactaagctaagacttatgatgaagggtctaaaacagacaagtaaaaaaaaaatcataaaatttagactttgaaatgtttgtatagtttaaagaagaattaagatgattaaatgcatacataaaaatcaggagaggttagtatcacctctgtcagttatcttataaatttaaaattttgcagaaaaaattcttcctgttttgcaattttaaatctgaattatttattacatatttgtgcgccattttcaattccataattatacaatttaaaattattaaatgaatatagtagctatccccagacacggagaagtatgtcttttactaagaacaaaagttcagctaatgatggaatgcagttttgcaaaataatgtaaaagatagaggctctcaactagaaacaatgctatatatagtcaagtcctaattatatgaatttgaaaagtgagtcccatggttatgaaatgctcacacttaataaatagaatgtaatgtatatggattatatgcatctgggtttataaatgctgacaataagattttgaactctcattccactgttataaaatacatgaattttctataaagtcgtgtattgaggatttaaattggagaaaactcattcctagaaatgcaaatatgagataagacacaacttacttaaataaataatagatggataactatgaaaaatgctaaaaagataagtctgtatcatgtctgcttgcagtggaaattctgtctccagtgcagaatgaataaaaagtcagtttaagcagagtcatcacctttgcgagctacagcctaggttctcttcttaagcgcagtatcctctctccagctagtctttgctgggttcccaaaatatgtcaatcagtgtgcctcgtcaaggcacctaggagtccaaatccttagcaaaatgtctttgatttcattaaagttatgaaagggaacacaggcaggaaaaagttgtgtgtctcttctgcttcataatttcatttttatgttattaaattgatttaacatatgggaatcatttaacacaaatatgattaatgtgatgaaaattgaagatattacacctatcatagtatattataaaacaagtggaaacttatggataatatcagtcaactgaggtgtgtttaagaaagacaaggagtcatgcaataggaacacttcagttacacctaatattttgatgatggtgatagagaagcatgagtgttaaattgtcagtcatcttaaaatctcttgtatctatcataatattgtttatgcttcaactgaatatacaaattgacttgaagataacatatttttgtattttacaactataaatatgtgtttcttagttgtccatagtttcaattaagaagaataagcccagagatagcataagaatcactttgtcaaaatagtgtaagatatttaaggcaaacatttaaatatgacaaaatattataagaaattataaatgaatagaagaaaataccatttgcttgagataaatgctaagaaattaagatatacatgtaatgaaacaaaataaaatgcagtttttatttataaacaagttgtcattaacaataatgcttcaagaattatctttggatgaatattctgcccaggaaaaatacaaaatgaaatgatcaataaacacaaacaattataagatatcctgtaaaggccaattatgtttatataataatcaatttacaactaacaccacagaaagttcatactgttatgcctgctcttgttagtggagtttgaatgaggtgaatagatttctaatgaagcaaccgaatttcccattgagaatactgtgcaaaatatctacatattgacttggaattttttcattaaataaatgttttatttaaggcattgatataaacccggggtaacaattttataataatcatttatattaatattttgaggaacatagacagggaataaaatgcataagttcatgcctcaacccaaacaactttattcaataatttaacaactgtttactgatcccctaatggtattatgcggaaatgtactggtgactaagtttacagtggaaaacaggacacaaacagccaatagtgaccaacaatatttagtaagcttttcctaggtcctaggcagacattgttttattttgtttttaccacaactctgtctctgtctctgtcactcagtcacacacagacacacacacacacaagacacacacacacacacacacacacacacacacacacacacacacacacactatatatatatatatataaatatannnnnnnnnnnnnnnnnnnnnnnnnnnnnnnnnnnnnnnnnnnnnnnnnnnnnnnncctttccaaggctctgttatcagtcgatgagttagttaatgctagtggataaactcataacagaactccaaatttcattcttcttctctccatactggccttttcctggacattaaagtctggtgggttagaaagataacaacagtaagatacatgtttcatgttgtcttccaggatcattggagagatactctagggctagctgatcttttttacattaatgttttaattatttcttgaacaattcatgtaatctatattgacaacatttagtctctgaacattggaattgtatccatgagtgtcctatgaagggtcacttcccagtgattgtagagacctggtgggatgctgattgccttctgttgcttaccagagtgaaccaagtgggctcagagcaacttgtaatcctactcatccctgatgaggctgaaattcaataatcgtatgcaataaaggtgcagctgattacacagatctatccatgggattgtgagcctattttaaacatacattggaatatcacattcttattcattataatgtactggaattatatatgatatagtcagtagggaaactaagtgaaagttacatcagactcctctgtagaattgtttcaacctgatgctaatgtatctttttaaacaacataaaatccccacaaaattcaaaaggaataaataacaggggtgacttttcaggggaggcatacccaattgaagaagatctcattcccatactatataaactgttacccaaattaattaaagacaggcagaaatataatacactagacagtaatttcttaaatggatgtattcacatacataaattgtgagatttgcacaacataattagttattaggaatgtgaaaattaaaatatagtaatataggcttttgtgaggatgtggagaaatgtgttttcttaaaatgctgagaaaaacacaaacatgtattacatcatgggaaataattacttctttatgtcaaggttaaacatatggtaagttattatataggaattgtactgcagagtatatagctaatagcatttacatatgctaaaataaggctacctgtttatatacagaattgtgtgatggatatccctctactggttattaatatttatcaaagcaacttaaagaaggaagggcttgtttattccttacagttctaaggcaaagttcataatgacaggagtgtcatggtaacatggatatgaggcatttgatcacatgatatctacagtcaggaaaaaaagtaatgaatgcaagtgcttatattgctttctatgttttattcagttggggagcacagtccatggatgggtgggaaccttagtgaacctgggtcttcttaccttacttaacataactttggtaagtgctcataagtatgtctataggttggtttcctaggaaattaaagattctgtacaaagagatttttctatcccacattgaaaatgaaagggataattatatggatattgaagacagcagttttgaagagagcatttgaagttcactttaaacaactggacctaacagttctagaacaaacactacagaacccaataatacacatcttctcataaagtgcttaaatgacattctacagaatagattccatatcaggccacaaaataggcatcagtattttattgaagacacattttaatacaatatacaatacattctgatcctaatgtatttttcaaatcatgcaaagtctatgttagttttcctttcttcatttttcacagaatatctctttgaagcccaggcttgccaccactagagattccttggattctacctctcaaacgctcagcatcaagcctagctaatcacaacaagatgaaactgggaatcaataggagggaaaatatagaaacacatgacatttaattggacattctttgggccatcgattgattacagaaagaaaaaaaaacagttacaaagggaattagaattaccttgacacaaatacaatcaaaggagcatacccaaaccttcataatgtaacaaaataagcaattaatcaaaatgtatcttattaaaatggctaataaaaagaagaaacatttaatggccacaacctatgtcatattataaggcacaagtgaacttgggggaagatgtaaataatggattttgaattaaaatagacaattactaacaagggaaaagatcaacaaagctgtctttattttcaaaagaaaaagaaaaaaactacatggaaatgataaatatttatttttcccacaaaataaaggaaatgtacaatgtactatggacattcagtgttgttaatatcatattgtgtgcatcatggcaattatggcaaaatatcctttttgtactaaagcctagtcttacttttttactctctctctctctctctctctctctctctctctctctctctctctnnnnnnnnnnnnnnnnnnnnnnnnnnnnnnatgggatgtgtacacacggcagtgtgtctgtggaggtcagagaaggcatctaggaatcacattcatctgtcttggcaataggtacctttattagctatctctcctaaccctggaaaccctatcttggtacctttattcctttattagctatctctcctaaccctggaaaccctatcttgaatcatctttactggcaggcttttctgtttcctttctttcttttcttagatttgtgtgtgtgtgtgtgtgtgtgtgtgtgtgtgccgtgtgtatgaatgtatgtagtgcatcatacgcatacaggtgcctggaaatgttgtcaaaaatcctggtgctggagttacaggtggctgggcgctgccacgtgaattttagaggctgaaacccaagtcctctgtaagagcagaaagtgctcttaactgctgagacatcactcaagccctgtgattcggttttgaatttggacagggggcattttaggtagtattaccaatctacctgtacatacactaccaggtctgtcacagaagccaaacaacacatatagaatgaaatgttctcactatgtatttctgtattattttatgctaatatataacataggtaattaaaagatagttaaccataataaataataaatataaaaatcaactgaaatgagagtggcttgaaatttatgaattacatattcatggaatttccaacttaatatttttcacctgaaatggtcaagaatactggaaactgaaaaatgaaaccagaggccaggatgtgggattactcaagtatactagtttttctgttaaaatttggtgagaaattactttctgctatgtatcatgataaacttttattttcttttccttttttttattattaattcaagttagggaacaggcttgtttcacatgtaagtcccctctccctctccctctcctcactcacatccctcctcccccacctccaaccaatcccaaccccatccacctaccactccccaggcagggtagggccccccacaggggctccacaaagtccaccgaatcttcctgtgctgggcctagacctctccccatgtgtccagagacagagcgcatcccttcacatgggatgggctctcaaagtacccccccacacacaccatggaaaaacaccagttcacctccggaggctcccgggagtgcaggggcctccccattggcatccatgatcagagggctggatcagtcctgcactatcctcccagacagcatctggggtcgatatgctttccctttttcaggacaactgtttctgtgggtttctccaacctggtacagaccccttcgatcttcattcctccctctcttcaactaaattccatatttcagctcagtgtatttctgtggatgtctgtctctgcttccatcagctactggatgagggctctaggatagcatagagagtagtcatcaatctcattctaggggaagggcttctaggctagcctctcctccactgcctggactgtcagatcgtgtcatccttgcagggctctagagatctccctagttccagatctcttctcagacctatagtggctccctctgatatggtactttcctctattcttccccctactcaatatatctgctcctcctctactcttcttcttgtgctcttattgtggcagcaccctctcccctaccctcatgctctcaattagctcgggagttcatgccacttcccattcctgtggtttatttatcccttagagtccttcatgtttcctagtttgtttggtgaagaggattataggttggtaaacctttgctctatgtctacaaatcatatatgagtgagtacataccatgtttgtctttttgtgattgggttacctcattcaggatggtttcttatagttcctaggttgcttccaggttctggctattacaaacaatgctgctatgaacatggctgaacatatgtccttgttgtatgcacatgcactatttcggtatatactcaagagaggaatggatggatcttgaggtagattgattcccatttttctgagcaaccaccatactgatttccaaagtggtcttacaagttcacactcccaccagcaatggaggagtgttccttcttctccacacctctcagcaagatgatggagaccttcaaagaggaaacaagaaaatcccttaaagaaatagaagaaaaagcaagcaaaaaatgacatgaaatggaggaaaagagaaaccaaaaaattcaagaaataaacaaatctcttaaagaatctaaagaaacccaagataaaacaaccaaacaagtgaaggaagctcttgaaacagttcaaagcatgataaacttttataaagttcaaagacttgaaacattttggcaattgaaaattggtttcagagtgtaacttgtagtgagacactaaattattgttcattaagagacccctctgagctctcagaaaacatagccattaactagccagtatctatttcctattaaccagaaattcaaacacaacaagtcatttgacctctgccatcactctggtcatcatgctaagagggcaatgtgtttaactgcatgaatataaacctattttaagttggtgacattatgtttggatgaccctgctatcttccaacttctcacttaatttgtgaaaaaatcttggaatggggactcctttctaggccattttattcacgtaaatgatgagatttcaagggaccatacactctgtgtctttctttgatcctaagtttctctgcatatcctgtcttactgaagccagctacagtgcctgccaacaattaccatgtgtggtctttcacttatgaatacaatatatcagttttttaaaacaattaacccttcatgtacatcttaagcctataacttaaataagagaaacagatgaagtcctgagagaattgtgttatcaccatgagaaagcctgtgtcaagaaccccaaggcctcaaactttgaaaaggcaaacctttcccatggtaaagtatgatgctgatgcatgactgatgtttaagcaaaagcagtgtttgcagaaagtattaactgcagcttcctccatgaggatgattgcaaccttaacacattcccttacagaaatctatctcctacttaacatacttaacatagcacttcccctgccatctctgtacaataaataccatgtactcattcagctgtagacaataattccatctcttcactcagcactatataataagcacactgagcttgctggctgctagtacttctccatctgacagctctgtcccccagaccccagattttctacatgcatattctgtgtgtttgccctttcttcattattatctcattgccccagtcaggtcaagtccaatgctgttcaggtttcagcacctagggtattttacacatgatttcttcactaattcatgttgcatggctaatactgttcttttatcctgtccgcttgagattagcaggatactagatactttattctctgtaccaataacaaggaattttattttgaaaacaatgtgccagagttcaccccagtaccatctaatgactgcttttattttcttgattcactatttcttttaaatgttagaaattaaaatatttgagttctccttttattatacagtaatttcattagtagatgatctcccaggaattagtgatacatatgcaattctaagttggtaataccaaatgctcaaatgcattaatactttgtacaaaactactgtagttttctgttctaaagtataaatcatctacaaacttccttcatatttctacttaaattactctctatataaagtttagtacagtgcagattccacagatatttgaacaccaagctgaaaaatatcacagcaattttctgccagatgtaatttggtatgctataaacccttgaaaaatcagagatgatagtgaatatgacaactgacctttagttataatatcagaaatgtgataccataaagatatctgggcttgttttcttctgtgaggccatttggggaagaaaaagaaactaggtctgaatatttactaggaagggccataagtttatgctctatgtttccctgacaatgcacattagaatagattttgtgctgccaagcatttatcaaatctctctgaaaagcaaaaccacagctttgtttttattttgtttgattttttcagcaggcagataaagtatcatttatcatagtatgtgagaaaagcaacagggcagacaagctgtaaatctcagcaggtgctggtgggagagagatgaattaatagtaagagagaaagtcgttcttttgagtaaatgtttaagaaaaccagcaagcttagcaatggacttgttccttaaatgaacagaattcaacactggatgatttgtgcttcttttaatacagaacctaaatgtttcacatgccattcactagagaccaggataagacaaataaataatatatttatatagagatgatgttgtgattagaatgtgaaatgtcttatatggactcatgtgtttgaacatggtgatgatgtttggaagagttaagtgagtccttgggagtgatccttaaggttaggattagcatctgttcccacttcttgtgtcattgaccttgatattttttgccaatgcaaaattcattgtttgtacttttatcttgtgtggttcccactgacatacgtagtctccctgtgggtagtgccaaagacattgctgtatggttaagtctaatacctatgaattttccaagaaccaatacatatgaataaaataaatgaaattatttggattttgatttcttgtttatgacttaaagtactgaaactattaagactccccatttattcttctttatccattctttacttacttatgttaacttgctatatattgtggaaaatcagaatatgcctcttggaaatataattttattaaataaagcaaaagaaacaaattcatgagagtgctctgttctttatacatacataggatataaatgtacaaaagttgagtgctgggagctagttcagtggttaagagcactgctactctttcagaggactgaagtttggtccccaaaactcacatggggtggctcacaactgcctgtaactccagatccagggtatccaataccacattctgacctccactggcatctgcccatacatgtgcacataaataatacaataaaatgaaggacagctataaattttcatcagcttagagaagattcaaggagaattcatatgaacaatccgggccagctacttttctgctacttgtttttcttcctccaaacagctgtccatgtaaagtcatattttttctttttataatagttcttctgtgtttgtttcctttccccaaggctgtgagtatatacttgaacataaaagaaatgtaaggaaagaaggttctatttagacttgaacctcaaggaaatatattctttaatgactgacaatgcatagtgacagaaacaagcattcagctggtcacattacagtcacactcaagaaaagagaattcacagagaaagaggggatgtatggaaccttaagttctacttgccaggacccacttcttctagttagagtcggcctcctaaaaaatccataatgttctcaaacaccaccactagctgaggactaagtatgcaaccacaagagacaatgggacacatttcatattaaaactatgacatcagctctataaaggcataatgaatttctgcagataaaatataaactagaattctaggtgaagctttaggaacaactcttctttgagtagctctcattcatattatagcacatacatatatgtgagaaactatttttagcatacataaaacataataataacatatgtattgcatggtatataatgcataaaatatattatatatgaaacataattgttacatatgctaatacatcaaataacatatgttaataaatctgtgcatgttaataatatatgtaaatatatgttaatgggtaatagcaaatatatgttaataagcttcttcctctttagtgtcaatctttatttctaacaagggcacatgtcaattattattcctaaaaggctgctacttttcacctagtaactcaaggactgaatacagtggtgagcgacacagcatcataggttctaaatagaaagaaaattgtgcatcaacaactgtgccaagcagacaaagaagataatgtttcaaagaaatacaactcaaatatttttgcaacaaaattgagaaagaagaaattctctctcaaacaaatgcaattcattaaatatttcaagtggaaattttcattcactttcatatgttaaatccttgaactggaatctttaaatatttgttatatttttgaaattataattataaaattttcaccttccctttactccttctaactcctaccattcatctctcacctttctttgtctcagattcatgaccactttattcctacacagttatgatgcttatgaaccacaacagtgaccagcatggcacaataatcttcagggtacagtatgggcatgcataacttggtagtgaccaacagttttcttattggcctctacatcagctcaacaagagggaaacaatgagtgatgctgcaaacccagccagaggctttgggatactgatgccatggatcttggaggagaatgtatttagaaccactttactaaacaaacagtccctacttactttccataactttatactcacatataagtagagctcttgatcttcataaaagaaacttccactttcaacagaatttacctatagggtcacttgagtccttggccatcatgttcatgaagaagttatagacctgccttctgtgtttctctgaatcttattatgtagaacatatttatccttgcaaataatatgacctttaactgaagcaattaagtatttgatatgctatatgaaagcagttcaggaactgaagtgttcaatgttgagctacagcagagaaacatttattattcctttgtatgttgtcttgtttatcagaaatttctctcctgatgagagtgcatcaatataaaaattctactgtcatgtaaatacttctatatacagggaaaaaataattgggccatttcctttgattttcttcattaggactttccaggatacccagaaggttcttattctccttgagccacaaactctagctccttaaagagaggggatgaagaaaaacaaaatcttgttattatttaaattttattgtacaattttaaggtacagaatataatgcacttaaagaaacaaaaacccaaaatgctaggatttgaactcaggcctcacatattccaggcaagaatcctggcttttaagttaaagaccaggaccttttaaaacctttattctgagatggagtcttttatcattctctcttcccatcttcttccttcctttgttcatttatttctttctatttaaggttgcttacagtattaatttgataccatctccctgtctaccatctttacccttctcttctcacatagactttctttgttgtactctgagccccaataagaacacttcctaataattgcatgatttttgttgttgtagtttgtttttatcacttccaaggaaatggggcatcctgaaactgagaagattttgtaaggcaaaggacacagtcaacaagacaaaatggcagcccacagaatgggaaaagatattcaccaaccccacatctgacagagggctgatttccaaaatatacaaagaaatcaagaagctagtcaataaaacaccaactaacccaattaaaaagtggggtacagaattaaatagagaatactcaatggaggaatataaaatgactgaaagacacttaagaaagtgctcaacatccttagccatcagagaaatgcaaatcaaaacactgagataccatcttactcctgtcatgatgggtaaaataaaaaataccaatgacagccaatgatggagaggatatcgagaaaggggaacactcctacattgctggtgggagtgccaactgatatagccacgtggcaaatcagtatggagattcctcaggaaaattggaatcagtctaccacaagatccagcaattccactcttaggcatttacccaaagatgcacattcatacaacaaggacatctgttctatcatgttcatagcagcattatttgtaataaccagaacctaaaagcaacctagatgaccctcaactgaagaacagatggagaaaatgttgtacatttacacaatggagtactactcagcaggaaaaaaaatggaatcttgaaattctcaggcaaatggaaggaactagaagaaaccgtcttgagtgaggtaacccattcacaaaatacaaaaatgctatgtactcactcctgcatggactttagacaaaaaaggtttaccagcctacaatccacaccaccagagaagctagaaaacagggaggaccctaagagagacatacatggtcccctggagaagaggaaagggacaacatctcatgacctaattgggagcatggggggaagggagaggcacctagaagaaagagaaggggacaagaggaggggagaggaagacatgagaaagcaggaagatttagtcagggaaagaatagaggagagcaagaaaagagataccatactagagggagccattataggttcaaagaaatttatggcagtaggaaaatgtccagaaatctaaaagattgaccccaactaacaatctaagcaataggtgatagattaccttaaatacccttctccaataatgagattaatgtctaccttatatgtcatcctagagccttcatccagtagttgatgtaagcagaagcagacacccacagctaaacagggagctgaactctagaatccagttgcagagacggaagagtgatgagcaatggggtcaagaccaggcttaacaaacacacagaaacagctcacctgaacaagggattgctcatggaaaccagaatgatagctgggaaaccagcatagtactttgccagtctccctggatgagaatgtcaggttgtaggtctgggcaatctttggggcctctgatattaggtcatgatttatccctactatacaaatggactttgggagcacattccacatagagggatactctctcaacctagacacattggggaggttctaggccctgatccaaatgatatgacagactctgaagattcccccatggaaggcctcaccctccctggagagcagaaaggtatagagatagagggtgggggtaggggaggaggcaaggcagagggaacttggattgacatgtaaaagaagcttgtttctaatttaaaattggtttaattacatctataaaaattaaaaaagataattttctaaagagaaacttgggtatctcaatctgacttcattccattgaagcaatgaatctgcaaaaaaaatggaaatttcctcaagtatctcatactaggagaaagaaaatgaaacaaaaagttggtactttgtttcacagaaatacttgttagacagtagtatcaacttgactcacctccttataggatacaactgaagactatacagtgataggtcaatggtgggtagaccacatattggcctgactgcttagatgtacattttcttgacctcttatttaaactttaacatctatttaggacaccagaaacagactggaagagattgctgggtttaattgtccgtctttccaatatattcatatcgaatgattctcctttttctgctttacactattaatttggcacctctaattggtttattgaacatgggtgcctgagccagacttaggccaaagtcttgaaaccaaagtgtgaaaacaaatttacatttcatttatttgtgtttagaacaaatgaagagaaaatgatattgtaataatttaaaagaatcatgatttattttcatgaatatttgattaacaaacattggcttaagtcagatgatttcttttaaagattatggctccttttctgaacaaagggattaagaacttaaggagtttttaaatatgcaaaaatgttttgttatcattgcttgaaatatctccatgtaacgccctgtatgagaggcagatagatacggtgatacgtatcagggacatgtctccagttgaaaccatagcaatgcgatgtcagggtcttgtttggccatctgcattgaagtttgcaaacagctggaaatactgatgccctttacacacctctaggaaaatgtctacagtccatcagttgcaggtgtttatgtcctgtttggactgttaaacctagattcttctgtaggaaaggggaataggttgttggaactcagctgctgccaagggccttacagattcattcctgctcccaaaagactctctcttctcaaagtcctgctctgatgagctgatatgtttgtattactcctaattctcccatcctatatagggtgcaacctgacaccaggcaagtggcatagatcacatgttcatcaatactgaccaaagtttctgcctagggattaggatagctcctcccactagagttgatgttttttagtgcaactgaagcctctcccatgctttggctctctgccacacaattttgtgccattaataatttctgaaagctcttattcgaaggagctgctactaagtacctcttgagacctttctcttagacctatcccatttctggtctctccatttacctaacagaggtattgctaagtcagagtctgaatgaaatgctcttgaagaaccatataattcatggcattggctttcataaattctatttaatgtttgaagtcagtaagcatgatagaaaaataaagacttagctatgatatttccttataaggaagttgtctatgcacatgagggaaatgaagcacagagttcatcttagcttgataaatgatgatgagtataatcagagatttagacttatagtctacactgaactatgtcttctcccttgaccctctcaacaatggctgctcttagaaaaaaattataacaactctttcagtttctgtttaaactactgggtgatttagggaaaaacaatgggggatataagggagattttggtcccagagactaagccatatgttgttgtcatttcatgaacatggaagttagatcttatgcttcagtcttccacttagcctggaatgcagaggcttcatctgtccttcttgatgattgctgttcaaaggataactctcaggtctctaagaaagactgcctctattgaaaagctagcaagatatttttaagaatgttaacatatgaggcagagaaagaagtaattagaaaatgctttccaagaaagacacttgacaaaagtgaattccagaagtagaaaagcaagaccaaatgtgtcatggagagtaaagacatcttagtcactatcacatggttgggaattatgtagacagggcaacttccatcacattaagctacctaaacagatcacaaggtccatatgaacaaactgtaagtgtcagtacttccaatcatttcacacatacaaaagcaaaagtttcactagttcacctccaacaatttaaatgtgccaaagctgagtcttttctaggatgattactaatgtcatcttttcatccaaagcaatgaatttgcatcctggtttattcaaagccaaggcaataactccatagacataaagcagtagagaaaaactcattttctctggcatgtagggagagaatgggaatttcttctaaagcaatgccctcagagacccaaagaaagcataaggctggcccattcctaagaatgctctattgagctgtacattccattttaagttaatgacataatttaagaatatctaggagatgaattttatggtatgctttgcttaatgccttaaaacacacatttaaaaatgtaaaatgttagatgttgaaatctctgggaatgctcagccagcaccatatagtggtagttgaaaataaaggatattttgaaggtgttattatggtctttaggatcaaagcctgagccatagtggcccagagacactagactttaccaactgtcctcaatgcagcagttggagagctaagtactagtgcaaacaggaagaatgttttccaatgtggtcacatggggaagaagaacaaataaaagctacagtgactcttgtaagtttgtgtttgtggtactgacataagattttgtttacacagaaggggagaggtgtgcataactaggcattccatgtaggggatgctgcagccatgcctgcttaggggctggctacaggtgtgcttgaccacacctgggagggcatagtcaggatgacctagagtaagggacattcaggtggtggcttgctgtagggtttactgcccaccagctgaaaaggtcacactgaaagtaaggcttttccttattaaattcccttgtatttttacctggctccatattggtaatttcccacattatctggttgttaggaatgggatattgtaaacctaggcccctttgggatagcctgtggttccaccagtacagtggcctaggccaggaaagcaccctctctccacaggtgctcccggctcacagctgacctgctgtgccacaagtgcattcccactgctgctgagctgctcagaaccatccgcccagctgggagacttccacagacttccccacagttactgtcgcagtttctagctgagtgcatgggacctgttcagactgctgcctaaccgagcctcctacctggaagctgcctgcccttgagccaagtaggcctgaggagtaggccttggctttcagcagggtctgcggcttcccctggccacagcgcctttacagctgtgcctgttttagtggttgcagctgcaaggcagtatactctctaagcccagcattgtcacatttgtgacctctctccactcttgtcaccatcttgcctgacagacctctgtcaaaagtcacttggactaactatacacctctgtcccctgttgatcaaagatacttactcatctggagaagaactcaagtaaaatcatggtggaatatttatcatttgctaaaattggtaatatttttgcttattatgtgaattcagtgtttgaggaggacactaatctgccaattactggcctatatgcagtgatggcagttagcttactggtacaaataaccttcctagccagatccctctggaacagggacaaagataacctcaccacctacttacaggaaataacagctttatgcactgaggttttggagaacagattaggtcaggccacaattgtgcttcaagtggaacagaaattggatgataagcttggctctgtgtccaatacactaaagacaaacttgtctgttacccaagatgagatgcagcatatttatgataacataaaaacagagagatgctccatgtctgaggcattagaggataggctgtcagaggaccgtgatgaactaaagaatatctgtagccagttggaaactcagataggctcggtgacccagaaattagatgcaaagttacaaaatacccaagatagggttgaagaattggacaatgtcattcaatcaattattgaagcatctaaagtagcagatcacaaatttctatctatgtttggaagataatttacaatacagggctgatagattagataggtccatatggtcgattgctgaggactcaaaatcagcaaatcatgacctcaaatctagtctctaataactaggaggcagtttccatgccatccagatcctgcctaaggatgatcatattaaagacctagaaaaacatgcagaggagcagttagagaaatttacagattcactaacatgcttggaatcttttaagattaaggagattgaaacttttcataaggttatcattactaggcttaaagatcattgggatgcctcagaggcagaatcactccaatccaagacacctactccacccaggtatcatgactattcttctaagattattaccgatatgcctttagtctacccagctaccatggtagaaaagccagcttctaagaaacacactcagagacagatggcttatgtatggcaacctatactgatgaaggatctgaagaatattaaagaagcagttgtctcatatggtctccatagcccatatgtaaaacagctattacattcatggtcaacctataacagggggacacccacatattgggaatgattggtagcagttgtacttgagaattcacgcaaatccagtggaaggtattggtcaggaaagaggcaaagctccttgtgcatcaaggcataaaggaaggttaagaagcccctctagataagattcttggtaagggtatttgtgctaacccacaggctcaggctgaatatgatggccatatacagtccctatgcaggaaagcagcattaaagcctgggataaggttcatgagccaggagaacacctagaagcttataccagaatagaacagggacctacagaacagttccaggtcttatttggaaggttaactagggcagtagaattacaggtaacagatcctgaaacaaagacaatcaattatatatacaatagcttatgaaaatgcaatcctaatatgcaaaagaatacttttgcctttaaagaacagatcagctccactagaagaatgagttttgcatgaaggcaacattgacaagataccagagcttgggaaggagaagctatcttgaaaggtttaaaaaggcaagaggatattaaaagttctagaggtgaggccacaagggcttgggaaggagaagcaacttacagaggtcaacataggtaccaaaaggctagaggttgctactactatgaaccagaaccttgggtaggaagagccttccccaggagaccacaaaggcgccaggaacctagatgtttcagctgtggtagaatgggacatatgaagagaaattatagactaacgaattctaacaatgcctcatatggaaggccactgccttctggattgtgtagaagatgtggtaagggcaggcactggaccaatgaacgtagattgaccagggacatgcaaggaaacctctttgtttctacaattacaggaaacaatcagaaacagaattaatcctctatacattacaaatatcagatcccataggggtctgccaggcccactagcacaaagcaatgttgagattgatcgtttattgattggaagtgtcctagaagcctcaatatttcataagaaacatcatgtaaatagcaaaggtttgaaaaaggacttctccgtcacctggcaacatgcgaaggagatagtgagaaactgtcctacttgttccttttataatcaaattccattgccagcaggttgtatttctaagggaattcggagaaatgaggtttggcagatggatgtctttcactttgcagaatttggaaatttgaaatatgtgcatcacactatatacaaattctcagagttccaatgggctactgctcttaattctgaaaaagctgattctgttattaaatgcctgcttgaggtgatggcagttatgggtgtacctgcacaaataaaaactgaaaattctccagcatatgtctccactaaattggaacagtttttcaaatattataacataaagcatgtcaccgttataccacacaatcctacaggacaagcagtggttgagagatctaatagaacacttaaggagatgctctacaaacaagcttggaagattaaaccccccaaacataggttgcataatgctttattaacactaaactttcttaagtccaatgagaaaggacaaacagctgcagaaagacactggactatggaaaaacctgctgaactgaatcagccggtatacctcaaagatgtactaacctctgtatggaaaccaggacaagtggtacaattgggtaggcattttgccttggttgccacaggagaataacattggataccatcaaagttgatcaagatttcagttgtgaaggaaaaacctctcgacgaggataaatgacaggtattttactaatgtataccttataaactaaatagaaacctcccaaaggaaattgaagtgttttgcttttatcttgacagataaactcatctccagaaggcaaaggacactgcatgggtagatacttaagaagagaaggtagctataaccatcaaacaaaaggaacgtgccatacggtaagcttcatagctgtctcccagagaactctatttctctttatttcctagtccctattcaaataaatcaatgttggatttagatttagatttgcctttcctcctctaaaatccaagcacgttgtttaaactttttctagagtttctgtattatatcaagaagccaattgatgtaatacagaataagagaaaaatttgaggactatgtttgtcttttcttggctctttctttcaaggtgtataccctttcataattgttgtcttttctggtatgcatacttacacaagcaaacatttctctgctgtttatgtttgagttccacacagctaatgaagacatgcctgacagcaatccctggataccgtggaaagaaaatgggccacacttccttgactgcactggatccaacttgctccattgcaaagcacagtctggccagaggttcaggtactgacttcaatcacgttgaagatttcaagtgagattttcaatcaagcgaatcccatctaacatggactggatacaatacattcaagactttcactatacaaatattttctttctacatggcctcacaaggctgtcatcatcccatttctgcaggaagtaacttggaggatgttatgtccccttacccccatgttgtcacttaggatagtgtataacctagttaggggtagcttcctattgtttatggttgggattggaaggaggtgttcaggcttggacacctctttcagatgactttagggtatagttaaaatagacatagttaggatatgacataaacagattattatatcttcttatatttcacctttatgattgttaattttagatactttacacagttaagttttaatcctcttttagactaaaaggggtattgtaggggatactgtagccatgcctgctgaggggctggctacaggtgtgcctgaccacacctttgaggggaaagtttaagagtgaggcggctctgctttcactttcgtcttcagcttgccgtatggactgctgccgagatcgctctgtaagtaaggcttttccatattaaattaccatgtatttttacctggctccatattgggaatttcccacattaattccacatcacagtgtgatcctgaacatcattggcccatcttttcttcagctgcgggctgccttcaagtcctcagcattgtgaaatctctccctgctaatatgctcctcttctgcctggcataagggccccggcctctctgtttcttctgtgtaagagtccagaagaagttcaattaaccagaatcctgtttcaacagcctggtagacaacaggagggacacaatcatctcctcagaatattttctctcctgttatgtcacttacaaaggcacattaatatatattatgagtatgcccctaacaagttgaacccacttagtggttataaacttcagcagagaagttcttgttttcataaaaaatatttctcatttttataaagcatttaagcagattaattaatgtttatgagatttattggtcattgaggcagattttaaacaatatttgagttccacattaatgaaagatacaattgcaagtcaaggagtcactttgataaactacctttcatttagcttgtgagtcagtaatgtcaaagatgattgctgctaagtaactgaaatggtttcagatattggcagttgatggatttgccaataagctttgctgagatcgtcaatagccttgacccacctataactagatttgcatatggagattcttataagtcaaatgttaaagacaaaaaagactatcactctaataacataaatgcaggttcaggaaaggacatgagaattcccttcaaaatgagctttattaggagggagagagatggggtggaagagagagagagagagagagtcaaaatcacactggccatgatcagaaattgaagaaagagatcattagggatatgtaacctcaccctctaaacagaataatgaacatgtgaagtgagagaagtggcctaccgttcaaaagctgactaggagcaaccttagtagagacagatatcatgtacaatatgatggtggacctaaaggaaggagccttttaaacccccaaataaagttgatttctgagttgggtgtgagtggcagaagttctgcaaagcatagtttagttgtgcctatcacatatgtcacagaggtaggccctaggtaggactataaccttttcttggagttacaaggaggaaggctaggctttgtttttccagttgagagttaaaagattttactagtctcagacagagcctgtcagtcttttgttttaaaagagaaacctgggggtcttgatgttttatttggagaagagtgaaaggcaactatatgtctatggtctgacagttttatataccaaaataatatctcctgtccagagaattctataggaaaaccttaccattgggaattttggtcctatgctgaggtagaaccactgcaggctaaagagtacgatgtctattggaaattaagacatcttcatgtgagataggaaaaaccttctgcaaatagagaagatggaggcaacctgagggccattagccctcctcctcagaaaggggcagttgaactgtctagtcactaattgctcatcagtgcatcatcagtctttgtcccattgctttatacaaactataagacaccatacaaacagtagagagactttctctcctcacatttaatacttttgtgattcataattcttttgaaatatgggtcaatacagcaatggtttatggacctacatcattggtagcatcaacaatgtgttttgttagctcatagataattatttgtcttttcttggtgtactattgcatgactgcttgggcaagtttgtccagccagtctctggagacttaatcagggcaccttctccttgcagtgcaatataggaggttgagtctacctacctttttaatgcttttcacaaagtaggaaaagaaataaggcatcaaaattacatttaactgctacagtgatcccattgttagaagcagagtgacacatttgtgtctataatgtcataatctattgaatatcaataaattaaaaagaaatattgactctgttgcctggaagtttctaagaggttctgctatcccttgacagctggctgttagaaaacactggtctttttattcaagccttagttagcaatattaatgcccacatcacaaattacaccttacctagtaattattgttaccagggaaactggattccaatttttgggttctgagtctcattaatgaggggaattagaaatggactcagaaggaagctcatggaccatttgattagagtttgaatgaaaagaaataatacaggcaggctgaaaaatctcgatagccaccagagagaaggaaatggagagaaatccatgtttttaagtcaggtatgtcaaaggtctctgttgatggttcaagagggacacagagatggattatggagggaaaggcacttactagaagagttagtaataccactgaaagatagttatctaaatcagcactctgaggagagagttcctatctcttgccagaaacagatactgtatatggtttttgaggagaggattagattccttggttgtagttatctttttttttttttttttttttttttttttttttttttttttnnnnnnnnnnnnnnnnnnnnnnnnnnnnnnnnnnnnnnnnnnnnnnnnnnnnctcgaactcacatagatccacctgcctctgcctcccgagtgctgggattaaaggcatgcaccaccaacgcccggctggttgtagttatcttaatgaagaaggtggtttatcctaggaaactgcaggcaggaatttccaggcaggaatcagggagtggggctgggagaaggatatatggccaccaataccccctttgttgtaaattaacttacctagatgagacagtctagcacctgaaagtttgtcatctagaggattcatacaggaaaagaattgtatctgggacacataatagaaatagagacagtttattcaaaggggaaaagtgcttctgacaataggtgtggcctggtgaacttggggggaattttcaaagccctgagccagaagaaccattatcctttacagtacatttatttaacaccctccatttgtaccattatataacatgaactttgcttgagtgtgctctgtttattgtatgaagctctgatgaagaagactacaatgttttctaaacaaatggtatctttcatttgttactcttgatgggaaagcccccagtcactgatttcataactgatctataggaatctatgtatcatttgctagtattcagtcatctgtactgacagaatctatgtatcatttgttagtattcaggcccctgtactgacctgtccttggggttctgaaaggatatgccctcagcttcagccactaaaagcactacctgcgcatattcattatgttcctttttaaaaaggccctgcctacctcccatatttctctctttctttctctccctctctctgtctgttccccctctcccctctctcttaccctctctgaaacctctctcctctctctctctctctctctctgtctgtctctctctctctctctctgtctgtctctctctctctctctctgtctctctctccctctttcctttctcctctctcctactgctcctgtctccagaggccagtctcccaacaacatttcctccttttataatcttcctttccctaataaaaaacccttctgcttaaaccctgtcacatgaggtcttcttctccaatgccacttaaattacaacatcatttgtctatcatctttatttttatgtaaattactaaaacgttctacaagtattcagaatagttgaaggatttttaagggatactacttgagatagacagagacaggtattaataccttgatattcacttcagggaatggacaacaaactcagttggagtcctgatagaaatattaccagagacagaaccaagccatgggttatggcttgtgcctaacttcagaattgatttgaactgtagaagcaaagtgcaagacaatgtaggtcaaaaaatgaggttcagggccaagtaccaacaaatttaggaatgggtggatcatctggttatattatagtagctttgacagtactaagaactgagaagagctgaaggaatggtggtatggggaggtatgtttggtatataagataagaaaataaataaaactttttaaaagttgcaatccccatcaaaatcccaatacaattcttcactgaccttgaaagaacaattctcaaatttatatggagaaacaaaagatccaggatagccaaaacaaccctgtacaatagaggaacttctggaggcatcaccatccctgacttaaagctctattacagaggtatagtcctgaaaacagcttggtattgacacaaaaatagacaagtagaccaatggaatagagttgaaaaccctgatattaacccactcacctatgaacacctgatttttgacaaacaatccaaatatatgcgctggaacaaagagaacatcttcaacaaatggtgctggcataactggatgcaaatatgtagaaaactacagacagacccaagcctttctccctgtacaaaacttaagtcaaaatggatcaaagacctcaccataaacccagccaccctgaaactattagaagataaaataggaaatacccttgaattaattggtacaggagactgtttcctgaacattataccagtagcacagacactgaggtcaacaattgataaatgggacctcctgaaaccgagaattagacaattctcaatagaggaatctaaaatggctgaaagacacataagaaagtgttcaacatccttagccatcagggaaatgcaaatcaaaacaactctgagataccatcttacttctgtcagaatggttaaaatcaatgacagtttatgcttcagaggatgtggagaaagcagaatgcttctccactgctggtgggagtgccaacttattcagccacttaggaaataagtatggtgactcctcaagaaaatgggaatcagtctaccacaaaatccagcaattccactcttaggcatatacccaaaagaagcaaattcttacaacaaagacatctgttcaatgatgttcatagcagcactatttgtaatagccagaaactggaaggagactagatacccctcaaccaaagaatggatagagaaaatgtggtatatttatacaatggagtactactcagcaggggaaaaaaaaaaagaaaaacaagggaatcttgaaatttgcaggaaaatggatggaactcgatgaaaccattctgagtgaggttatccaatcacaaaaagacaaacatgatatttactcactcatatgtggattttagacatagagtaagggattaccatcctacaatccacactgccagagaaactggtaaacaaggaggaccctaaaagtgacaaactttgtcccctggagaacgggaaagggtcactatcccctgaacaaattgagaacatgggaaaaggggagagggagctacgagaatgggaagggaagaaaatgaaggatgcagagatcatgagggagcagaaagtttgagtcaggtgtagattagaagaaaggatatgtgataggtagggttttagttgtggggggtggtaggggaggaagggagggagaatggaactgggattgtcatgtaattcaatcttgcctgtaattcaaattaaaaaaaagaaaaaagtttaaacttatgctgcagagctttcattaaaaaacaacactgttttttcaatcatgctgtgaaatcattactgttttgctcactgccatgtttttgttatacaaagccaaattacatacctgggaaagaaatacattaaatggaaatctaggactaattatctatcaccttcgtcagtagaaatttaagatgaaaattccatcctcctgggagctattacactgtataatataaccagctctgacttattatcaggcagacatcattttaaattttaagtgttcatatagaatacttggagtctaggtgctattgtgttggcattttataatctttcaaaagaaataactgtctgtatgtatatgcatgttccataaatgtgggacttctcagtatactcttaatggttagtgtaagtctgattctgcatggcagttactcctaaatgtccctcataagagatcacacaaaactgcctctaccagtctccttcacactgtgtggcattatcaacactttgatagaccagagcaatttattcttaatgaggtcaatcagttagacaaacaatgctaagtgtataagaaggtcattgataaggtacagtgaacagtagccaggaggattactagaaagaatatattgtgccctttgttttattttatttttacatgctcaggttcagaggtctccctctggatgaacagtaatccgaaaaagcaggaaggcaggcttaattattatatttagataaaggcttgtttcaactatatcataataatgatgtgattaactcatatttgtccactaggatggctgaatgtctgtttgcttaactctgtgtttatttctaactccttaaataatacaataatgctattaagtagaggggaactacttcgttgtcttcagaaaaatcccacctgtgacctctggagttctttctgagggacatgtaagctcttaaacaggcctagcatatcctttctaggcaactcaacatctggtatatgctctataaatacgaaaatactcttaaaatattttattagccctttttgaatttttttacaatgagttttgaatatattcacccatttcttaccagattctcccccacttcttccacattcaattttgtgtcatgtttggttttaaacccatctggtgtaattttgctgcccacatatttttggatctgtggtcttccaccggatcattgttgtcttaatagaggctatccttttagagaaaactgtctctttttatcctatcaactagcaattgccaatagatccttgggtatgggtgggattctatgaccaactccctttttgggatatagtctggcttgagcttgcacgggtcttactcattctgtcacaattgttgtgaggtcctctgtgtagctgccctattgtgtccagaagatattattttcttattcactacctctggctcttgcagttttgctatgccctctttagcaatggtttgtaagcattctgaggaggttgatatgatatatacattcaatttagaatggagcattacgcagtcacttattctctgcctgttgaatagttgtagatctctgtgttgattatcctccaatgtaaatctaagcttctcagatgagggataggagatattttaacccatgggtgtagtgataagtcactagaactacagggcagctgaggtcagcaggaatttacccatgaattataacccaacttgcagagactgtaagccaaagccaaaacagaacagaaatcaaaaggagaaatgaattatgtgacataaaaaagaaatccttgcatatgttaaaagtaaaactgttatttgattatctattgactatttctagagggatttaatttgcccaataaagttttgatttcattcacaaaagtctttcccccttttcagagcgtaattttgaactgaaaaaacaaacaaataaacaaaaaaacctcatgtggagagttgggaaagccccaaatggccattgctatgtcagataaatcacaactactgttttgtaatttttactattaaaacatattaagaaatatggcctgtcattcctttggctggaacacatgattaagcagtgtagtgagcagaatgagcaggtgtcacagtagaatcagaaagaccatctgtcttcattttccatggaaacaatccttttgaggctttcagaaaggagaaacattgctatgttgtacaggaagtttaatgctttgtgggattttcttttctctccttttgaagactttctttgactattttatgcaaagtaaaagtgaacaatcacagcattgtttactcacagaatactttctgtctcattgttaaatgttcccaaacacaaatctggtgtaggtgaagccttatacttgagtatcctcaagttctatccatccattttgtcctaagtgataaaattagatcaagaaccatgaatgctggtgcatgtcgttgtccttaacatcagatgttatttccacaaaataactatcaggactattatttgaatgagaatcaggaatatataaattagtaaaatatataggaatatccccatcatttatcctctgtccttggaatgtcctcttgggaaggtccaaagtaaatatagcaatgtcaatttgttcttacctttttaaaaatattttttctaaaggggactctctctgaccacacacccccaaaaatgccagtctctccacccagctatttttgtaccatctgtacactttattccaatagaattattttaaatgtgtttgttcctgtgattgatctgtattgttagtagaaagattattttttttaattctgtctgttctttaccgaacaagattatataataggctttaatacagaaaaaaagctatgaatgattagatgaatggaagaagatgtggtatactttatacacaaattcacagataaaactttaagtaaataggatgtggcattaatgtaattatcagatgaatgtgatctttcagctttttctaattacatctgctaacaaagaattcattgtcatacacctaaatcatgaaaaatgagagagagtgaagaatgatatttagcacaattgctgctgcaagtgcaatcacagggctaaattcttgtctcatttttcaaatataatatagagaatttcagaactaaagaatagaaatgtagtccagatttggaatacacatcttatcccaaacaaagtaaaattccaaggatataatttcatttgttttttttccttcgtaatttatgtaggataatatgatgtgccttagatttagtaactcacatcaccaatgtgtttttaaaactacaatgaactttggtatactgacatgaagtatacttacaaagttcaaatggaagatggcatactcctatggacattttagaagtagtacagagggacagaataccccatttatgaatgtaaccaaattaaaataaagagcatatgcagattgctcacatagggtagagggtcattttctctaagatttattgcttaaggattgcagaggtttggttggtgagaaaagaattttgaaagttgacttaagtttgttgagtataaatttgttgtttatagctcatcataaacttttaggctttatgagaatcattgtctttaaagaacttgtaatttattacaaataaaaacattgcaagatacaaagtgtcctacatcacagggtaataggtaatgaaatgtgaagatctccagaaaatctctcagcagcccaagttgactatgcagacacggacaattaaaggtgtcatatttacttttctattgctgtaaagggacagcatggtgaaggaaagagtttattggagacttacactttcaaagggttatatcatgaccatcatggcaggatcatggcagcaggttggtaagtatggtgctgggacagtagctgagaacttacatttgatccacaagcacaaggcatcatgagctgactgatattagtcttctaaaactttccagatagtcccaacaactggggatcaaatattcaaatatgcaagcttatggggccatttgcatttaaaccatcacacagggcaacataaaatttttgtgatgtactctctcaacatgatggcttatcagtttttagcttcttttggtctgcttctcgttttctttggtccaattcaataagtttctgaatttgatctcctttcatcaggtttatagatgatttacacagctatttaattaaactttcctaagctatttgtttattaaattttattatttatttatttgtatatactcagagaccatagactatattgtgggaacattttccctgacattttctcaatgtgaagtgctataaattactaaatagtccctatgagagtgtaattctttagcatttttggatattgttctatttatttagaacacatctattgtcttagttatttttctgtttctgagtaaaataacttaagggaggcagggtttatttctggctcacagtccaaggtgtagtccattatggtgaggaagcctggtagacaggagctggtagggaccagatggagaggaatgtttgtgccagttccttttctccattttattcaattcaagatccccatttaggataccatcccagccctacttgctttcaattaatacagcattttgctcagcactcagaagacaaaggatgatgaatctctaatctcaaggccagtctggtctacagagtgagttctaggtcagccaaaagtagacagtgaaagaacccattaaaaagagaaaggtaatgaagttgtaattcaatgaggggccctgttacattcccagcaagcagcagaacttagcagatttagccacaaggtttaggctttagagtcaagaatggaagaaatgggttatggaatcaccctctgtgactaaggaaaactgctgaggccaggcatgtgtaaggggtgtccctgtatggaggcccagagaaaccattgtgtaaagctgtaaaggtggaacctggattgcctttgagatcccaagatgttagagatgccaaagtcatgggataccttccaaggaaagctgctatcagggagtaaaaccagcccaagagagagaagtgtgatgcagtcaatagaggtgaaagaagttggagatctagagaatactctgacatcagacatggagatgaagagtttggaaatttcccagctagttttgcttttgctatggtctgtatttcttcactgtgcccccttccctacattttggaactgtaatgtaaactcacggccattatatggtggaaatatgtgatctgccttttcattttaactttataggtgattacagttaagagattgaatattggagaagaaattttgaactttgaaattttaaacaatgttgagactattagagactatagagggacttttgaaattgaactaaatgtattctgcattatgatatagttataagcctatggaagccaaagagtgcaatatggtagtttgaaggaaaatgcccccatgtgcttctagtgactggcactaatagaattgtgaccctgttggagaaggtgtggaatttttggaggacaagtgtccctggagatgggtattgagatctcagatgtttaagccaggcttagtgtgtttctttctcttcctgctacctgtggatctagatgtagaactctcagttccttatgaagcaccatgtctgtctgtacactgctctgattcctaccgtaacaataatggactaactctctaaaatggaagccaaacccaattaaatgttttcctttataaaaatatacagcattttatcattcattagcctgatcaagtccatctgtcacaatgtctcagaaacagagattaatttacgtaatccctgacaggtgtgcctgaagtcttctctcatggttgattctctaatctgtcaggtggataattaacactaatcaccaacactacagcttgtatcctctaatgaaatttacagtacaactcgtgtcctttaattaaatcaacaatctattccttcaaactagaaatatttagttaaccaaacaaccctacttttgagaaaatgtatgtgtccctctttccatgtctacttttaaggaactacacaaatattctgaatatagaaatatataaatataagaataaattgacagttaaaacacagagctatttccaaataaaggaaaaattataggtgaaaggcaataaatagactatgttgcttaggagctgtactcatgcagagaccctttactgtgtctgaaggacacatctgagcataatttatctgcatagagatcattaacacattaaagccatcaatgatatgcccaaaatctcttttccaaatacaggtgtttgtcacatattcttaccacaaatcagactttagatattagtagttcaatatatggaatctacataaatgtgtatagcttaaattgagttaacaatggatagactcactaaatcccctagaaaattagaacatctgttactataataccaagtctatcaaatgcaaatttagtgggttagtgagaatagatgcacatagagtatacccaagttgatcaaaattgattagtaaattaaagcttgatgtgtctagatctttaatattaaaaagacacttggggcatgttctccacatactaatttctcagagtacataaaatgcaacttgaaaatactagcaggagggcagaaataacttcaaagggagattgattctaattctgctggcacagtttactttccaggaggaaaaccattttccatgaaacacacattcatgtaaaactcccaaaattaaaaaaaaaaaactgctaaaaattggggtgcatcatgttaacccccaaagattcaataaataagttaaataaaagaaagaaaaaagatctgactattagaaagcctataaggtattttcttaattagtgattgatcgggggagggaccagcccattatgggtgagaacttccctgggatggtggtcctgggatctataagaaaacaggttgagcaagtctggatcaagccagtaaccagcatcccttcatggcttctaaatcagctcctgcctccagatgcctacctgacttttttatatgatgaccagttttgctaaagtgtaagaaaaatcctgccccccacccccaggaaaaaaacgttaaaaattccaggctcatctttacaaaaacaaacaaacaaacaaacacaaacactaaatattcagcatgcaattcaaagaaagtctaaagaaaatatccaacatatgatgttggatgatacaacagacatagaatgtttccagtgttggtggttttgttttgttttagggataaatttcataactgtagcccacagcaggtagggtcacactgttgccctcccatctgcatacttctaaattgctattattcttaaatccctaagaaaccactttatgaactccatgtaagtttcaaagacactataaccagaaaagctgtaagttttcttcctttaaacatcgacactactatttacagaactcacacctacattggtaggaaaaaaatattatagctatatgcctaaattaactttattttctttttctcttcttaattgtcatcactgaaaggttcatgtctgtctcagcaatctctcttttcttctttttaaacaaaacaataacaatcactaaatgtggtgactgtcttgaggacttcctgttcttactttcttattgaccacaactgcattctccttctttgtcgtttctgcacctttcttgacaccacctggctcatattcctcactcaaagtaattactctaggctgagttctggtccttttagctctgaaacatatccttacctttatataccttatatccctactatacagattgcttgaatttctgtctgcacatagaaatcaagcattttatatccctctgatggctatgcttgcttgtcagtttaactgtatctgaaatgaaccaccattcagaaacggatcttatttggatcttgaggtagggagacacatgcctttaatttgaaccacactttctgctggaagcctatataaggacattatagaaggaaagatttgctttttgcatgcttgacgtcaccttgctagtatatctattcttcacgagaattaaagcctacttcttggggattccagcaagtacagaagaccagctgagaaacctagcatcctgggactttattttcacaactagactttattagattagttggactgcagcctgttaagccattcaaataaaatcccattatgtatgtatggaaccctgactaatatgattctcttgaagttctcttagaagatgggcacacacaaatcaatgtgttcactaataaagctattatcacatattaatatctgacttggttaagtttatagaatgtagtattggaatgagtatttaggcagtggaagaactctttcttaataagtgaaagactgagagtttggctccaaaactcaaaaagaaggtaagcaaataaacaaaaaccataactgatgatataaaatttaatacttttcaattaagtttcgaatacctttcaaataagaatgatactttggacaggtaaggaagaattgaatgtagttagtggccactgagggaggagtcattcctctttcataatctgaatactggtaggtttctcatatccaaatgaatgttgacacctgcatgcatacagatactagtaattggacgcagggcttttttttttttttaacaacaatgaaaaaagaaaccattaacctgggagaatgaaggcgtatatagcagtagcaagagtttagggaagatagtggcagctgagtatcgtcaatacacaaataaaagttttattatttctaataataaagcaatattatatgaaaaagacaaagctgggcagtggtggcacatgcctttaatcccagcactcaggaggcagagttaggtggatctctttgagttcgaggccagcctggtctacagagtgaatgccagaataggctccaaagctacacagagaaaccctgtgtcgaaaaagcaataaataaatagataaataaataaataaataaataaataaataaaatccaataggaaacagagatgtcatcatatttaacaatggtttttcaaatttaattgtaattgcttggcagcaatatataattttttcaatcataacaaacaaactagaattaagaaaggcattcctagctctttgtttctcctttcccctaggacccaacaatatcttcaaaatgactttaagattagacatttcagtatggaaacctaggagccaactttgcacaccagattctaacacatagaagatataagcaaaagagactataacttcaatgactcactcaacttaactgcccacctgtactcttattcccactgaaggccccagtttaagaacttacttttaaaatgagaaatgaaagaaattaagggtatctttgcaaaattcagggtttggtccttttgttaaatagtcctactataagcctattacatttagcatgaacatatagaaaattaatgaccatagaacacagttataatagagatgaactcattattcacagttcaatatggaaattttttctaatgttgtgcttgttagacgtttaggaggtcatcatagagacagggtggtctttatctgttggtctacattgggggcaagtgacagtggtaattcaaatgtatgactagacgatttgcttgccatgggagtatcacctgctcctgagattccagactactgtcccatcccttggggctgcagaaaaaccagagtctactacttggatgcgccctccactttatgttgagctaaacgaatttgaaacagagcagatacaataaattcagtcaaaaacaccttgccttgggaaacagatataaaaatttcccattaaaaaggaggccctatctatagcagaagaaatccaatacccatggaggtatataggacagaacattctatacaaccaaaacctggttaaaatcactcttccttttgcacctcaatatgctttattttcataattaccttctttcattcaacacattacaaatacattttacatttttctatttctgattattgcttttctcatgagggttcccatataatgtaaaactcacatgaaatttttgtgattttgccctattaatctagtaataccaatttaattcttagacacatttggggaccttagcagataagagatgaaggtgtgcattaatatactaactcctcacaaagcctcaacttcttttagttaggaatgttctataaaacagaaatgaaaacaaggacataggatattaatatgaatttttaaagagttcttactattcagtgaaggccaatattccatattgagatcattttactgagagacagaaatagcaggaaatctaccaattccctaagataccatgatgtggataaaattattttcatggatatcagcctgtctttttttctgtagactggatctgaaggattaaaatcctcaaagacagtgatcactaacatatttgatattttaaagtttcattattatgtcacaaaaagcaaagatatttcgttattttcatctttatttgttttggttcaaaaatgtttttatctttctcatctttccacagatagggtatatatacctacagacaaaacatggtactgttttctacattgagagagtactatgtgcctcattcacagattctcctgtgcccctggacacctaatattgaggtttccttattcatttctaaccaccagaggagaatattcaaaacatgtaaaggccattgtttcaattaacaatagttaatatagacttctgtctagagtgttagaatatgttttttttatatacccagtgaatcactggatgctcaccaattgtctgccttttttgttttatactgtagagtatggttgacatagggtctctctgtgtatccctctctatcctggagtttgccgtgtagaccaggctagtctccaactcacagtgaactgcctgcctctacttcctatttgttaggactaaagtatgtagcaccatgctcagctaattttatgtcttttcaaattaattatacaagacatagagcttagaaacaacaatgtgctacctaatggtggatacattccaaaaactatgatattgcacagtttcttcatgagcatgacagaatgtacttgtattgctcaaatatatagtggtgcctacaataaaaacaagatgaaatatgtcatgactcaataaaattattttttctaattagtagatatatactctaatgtaatgaaaaaatattattttgtaaacacataagtctgttggattgatattgaatatttttatcagctaccaggcataaagtatgattgtttatgacacagttttacatagttacttttatggtaggcttgcccataccagcaccattagacgctgatatagtaagtttgttttacgataagctttctcataccagcaatactatacataggtatagttagttggttttatggtaggtttactcatatcaacaataccacacaggtagagttggtttattttagaactgttcatgccagcaacaccacacacaggttatcatactgcagtgttagatgctatgattttatagtgtttataacctcattaaaaacataaaaatttcagctccactattatcctttggattagcactgcatacactgtaagctgtttaccaaactcctgagttaggtaggtagtatatgaccctacatcaatgtgggcttcagaacaaatgataggctacatgtactcaaggttattctgtgtcaggaaacactaaagcaaaaagtatgagaacactataccctgctgcatcatggatggaccaaagatgacttatggaagaacttctatgggtacatcatgtatttcctccagctgtgctcttggaagcatttcttagttgatgaaatctctaccctgttaggttacactcttgacttctgctaaaattcttttttttttcctgagaagaaacttactgagccaaaacaaactctaaatgtcatatctgccaattagcactgtgacctttctgaagtcactctccctttcctggtttgagctttgtttttctacagcctcaaacatttgctacagcctggtagcttctttatgttgattcaaactgagaaatttaacttttagcattaagctggaaaggttgaagttttagttctttatgaaatttttattataagcatttcatttttcctccagtcactaaatttatgctaatactgacaagatgggaatctatatgatgtctgcaactacaaggagctaaaaggattttgagctacatgcttctgtggaccagcattacaaactctgccagatggcagtgaatttgtcatgggtcatgctatgggttcatgattgtacctaggcacaggcacaagaagaatccagtggcaaccacaggtaattcatttcagtgattgggtcctggaaccaactaaaatgatcttgctagattatttaaacatatgtagaatcttagtggtaggtttgaatattcatagcaattatctagttaatataatcttgaaagggggaagaataactgtatgcacctagctggaaaattattttaattaatgaaatagggcctatcaaatttatcaaaattctcaatccttgtaaactcattaataaaatattctaaacaagattagctcaagactctggcattgcacctgaaatgagctggatagtgacagagggtgtccccatttctgaattctaactgaagttctaaagtggctactttagcttcatattataagggaagttatggataaatggagttctcattgctcactttattctcagttaattcaggcagaaggtctttttcataattttctacccctgttgatagacaccctttaattacagcaacaaccatgaagtatcctggttgtttataccttctagacaatgaacaaattgatgttcaggagagcgtcttctttctttctccttcacttccaattcctcttcccagatctgctgtattcatgctgagagaaatgtcacttgaactttaaaacacaggaagcaattgaggctttaaaatgataactacaaatgatcccatttttgacaaatttgtcagacacttttggtagcagtgaaagtttgtagttattgcatttctctgaaacacttaagtgtcacctgagatatttcacctaagcaaccctgctttcacatttgtctgtccttagtgaacaacttctctcacaagagtgtgcatcctttttcaagcaactacctgctatcccagttatacgttttcagcattaaaagggtcctgatcctaccggacatgactctttcctgaccattcctttcctgctacacaaataaccatgcaaactgatttttccctcctctgggccatcagttgcatatcttatttctgctgattattttgcttattgcctcagtagaattcaaatgatgccaaaccaggctttccattcttctaactacaagtgggttagaatttaatgttctatgtgatattaaggtattaatacatatttcagttttaatatgattaaaaactaatgctgacaattactttaagcttagataagaaatttactttcctacattacatcaaataaaacttgaaaaataccgagaaatgctactttaggggactagatattgagagatttaaccaaaagaagaaggtctaaaggagttgagtttctgtagcttcatcctgtcccaaatgagccaatcctgtgcttttgaccagaatagcattaaactaccaccatctctgtacattttgcatgtacaaaccagcatcttcagttttgatactcaaattctagacaattaggcataccaaattcacttattatttttctcacatattttatgcacttgggaaaatctcatttagaaatattctctgaatatactgggggaaaatctatgtatgtatatatctacttatctatatatcatttagcatctgtctatttaccatatatcatataactagcaatttatctaacatctagttgtcatttatctgtttatacgtatatacagacatgtatgtcaaacaatatacataattaagtaagggacaagatggtggaatgttgaaaaacacaagagaatttaaattctggctccatggatcattttgcaaggtcagatacctcatctttgcctttacttttcatattaatgatacagagataatggaacctaaacgtagggcaaacagttttagagtgttaaatttcataaagtttgtaaaatttaatgttcaagtacaataatttttttctgaactactttaaagtaaatacgtttagtaatgtaagcttgaaagtgaatgtgagcctggttacaccatatcctcatgtctgggactgcgtgccttttgttgttcactctaacatgtttatgaattatgctacactaacaataaattataactataacattagttataaaactgttctcctgatggaccatttcttttctttgatgtggcaaccttccttatattttcaattttgctttgaaggctgcttggtaatatataaggacagctattcttgtcaggatctttcttctacttgcttggcatagattgtgttagtcttcaaattcattctcactctttccagagagttgtgtctctgcaaataccgagttgtatgttttttgtatcacattaaatgaagtaacatgtgagcaccagtcccatagtttggggctattgaaatttgtattattcctcagagattttttttttactggttcctttcattttgtttttgttgttttattggtttgtttaaatgctgtttgtttgtttgtttgtttctgtctattctatcttatatttgatgatttattgagttgggtatttttagtctgtgtttagtttagcttattgttctatgcttttcaggaaattatatttcctatgtctttatgttgcacccatttctgttcctcttctgagtgtaggttttctgctgtgctcttgagaacttacttggtaatgaatttcctaacattttgcttctcttgtactgtctttgtttgtccatcagttacaggtgtttgtcttatgtgtaataatattgtccagtgttttttatactttcagaaataagcttttccatgtttatatgtaattggaatattctttggatgatcaaccagatcccaaataaagactccatgaattattattaattgtgaatgcttaatagagcttaggcttggcccaccagggcttttaacttaatttaacctgttgctattttatttacattttttcaagagaaaatttacatttttctttcttcaaaggattctatacattaattaagtttagagagtatgatattagagaaatgcctaactgctttgtgtacaaattatacacacagtagcatgagtgactattaagcattttcttttttttcttttttcccaactttttttattaattagaaacaggattgttttacatgacaatcccagttactttctcccacctgtcctccctttatttacatttttcctccagtctgtttacctttctttcattctgtgtgttctactttcctgctttctctatgtctggctggatgccccctagagtctccctgttgtttgattttcttttttcctcaattctaaattccccactttgcttattttccctgcctggaaattctgattgtgcctcctccctcactattagccattcaactttttattagaccaatcaggtgccttagacaggcaaggtaaaacagcaacacatgtttacatgattaaacaaatgcaccttgtctttacatagttaaacaaatgcaacacatcttcacatagttacacaaatgcaacacaactttgcataattaaacaaatactctgcaacatttcgacattttgtttgaataaaaagacagttatagctttaacatagtaagattatatacaataaagtaattatcaagcaagaattgcatttaaaatatccagcccacttgtatttggcaaattcagagaaactatgctattatctatcctatcttgtgaatccaaagttttgtacctaatccactttctattctaacttgtattaccaaccaaaatttatattctcaaaactctaaacattatcttagataaacatattatgccccttatatcagtttagggcatttcttttctgaatttgttaacaaggaaaactgtaagattaactatttcatcttcaactctaccagagacctgagaatgttatactattacctgagctaagagaatagtgcagggcaagcaacttccaaaatcatagaaatgacaaaagcagctgtctgactggatagtcattggagtttcatgtgaccttcagatgaaagggcatctttctttgatttacaggcttagaatatctgacagactttttgtgaaacatgaattttgaatgactgtcccaccttttctttgcaaagttaggcatgtattttcctttgtatactgattgtccactttgtacaatgtgctgtcagcagtcaaggcaagggaagtttcttgcctaaatgtctaactttgccacaatgaaaggtccatacgtggaggttcttcagcacccataatctttctatggagtaaattattgctgccagaagtagatgtgtctcactgtcatgaaagccttaggtttgggtcgggatcaatgattagttgtgggtgtcagcttctacttccaccagctgctggatgaggactatcaggtggcatataagtcagtcatggctttcagtgaggaaaccttgaaaatctacagtacctcctttagtagttcagtacttatccctagcataggtgaggacttagggagcccattcaacatagagggatactccctgagctaagacacacaggggtgggcctaggccctatcccaaaggacatgatgactctgatgacaccctgtggaagacctcaccatccagggggagcagaaaggatatgtggtaggtagggttttatttgggggtggtggtagggcaggatgggagggagaagggaactgggattgtcatgtaaaacaatcttgtttctaattcaaataaaaagaaatctgcaaaaaaaaacccaaaaagccttaggttattaacgatcataaatgcaacattctttaaatatctgaagcatttaaagatatcctatcagtttctggctattacaaataatgctgctatgaacatggttgaacagatgtccttgttatatgagtgtgcatcatttgggtatatgcctaagagtggaattgctgatctagtggtagatagattcccattttcctgaggaactgccatactgatttccaaagaggctacatgagttggtactactaccaacagtggaggagtattcccctttctccacatcctctccagcataaactgtggttggtgtttttttttttttttattttagccattctgacaggtgtaagatagtatctcagagttgttttgatttgtatttccctgatgctaaggatgttgaccactttcttgtgtttctttcagccattttatattcttctattgagaattatatatttatttctgtaccccactttttaattggattagttggtgttatacaaactagcatcttgagttctttgtaaattttggagatcagccctctgtcagatatgggttgttgaataccttttcccattctgtgggataccattttgtcttactaaccccagactgatagctggaaaatcagcatagcactgttccagaccccctgaatgtagaagtcagtttgaatgtctagacaatctatgcggccactggtagtggatcagtatttatccgtaaaacatgaatggactttgggagcctactccacatagagggatgctctcttagcctagacacatgggggaagggcctaggccctgatccaaatgatatgacagactttgaaaagtcccccatggaaggcctcacccactcagaggagcagaaaggggatggtgggatacagggttggtgggggcaggggaggaggaaatggagagggaactgggattgatatgtaaaagaagcttgtttctaacataaaaaagaagatatcctatctatctaaaatatatctgtttaatgtttaaaacatacctgaatccattttttattgttatcaatgaataattactaacctgcattatttaattatactaaacacattacaatattagattttaaggactagaatgtggtgatatattatttatgattcattaaatcttgcctgagatttcagaaagcaaagtcaaccacaaatcatagaagcctgacacacacctttaatcccaggactaaggattaagaggatctctgagtttaaagaacaccattggctaccagagagtgaatcagtgctcacacctttaattccaaggtttgagaggtataaaagttagaggcattcattctccagccacactaaagataggaagacatagagtcttgggattttccagccatggagaggagagcatagcaatttgagattttggtggagccgggatcacctttcagccttaggtagagagagggatgagctagtggccagctgattttcttttctgatcttcatcttgaagcttgaaccccacatcagtctctgtatcttttatttattatgttacactacaattttgtattatatttttaagtgagctgcatagttataataccttaaatagagtagaaacatatgaatggtataacaaaataaccataaatttgtatcaatatacaaaaattcatacgaatgtaaattatttgggatgaatagttgtcattttattctatattcctatatctggactaaataatgacaaacatccatagcctgttaaattaccaaatacacccacctcaactcttgggaatgtgggcattgtgttctctagactgcttccagttgtcttggagaaacaacatcctcaggggaccatgagaaaattgagataatggttaagtcttaagaaaactagttataacattttttgtctggtccctgtgtaatgggtcttttttgaagtccttgcttggatagtctgtgaggctagatcatatcagccagcggccttgaatatgttctgaatgcagaactctgagaaaactgtaatagaggtactctgaaaggctggatcacctgaatgatctgttttcattgttatgttgttctgttgtactgaaaatacacatatcttaaaacaaatactctgcaacaattgcctgcttttgaagaaggtgtgtccaatttactttggaatataaatctctttatatggatgtccacagctagctttaaatttttgaaatattgtgttataatttcactgaacagtattcttatccctttcctgcttcaaatttcattggttggaggtgtggtcttatgtttagactttaaagcacatcgctgaattcttgtaggttgtaatcatgtgttattatatttttatactttacaaatatgtaatttcattaacattgttatattaatctgtgatattttttctgtgtctgcacttcaggtgtggtttcaggtgtccttgtcattttcagtatcacagttgtttgattcatcggctaatagcttgatagtgagttaatgagaggggcctataagtttagaactacaaaaatataaaatattctctttccctagtagaacaatttgaaagtagaatttctaccaggaaaatgacatgttcatatactttcatatattatacttcaaactttaaaatgaaaaaactgtaccaaatgttaaagaacaaaaacattctaaagtaataacatatttggaagatagtatgacaaaatgttgtgtattcaattatatagaacaaatataatcctgagtgtaagggggaaatgacctttatgctaacatctgttttacagaagaaaaaaaatactcctgcagattcttgtatattttagactattataaatttgtaaatattgacaatattgcaattaaagtatgtgcatcaagaacaaactatacatgtcccatgtctcacacttagtggataagtcaagatactgaggtagttttctgagtggttgatcaagtctcatccatccaaacttccccttctttccaatgataattgtctacttttgaacactagagagaaatttattataataaacacacatattcaattttatcttcagtattttcatttgatgtcttaaactcaaagagaaagaaaacatactttgtttaaaaatagaaacgaggaaatgtggtatttaaatttctcaagatggtatctgaaaagacagaacatttcttgtaaagaataatttctaaccccaaactgttgacttttgtacaagtttcagaggataattatagggaaagatttgttcccaatacaaaactggtggtggtgagagaaacctagtgtctactttgatctgaagcaccacactgtaccttaaatactgcaaggctgaaaccaaaacaaaatgttgcttataaatttcagtaatttcccacaggtgtagcatgattttatcttaagttgaaggatgttacatattctgatccaatgagttgaacaagactaaagaaaatggtgctataaagacacatgttgactggtctaagttctacagaggacaatatacattttagaatgcagtttgaggcaattttttaaaatccagaactaattttatactgtgaggtgaaccattcagttaagatatcttcaaaagggtcaaagattcaagatgagtacaaaaaacacaatcacagatcagtaaatgtaggatgcaaacatctttaaaataataagcaactaatctaattttaagtggaaaaaataatagaagactttacattaatgattaaaagctaggattatataaatatatcagtttaacaactaatattggatgcttataaagagcaaagcttctttccaggagaattacaatagggctgttctggactaaatagttgtttttcctccatttttaaatttaaaatagaaacaagattgttttacatgtcaattccagtttcctctccccgcctcccctacccccactaacatcctgcctatcccataccattcctgctccccagggagagtgaggtcttccatgggagggggggtcttcagagtctgtcatatcctttgggatagggtctaggccctcccttgtgtctaggctgagggagtattcctccatgtgaaatgtgctcccaaactccattctgctagggataagtactgatctactacaagaagccccatagatttccaaggcctcctcaatgacacccacattcatggggtctggatcaatcccctgctgctttcccagctataagtctggggtccaagatcatctacttgttcaggtcagctgtttctgtgggtttcacaagccttgtcttctccactttgctcattactcttccttctctgcaactggattcctgttcacttctgtgttaagctgtgggtatctgctaaaggctctaggatggcatataattcagtcatcaagctcattctcatgggagagcaattaaggtagcctctccactgttgattagatggttagttggtgtcatcctcttagatttctggacatttccctattgcctgatttttctttaaacctatactggctccctatatgatggtattttgttctcctctattcttccccctacacaaacttcctgctcctttatatcttcctcactcttcctcttctccccttatcaagctcttagttccctctcccatccccacatgctcccaattatgtcaggagatcttgtccctttcctcttctctgggggaccatgtgtgtctctcttagattcctccttgttgcctaacttctgtagtagtgtggattgtagactggttatcctttgctctatttgaaaaatccatatatgcatgagtacataccatgtttgtcttttggtgattgggttacctcgctcagaatggtttcttctagtttcatcgatttgcctgcaaatttcaagatttcattttttttggctgagtagtattccattggaattaaacaaaattccatatttgttttccctcaggacaaagccttgaagatcttctttgctatatccctctaatgacatggatggagtaaagttctctgcctatcatccaggtttgaattgtaactgacttgacccagagaacatgacagaattgacactggacgaatttgggatcaaacaaccatgcaataattttgattgtcatgctccatgatatggtagtaaacctaaactataaggtgaacttacagagagtgagacaccatgataaagagggatcagagcaccaagagaagcaagccatatgagtcaatcaagcactgaggatgtagagcctcaatccagagtacaacagtggcaaagtcttgagccctgccagaggttttaaggtttctatgatgtaaaataaactcctgaataaagtaactgcattatcatcagatttctctagttgaatacaaggattagatgattgaatacaattctttccagtgagtgaatggtttgtagagagctgggtactatctgtatcacagagtacatgctaaattcttcctgaaaaaaaatcaactactttacagaagttggtatcagactgaatatataaatatgtcaagttccaggaacaaagatagccaaccgactctgtcttctatggagagaataaaaaatgataaataaaagaaaaataaataaatactaaggaggagatgtaaggcacatttataggaatattctcccggagtgtgaagtcatattcatacatatgtatatgtatgaatatatatgggcacatatacatttatacacatatatagacagtcatagagcaccaaagctttattaacttgaaatgaaaaactgactaaaaatatagttctgataaacttaaatccacttccttatgaaaatgtgatttttcttttttctttcctgttattgactaatgttatttgtgggggaatattttccattaatgtgttttaaaatgcaagagcacactggtataaaaaggtaactgtatacaaaagtttctttggaaatactattttccaagcacaactaatttttgctaagaccatgattggagccagatgtttcattggttgtagagaatgatatttgcccaatgccattttcggtttctgaaaaaaattaattaaaaattgattctctcttactggaaaacatgttcatgtatttggcagaacatttttagaatggtagattctaattgattttattctagtccacagtgaaggagcattttccctttagtccactagacagacaaaaaccttcaagcataaatggttctgctgtctctttccactctccacataactctcatagtaacagacaaatcctttaaagcttttagacagatactgagaggacaggagagtgctcagtggtaagtgtgcttgttgggtcaatagcctgctatccatagacaaagttcatggagatcaatggtgtgggtggcaaaaacaaggaaggttcctaaggtatgcaagccacctgcattgatacagagtcagtgagaaatgccattttaaaggaataaaatatattatgataatctaagaatctgttgtcctcctttggcctcttaattcacttgcacaggagtaaatactggagtacttatatgtatgtatatatcatgtatacatatacaacttatacaaataaaaggaaaagaaacatacaagaactataatgaaacaaaattaaataaaattattccatcaatgacataacaacagtggctagtacaatacattaaaaaattgttatttggcttagtcatatcactcttaaatgtaagaccatgttgaagttatagtaaaataacccataaaaactgatataaagctgatatcataaaagattaattgtaacttcaattattttatttctcatatatgtaatatgtgaaacaatatagatgtttagataaatgttatgctttgtaactaaattgctttaaaatgtataaattttgttttaaaacaaaaagatacttatttttttatgtgcatgtgtttgcaccatatacaatcctgttgactggagagaccagaaaagaaactgctgttgtgaaccaccatgtggacgcaggggcaggagaacagttctgtggtgatatactgcttattatttaataaagtcaaatgcaaagctacctacagtcatagagccaggcagtggtgacacacatttaatttcaggacttcagagacaaagacagaaggatttctgttagttcaaggtcacactgaactaactacatgaactcgatccattctaaaagagaaacatctcacacaaaggtgatccctgcacttggggtcacatccctttaatcccatcacatggaaggtagagacaggtggatctctgtgagtctaagaccatcctgggctacacgagagtgaatcagagctcacacctttaatcccaggatttgagaagtataaaatgaagaagccaacagttagttgcatgtgacatttactttccagacagggaaggcataggaatgtagtctaaggcttggtgggaagcagtgcagtcagcattgtgcttggaggattttcaaggacaggacagccctttcaatctgaggtagaggtaagagcaagtggccaacagggttgatttctgatcttcagcttgaagtttgaacccaaatatctgtttctgtgattttattatttgttttatataggtctctgcaaaaacagcaagtactcttcagtgatgagtcatctctccagcccacagtgaactttcaaaatattgaatattgtcaaatagttaattaggaaaagtggtatttttggctttgaggtctccatccatcctgtgatggtccttcatgtccctactctatggtgaccctttgtcttgatagtttctatccttgattttttcaatcaacaacgtgtggtcactttagtcatttgtataatgtctatcaacttccttttgaattagtgagttctttatttcaagacagagcaaaaattttgtaccatgtttattatgaatttactccttgttttcttttgtgcaggacatcccagtttgaagtttacatgactcaaagttgttcctctcatgtagtgcatattgcttttattcagatacagatatttatggcaatgatttaatataaatatcaagtaataatttctgtttattccaaaactagccataccttctcttacccttgttaccacaacaattttcttttctaaaatatgttttattgtctgagtgtgagtagggtgtgcccatttacctgcatatgctagtaataaaaacgagagtaggagtgattaatgaagttcttacaagctgacatggtttctaggacctgttgaatggcatactccactaccattctgcttgctcagaaatacatatcaatgacaagaagcacaagttgggtccacttgtttcacacctagaattacaatcaactctctctcacagctctaagtatcagactcactcactgctaccctgtcctgcagagatatttcagtcctgctagctagttactcattccattggcttctatttttgaatcagatgctgaaggatacaattatttctgctttaacgtatcatatatacctccaaatagtccttttacacatggaaattatattttaacactatgatcactccattgtgcttttatatgtttgtgaatttatacatttaattgctggtaaatttttcagccagacacagaatgaaatgagtctacattgtagtacttgagtaacatataaagcagtaatatatagggctttgaggttagggttgctttcattctttaaaaatgcatgattgacttaggttaggaatgttacctgtgtagaatcaaaatacacctgtaataagaagtcagtgcccttcggtttgtgtcacaatgaactcatgccctatgcttttattaactaaaaaaaaaaaaaaaaaaaaaaaaaaaaaaaaaaaaaaaaaactaaaatataagtacacatttctctttctttcctttccccccaaatctctcctcactcctgccaggaaagttgtgttatttaaactatgaagcaggaaaaactgattcttacttttgaacttacattgcttctatcttatagattgttattagggatgataatcatatgtatcatatatatatatatatatatgacttaactatacagtaagtgataaaccatatactatctatgcacattcctcaaggattttatgtgtctatttgttcatgtgaagtcatttaaatatataaattaattagtaatcatgtcatttatatccttagctatttccaggatgttgctatttttaggtttaggctaacaggaggcagaaaagtacaataaaataaatgtggacttataattccattatctcagattatatgagcagagatgtaagtttacattttaatgagtatttccatgttctgtccatctttcaactctgtcaactatatccaatgataaaaaatataaaatattgaaactttaggaacaatttaattgattccatgaatctattcctgtaacaatatttttggttctacctgagcaatttttttcttaaggtcccaccattaagatttatttctttagtttggtctaaataaacattttgtcttttttacaatagcttcttcagaacaagaagttttcatgcattcaagctatgatggacaatatccataccagactcaaaacagtttggggaagaaagaacacaggggaaactaattagaaacaatttgccaaaatatattaaccttttcatgacttctattataagggaaataaaatgtcctttcatcagctttttttttttaggattggtctattctccaaacattttaagataatttgcagcacaattagtagccaattgtaattgcagttcatgctatcattggagtgagtaacgatgaatgacatctttaaaaatcattctaggattttcatctttttcactgattcctccatcatgtcagttttaaatataaacttgattaatttacaatgagaaataagtgtagcaggcataactatgggactaattcaattgttttttttttttgctggtcagtgaataagcaattggataaaattgattagactattgcacaatcttttaagtcatatcaagcaataggccaggcttctcacactgggggtgttaaattcatcacatgatttctggtatgtctaaccaaccaaaaacatttttataactttatactaacagccaaagaaggaaagaaaactcaactagatacaagacatcattatgtagtatatatttccatttgttatattcacaaaaattggaagatactaggaatattgccaggaaagcaaagagaaaaggagacatgaggcttcatccatgcttttctctttataaggatgacagtcactaaacttcaaataagatttgcaaacaggagccaagtgtttagatagtaaccatgatccttatgtagctgtgcatctaattttgaagacattcttgtgcctggaaagtttactatataaatatatttgttgatgaaatttgtgcgtgatggattatgatgtggcaaacttcatatactgaaattcactgtacatagtcttttaaagtatgttctaaattaatgtgacatgcaagggatatcatcagataaaagagagacagagagcaagaggcagagagagaggggggagctatctgcttgagttaggaaccacaatgaaggattcatggactactgtgatttggatatgaagtgttcccttaagtggcttacaagttgaaggcttgttttccagggttattgagaggaaggccgcaagatgagaaagctatcttttagagttaatgctgaatacctaattaggaggcatcacctaaaggaaagaatgagtccaatagagatgtgacttcaaagagggtatctggtctccagatgcttcccctttcctctacttctattcctccttctttctttccctcacaccatcctctttacctattttctcttcgtccccatccttggccagtattcagttagacgcctctctgacagattatttcacagccatgatattctgattcacctttggactaatgaagtatatctgaaactttgctctaagataaacctcccttcctttaaagagattttggcagataccatgtctcagcaacgtaaagatgatgagctcactcacatttggattggcctatttattcacttaaaaccaatgtaactgcttagaaatattttatattttaaatattcttgttgagtgtttttaagggaaaccaaagtgagagcattctgttgtcccttacttaatcctggcccagctcttttgcacagaatagagactttccctgtgagatagacgctaaaatgcactggagagaaaacaatagaacatttctgcagtctgagaacctgcattcacaaagttgccactgctctgctgatttactttggcagactggaattagaattttgattgccctacgtccctctggatctttcttcagattctgtgaccttgtgtcatgtaggaatgtttgtgtgtgtgtgtgtgtgtgtgtgtgtgtgtgtgtgtgagcgtgctcatgcgtgcaagtgtgtgtgagcaagcatgttgtgtgtgtgtttatttgtgcatttggttcaatgatagagatctcaagatatgcaaagatgtcaaagcaataaaaatgcatatggatgttgttcggtctattcttagagttactgtacatgttcatgaggttgctggcttttccatcatgccttttttatttaaattctttaattactactcatatttacatatccatcccccccattccttcgccctcccatgttccccattaacctcccaacctattcgacaacttctccccagggatagtgaggccacagggttccttcacattctgtcatatcatttgggggagggcctaggccctccttggtgtatctgggcttcaatagtatctctccataaggaatgggctcccaaagtccatttgtgctctagggttaaggactggcttcactgttagaggtcccatagactgtcttggcctcctagatggcacccaaatctaacagctgatggaagtagaagcagatatccacagctaaacactgaactaaactggagtctagttgcagaggaggaatgatgagcaaaggagtccattcaaggctggtgtaacccatggaaacagctgacctgaacaagggagagttttgtccctagactgacagctgggaaaccagcatggaactgatccagaccccatgaatgtgggagtcagttcggaagccttgaaaatctatggggcctcttgtagtagatcagtacttatccctagcataggaatggactttggggtccatttcacatagaggaatactccctcatcatagacacatgggagagggcctaggccctattccaatggatatgatagatgctgaagacccccttatggaaggctgcaccatccctggagagcagaaagtttatgggataggtagtgtgttagctggggatgggggaggagtggagggagaaagaactgggattgacatgtaaaacaaacgtgtttcttattgaaataaaaaaattgagaaaaaacaaaaacaaaaaaaaaacaaattataaaacacattgtctttgtcactaggagagaagctttttctcttttcattgcctcacctaaaagcctctcactttctcctgaatttgaaaatgctagttaaacttgactgacaacttattgatttgaaaagtacctttgatattagtaaaataggagtttggttctgtcagtgaaggcaactcctaagggattccctaagaggagggggaagggatggttagtgctgtcacattgacagaaactagaatgatcttggagatggggttctaatcataccaatgggggttttattatgctaattagtacagaaagatccatcttaattgtgggtgttatcattccctgttcatccctagactgtattaaatagagaaatggagctttagagcattattcttctcttcctgcttcttcactatgggtacaatgtagtcaactccctcaagcttatgtgggctgctccctcaagctcctgctgctgtgccttccctagaaaaatggagaaaacttggaagtgtgagccaaaagtaatgaaaacaacaaaacacatgttcctctccctctcctttaagctactttcatgagagtaattattacacaatggggctataaactctaatggtgaacctgccctgaatgtggaccacatgatttcatgggttcagaggttgaattgaaactatgagcaaataactcccccattagttgtttccttggttatttcactgcagtgatgaaaggtctcagtaagtcatttacctgtatccctcaactatacagttcattttttatttgataaatatgaaaccaattcaaattatgtcatttttagacaggtttccttatttcaatccatagaatgtattgattttcccctttaaacttcaggactaataaagaaaacacagagaaccatgaagacactatagagtaaagggtgaaaatataactaatttttcaaaaaattttaagtatattaacaaaatcaaatatttttttactaattgacagatatttataaacattctgagtagaaaatatttgtaataaaagtttaatgctatgttaacttgatcaacaatacaggaacataattatcaaagagtgaaggggaagctgtagccacgcctacttaggggctggctacagatgtgcctgaccatgcttgcgagggcatggtcagggtgttgtagagtgactgccttttctcttttggtttcactttggtacttgatggacagaatgctgccacgctggctggctaggtcgctctgtaagtaaggcttttccctattaaatacccttgtatttctacctgactctgtattggtaatttcccagtataaaagagtaatgaaggaatcctttattctgtttccttttctttcttattctctccctccctcctttctctctctctccctctctctctttctctctctccttctttctttctttgtctcacacataaaagcacacactctatgtgtattttttatattatattctcattataaagataagagcattgctaagtaattcaattttcagataaatggggtcataattattaacatatacaggatatttttgtgctacttgagtataaagggtaatcagttctttaacagaataatgtcttgctttgtcttgatagtttggttcttcaagactgtttccatgttttgaaaagtctcttaggacctctagctccttgggctcatgaatatgaacttgttacctttctcattatttttgttgttttgggacagtctcatattgtaacccaagctgatatggaatttagcttacagcattgtaagcctcctactcttattaattgtctcccttgtgtagagagtatagctgtgtaccaccagatcctactgtttctccttcaagagacaaaggcctttttttccagttgacttctgagacattttctcatgagtacatagattcttgagaaatcttttattctataattaagtggacatttagtaaacatagcctcttaaggatccatggtaaaacctttgaagtgaagcaaggtgaatggctaatagaagttagttatactccaggcccagtataggaaaataagggcactttggggagaaagctggctgaaggacacttggactccaggattaaagacaggacatgatgattagtctatcaaatagactatgagtttgcctagaattctgtctcctttaaacatagactaccacagggaaatcgaatagctgaatctgaaaacattccaaagccacactaatgattagagtgaacacaggtgtcagacaactgtggcttccctgctgttgttttttgtgagactatgttctctgatgatagctgatcatgaagaacattcaactaacaagtccttgataacttgtgcatcctctaactgaaaattccattggccactctgtatgtttcaaatttgtctctgaatcttcagatttgctaatggcaattttcatatataacttaattcactttagtcttgtatctttagagaatccagactcacctctatccagtctttctccctgatggaattcaacatttatttaatacaaagccaacattctgaatcaattttttgggttgtatcctgccaccagtcttactttgccacttttcctaataattctgaaatattaggaaaatcccctggctaataaaacaatttccatattattgaaacaggaagaaaacaattggaatcatcaaatatgtttgtcaaaggcataaacaattgtattcttttcataggttatatggcagattttctgtaagcatttgaaacacacatacattctggagattccagcactttctagaccatttcctttcctcctctatggacataaacttgattggttagttgtccacttaccaactggaaaatttagtatgcaagttagaacaggccatcctgttctgcaacttcctttagaacagtgcttatttttcatcatacaattaaaaaccagatttagtgagctttcaacactaatggcaattcatggcactccatcaaatcacttctcatcattgtcctcccttgcgaattcaggcatgccatgggctttataatgtattttaattaaacatttcttctcaatatttaaaattacattttacacagtggagtttttattgttcagtttaccgacattactcagaatgtgcagtagtgaaaggagagctctctgtgtttacccatacctatgcttaacttctttcttctttagaatgttccaacttccctctcttttctttcttttttttaagaaaagtatccttattggttattttaagttagggctactagtgttaaattcataactgaatgctaaattggtaattgtgtggaagtttgggtttgttcttcatttcagaagaatatttacatgattgtttcctctcgggactgctaaataccatgatattttcttgttctatgagagttctaattagagatttcagtggttttctttgatttttctcctttacataatgtgatatttttctcaagctgtccctaacattatgtctttaattttaatttgtttcttaccttaaatctttacaaggattacacagaatttatctcaagtcatccaggctgtcttcaaaatcacaatgtggccaaggatgatcttgaaatcttgatccatctacctctactccttgggtgctggggttaaagatattcatcaccacagtcacataatgtggtataggattgaatacctggccttgtgttgtctaggtaggcactataccacctgagctacacacacacacacacacacacacacacacacacacacacaatgacaatcaaatgtaatgctttattgggtaattattgccctgttctacttttcaagttcattaattctatactttctttcagctctgagtctattctcttagcttttgatcttattttttcctcttcccaggttttgatcttttaaatttttgtatgattaatttccatatattgatcatagtgttcagtagtacataaaaggaatcttaggaaatatcaatatctgtctatataatcttagaagttcaccctaaaacatttaaattatgaattgttttattccttttttctcttcctttccacctcccccttctccttccatcattctccctcctttcttttcttccctccctccattactcctcccttcctccttctctcccttcttccttctttctttgaaattgcagaatagtttctgtaatgtacaaatcaaatagcttcctgaaatccaattcttaggttggtttatattcactcctattcattttagaacacaattcaattaacttacatcagtacccctgtataccaactttttagggtatagtttttgaacaaatgaatttacataaaatcccattgtctttaacatgagtatttttttatagagcattgtgtgcttcacatgtaatgatttttataatttagctgattctttctaagacatttggttaatgagtcccatatccagacacagtggtatgaagaaataataacttcttttacattatctggttatttttagagcacccaacatatttgaaaattgtagaaaaatgatcatgtattattcaatttcaggaatttaaattgtttcatgtttcataaccaattttcatatgcattttatgcttccaattaatttgattaggttaaatcaatttgcttagtatgcaaaacgaacagtttgggatttagttatgacattttatgtatgtgtgcttatgattgtgcactactctcagtgtttctacttcatctttccctagcctttcccagctcaactctctttgtttatcctacttcagaggttttctgcttgtttgttcttgttttgtttgtttgttttacaaaggccactactttgcttcaaaatgtcctggaattgtatggagacagggagccctcagaatctctgattagagaagggaatgatttctgttcatacgcagttgctgtcatgtcctgtatgtgttctgaagcctcaaccaacaccacttctttctggattcttgtcaccctgatggcccttttagtgaagactaacaattcagtcttatttcatcctcatcaaatccactgctgtagctgtttttcaactcagaaacactgtcacttcttaccagccatagatcatttctgagtggctcaatagtcattgatcttgtgttaatttttttgtgtttttattccagcttcaggggaagttagacacttcttggtaacattcaacctcataaaagcctgtgtgaattaaacaatcacatatgagatttttctcggtttaatcagatgctccacagcatctgaaatggggtataggcagaagataaaaaaaaatctttcttgtaaataatatctttgccagcaaatttgtttcattacatgaaaagttcaagattctactttctttaaggattccatagtgaatacaaaccacattttctttattaatccatatgttgtaggatatttagattgtttccatttcctacctattgtgagtaaaacactaatgagcaagaatctgtggagtagcatagtcacacctaaggacagatgcaaaggagtgatgtatctaggccatatggtagatttagtcttagctttctgggaattcttcacaatgatatccatagtctgctatctcagcaactgtgaatgacagttcccttgtaccaatatcccctccagcatttgttatgggttgttttgttgatcattgctattctgatggggaaagataaaaatctcaaagttgccaaaagtttgatttgcacttccttaatttctagggatggtgaacattttctaagatatttctaactactttctttctttatttacaaactctctattaaggtcctagagacatttttagaatggctcatttgtgtttctgaatctttgttttttgggttcttgtatagctgcatattaaacctctatcagatatagagctggctaagattctgtctcatgcttcttcaccctgtgggcagaaactttttagtttcttgaagtcccatgtatcagtttttgtccttaagtcttaggcaaatagagtcctattcaggaagttctttcctacacgtatgttgtgtatgttactgcccgtgatttctactaacagcattagtgtttcactgttgaagttcaagtctttaatacacttggagttaatttttaagcaaggtgatagatatgggtttaattccaatcttctacacatgaacatccaggtttctctgcaatgttttccgtcttatgttttcagcatctttgttaaatattaaacagttgaaattatgtgtgctaatgtttgggtcttcaattttcttccattggcctaactgtctgttgggttttgctgttttgttttctgagacagtaccattttttttattacagtgtccatatactgcattttaaaaattagaattgtgatcctgccagcactgtttgtttacttgtttgctttttgtctttgttcaggatgcttttggatatcgtttatgtatttttatttttctcgtttcacttgaatattagaatgtttatatctatttctaagaataatgagatgtgcattttgattgggattgcactgaatatgtaaaagaacatttgataaaaatggcccctctttatgttttaatgggtataattaacatcctatcattgaagttttccttccagaatatactgtagggctgggttagtggatatgtattgtttaagtctggttttctcatggaatatattgttttctccatctacagtgactgaaagctttgctgaatatagtagtctgggcttgcacatgtggtccattaatgttggtagaaaaagtacccaggatcttctggctttcacagtttccatagataatcacagtttaccagcagccaaaagaaaaaaagaggaggaaatccacacaaaatgccaccacaaccaccaatacaaagcaaaaaagaataaacactcaatgatcactaatatccctcaatattagcagtcttaacttacctaaaaaaagacacaggctaacagaatggtacgaagacagaatccatccttctgctgcatacaagaaacacacctcaatttcaaagcagtcagtacctcagagttaagggttagaaaagattttccaatcaaatggatccaagaaacacacaggtgtagcaatcctaatacctaacaaattagatttaaactaaaatcaatccaaagagatgaaggaagtgatctcacatttatcataggagaaatccatcaagctgaagtctcaattctgaacatctatgccccaaattcaaagcatccacattcacaaaagaaacattactaaaactcaaaacaaatattaaaccccacacacttttattggaatagttcaacatcccactctcaccattagacagaaacaccagacagaaacttaccaaagtaacaaaggaactaacataagttaaaaaccaattgggattaacagacttctatagaacattccatacaaacacaaaagaacataccttctcatccccacctgaaaccttctctaaaataaaccacaaactcggcaatatagcaaacctcaacaggtacaaaaaatttggaataaccccctgtatcttatcagaccaccatgctttaaaattagaatttatcaaaaacacaaattgcagaaaacctacaaactcatgtaaactgaacaatatgtaattgcaccattcctgggtcaaagaagaaaaaaaagacattaaacatttattagaattcaatgagaatgaagacacaacataccaaaagttatgggacactttgaaagcagtgctaagaggaaagttcatagcacaaagtgcccacatgaagaaaatggagggtagtcacactagagaattaacagcacaactgaaagctctagaacaaaaagaagcaactcaccctggaggagtagaagccaggatataatcaaattgaaggctgaaatcgataaaatagaaacaaaatacaaagaatcaatgaaacaaagagttgcttctatggaaaaaacaacaagatagacaaaccctaatagcttaatattttggtgaaagaaaattaaagcgctctttatctacttcaataaaagaagtagtcaatacttttgagggtggtagctcacaaatggaagtgccataaatgtcatgtactggaaatataatagtaaatatattcaaaattcaatagcttaaatcagaattacttttgtaaagataccatatcttcagagaggagaaaaaatactggatagcaggaatagttagaatcatcaccagaggaattattcctttgctttgctagaatattctaaatttgtctgagtatgcaacatttacatgcctttgctcactctatttaaggcaatatcatgaatttggatccacgtctttacatgcatatgtttacatacaggttgttagtaacagggatgtttcctagataatactttgtttgggtgatgtcttcatcactgttctattgctgtggagggctactatgatcaaggcaactgttataagagaaagcattaatttgaggctttgttattgttttggaggttgagttcattgtcatcatggcaaggagtatgctgacatgcagacaggtagtggagcagtagcctagagctacatcttgatccataggcagagagaaaaatgctgagcatggcatgggctctgggcacacatgctccatatcatccagaaagccacacctactaatctctttaatctgtttaaagagtaccattccctggtgaagcagcattcaaatattagaggctgtggggccattcttattcaaatcatcacaggtaatgaatgtatatttaaataaatatagggaacatgctgttcaagaataaagttatcagaattgcaggtgctttgtgtaatctttcttgtgaaataataaattaattcataatttgaagaatagacattccattcaatggaaaatcttgaatagagtaagagacatcactcattgtcagttagttagcaaacattaaagtatataataattaatttaatgttgattccttcacacttttactacaaaaaattaagtctttacctcagtgtggtaccctggaattttcatttataatagatatacttgatggtacttatagctaggtttgttattttatatttattcaacatttttcaaatttgatacttaagttttaattatcttatagcacttaaaagaaactgatgcaacatttactatttttacaccttctattattttgtcacttattactctgtgagctgtgggggaccaaaatatttccgatatggaatattttgagatccagccttgggttttactaaacaggaacaccagaaagctctggcccactattgtattgctaatgccagtaaggctactactgtttaccatggcctcagggtaatatgcctcctatttccatctctgtgggcctaagcatctaaataagcctgcacctgggtggaggtggtaggtgtgtgagtgactagggaggacaggtgtagttagggaccagtgactagaggagagaggagaacaaagagagaaatggttccctcatggtattggcaggatggttaagaaacagaagaaaagatggctactaacgaaatgactgtagttctacaacatggaactgagagctctctaaagatgacaagatgcctgtgtttggtccttatcgctgctggtttgctaggagtttccaggtccacacacccccactcaggctgaacctcatggattaaagctgagacatgctgggtcgacacttgtaagacccccggaagctcaggcctccaggatcttttctcaggactacagccaccccaatcaccatgcagaggcagaaacttgatgcaaacagcaagagtttttaatgaaaggtggatgtttgtacaaacaggccctctcagcatgcaggctagagagcagccccattcccccaggcacaggcatttttaaaggcaaaaccacaagcttagggagggggcctcgactctctctccctcgagtacgtgaccagagtccctttgtcttgaagggagggctgggaatcagatagcctcctgacccaccagttgtaaaacctgcagacctcaggatatgctaactaatcttgcctgagcaaatggtagctatctctttgtttcatagggacccttaattgttaattattgacacattggacaacctgtttccttcatgagcccttcagggagggtggccatctgggaattcttggtacccagttatctgatggccttgtaagggagtaattgctggcagctggtaaattccaggcacaaagtcatagtagtggcctgtttctgggtcatagtcagtttctggtttaggccgccctacattccctttggagattttccttatctgggctatatttctttgctaatttttaagtctttcacactgagcccaatttttctggagattaaaaaagggtgtttaaaaactagaataagggttggagggactgctcagcagttaaaagcatttgttgctcttgtgcatgttccaaaaacccccatttgactgtcaactacatgttgttgtggtcccaagagatcaaatatcattttttcgtctctgtagttaatatgtatgtatggtgcacaaatgtaagttcacacacacacacacacacacacacacacacacactaaataaataaatattttttacattaaatgaatcagtgaattgagaatgttttgtaattagcttagcatggtatttatgaaattttatttttaaatgaaattagagaattgtttatatacttttggaaatttgattggaattatgggtaatactcaggacgtaaagaaacttaggagttatctttgctcattactaattgaaataattttagaaaaaagatgtttcatgggggaggggagggagagttagaagaaagaaaaggggagaagaggagggaagaggacacaccgagggagcaagaagatatagtaaggggaagaatagaggagaacaagaaaagagataccataatagggcagccattataggtttaaagagaattctgccactagggaaaggtccagagatctacaaggttgaccccaactaacaatctaagcaatagttgacagtctacattaaatgcccttctctgataatgagattgatgtatgccatcctagagtcttcatccagtaactggtggaagcagaagcagaaacccagagctaaacactgagctgaactctagaatccaggtgcagagagcaaggagtgttgagcaaaggggtcaagaccaggtgggagaaaaccacagaaacagttgacctgaacaatgggttgctcatggaccccagactgatagctgggaaaccagcataggactattccagaccccctgaatgagaaggccactttgaatgtattgacaatctatgggactactggcagtggatcattatttatccctagtacacaaatggaggcctttgggagtcctttccacatagagggatactctatcagcctagacacattggggagggtctaggcactgctccaaatgatatgacagactttgaagatccctcacagaaggccttcctctccctggggagcagaaagtgattgggacaggaggtcagtgggggcaggggaagagaggagggagagggaactgagatttacatgtaaaagaagcttgtttctaatttaaataaaaaataggaaatccacaattagaaaaaaagatatttgtgtttattgtaaaatctacaagaaaaatctctttccatattaagtatgctatgcaagaaatgtatattgggtatatttatggtagatgtgggtgagtaaaatagttttgaaagacctcagaaagaggtactttcgtagaaggagacccgcacccaggaatcagtgaaaccacgaacttggatgcaaaaccgcaagaggctttaatagtggcgcgggtacccggggacttagcttctcttaggccaagccccgagcccaggaagaggggtccttatatagcaaaagcgcagtacagaagcgaaaagcatagttacagggattctattggacaatttaatgaggtgcaaagttatttcaaatcagcactttctcaaggtctagtagtcaggcgaaacggccttggctttacttatcttcttccgcgtccagatggctgaccttgggtcggagggagcgttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgttcgcagctcctggacaaagcagcaccactgctctgcctctcccagctcaagttccccttccaggcgctgcccgcactgcactctccagcccctggccgcatcctggccctgccctgctcagtccccgctgcgctgccctcggtcaactgctccggactcctaccctatcctgggcggcccttctgggtcagcagccgctgcgcacaaggacgatcagcggggttacttcgccccagaagccggggacctgggcggcccagggcgcgagcccgggtgatgtcccctgcccagcatgccgcagcgccccgttttctcctcggccaactctcctcccgcccccacccgatccccagcccatcctgcctgctccagagagaatacccagcaccggcacaggcggggaagacagagaggcagcgggcaggggacatgcagaagcattccgagcaggtctttcagtttaatctttcaatatgttatctaacatctatcaaacatctatcatttgatttttatctaactaacctaatatttgttctttcagcctacaaatgaccctagtttattcaaagaaaacatcaggtatttctcttccaaatttgaaagacatataatatgtataaggtatcaaaggaataattgtttcgggtaagcttttaatgttcattcttttttttttatttcttgtctgttgccaaaatgtgataggcagaaggtaaataaaactgcaccacttttgattatcaagaaaatataaaaattatataaaacctatgctttgagttgatgcatattcattttcaaccaaactgcatctaattttatgcaactttttgttttttaatttgattactgtctttattttactcattttttcatttaaattagaaacaagatttttttacatgtcaatcccagttccctctctctccacacctcccctacccgccactaacaccctacctatcacatatcctttctgctccccagggagagtgaggccttccatagggggtcttcagagtctgtcgtatcctttgggatagggcctaggccctcccctatgtttctaggctgatagagtttccctctatgtaaaatgggctcccaaagtccattcctatgctagggataagtactgatctactacaagaggccccataaatttttgaggcctccacactgacacccacattcatggggtctgaatcagttccatgctggtttcccagtgatcagtctgggggccaacagctccttgttgttcatgtcagctgtttctgtgggtttcaccagcctggttttgacccctttgctcatcactcctccttctctgcaactagattccagttcagatcagtgtttagctgtggctgtctgcttctacttccatcagcggttggatgaaggctctaggatggcatataaattactcatcaatctcattatcagggaatggcatttaagatagccactccactctttcttagattgttagttggtgtcatccttgtagatctctggacctttccctagtgcctgatttcactttaaacctatcctggctccctctctaatcgtatctcttaatttgctctcctctattcttccccctacacaaacttcctgctcccttttgtcctcctcactcctcctctgctcctcttttcattctcctagctccttatcccctccccctatactcccaatttgctcaggagatcttgtctctttccccttcgacaggggaccatgtcctccttgttgcctaaattctatagttgtgtggattataacctggtaatcctttgctctatatgcaaaatccatatgtgagtgagtgcataccatgtttgtctttttgtgacttagttaccgcgctcattatttagcctacaatatattattagccaaaacatttctaaattgaaattattaagcaataatccacataaaataatcaagaatccacagtgggaaaatgtagacatgtagatcattttggtagaaacctagctaaaattttctatgtaaattctgtctcatgctaatgtgtatgcaaagaatcacagtagctaatatgcatattcatattaaattacttggtcttagcatttgagaaaacacaacttattttcatagtctcttctctattatcctaatgtttgtgttaagctctgttggttattatccaaccattttagtggaatccattattttccagaattacaataccctcattgttggctaaaagtgattaattactggttgtataattacattataatgaaacacaaagaaggtttgaaataaaatgcttggttttgtttcctttctcctgtttattttggaattaaccttggagttttattaactattattaaaacaagttcaatattaacacaaaataacatatttaaaatgtcagcatggattaatgccaagcaactatagatatctaactttagaattttaaatggtacaacaaaatggtttgcttattaagtaggtcctgggattataaaaggaaatacataataaacatgaaactggagaattgatggtttttaattatacttagaataaatgaattaaatcttgaagttttaagaggacatttctattaataagatcatgactcccgtcagcttaaaggaatcaactttgttccataattctagataaaatcttatatagattgttttagaggagttttctccctagtaatcttccattctaattcttttatatcatcacataaaattaagtaaagtaaatccagagactttggcttccccattttttaaatagagattttaaaaaatattttaaatataaattattatgtttttcagaataagtaacatgagttttcaagttctaaatattacctcttaacatatactgcccctactcttttcaaatccatggatgcatttttcattcatttttattacatgtatatatgtaaatgtatgaacatatatatatattttcctaaatttaatcggctcaatgtgtataacattatgttatttgtatgcaatcattcagaaatgaacatttttattggataattaattggtatgctgttacctagagaagactatttctcctgctctcagcattccttagttgcttgtagctctttgtgtagggttgatgcattatgggcttttccccatctatgtaacatgagtacaaataaagtattgtctttattctttcttataaagagaaacatacaaagtgtacatgatgaagtctttgttttagaatgtgtcattctttctagatatacctaaattaaatattagattttctttctgattggcatgtatttgacatcggaaccattatacttttaaattttcattgctaaaaatgcaatgaactgtgaaccatgaaattactttccagatattctgtcatcaatattgtgactagtcaatgtttggtgagagctttatttacagcatgcttatatttaaggcaacactacacatatttccttagtagcttaggtatatttctaaaaatgtgttttctgaagttcttacatgaaaatgtagaattcttctcgttgaaaagatacaataagggttaagaaagtattttaaagatgaggagtgatgatattagaaagaagacagtgttactccattggagaaaactgattttccctcttccagcatgtataaattacagttcagttgttatcatttaccttagtggttagattttcattcattaattttttttttggttttttgagacagtttctctgtgtagcttatgagcctatcctggcagtcactctggagatcatgctggcctggaactcacagagatttgcctgcctctgtctcctgagtgctgggattaaaggcatgtgccacaacactcggccttcattcattaactttaaaattatataagaaaagagcccaagagaaagcataaaagtcagagatccacttgttcttattcacacactcagaaatcccataaaaaacaaacactgaacttggagccacaacataagcagaaactccagagaagacttcctgtttaggaataattgaccaatatataaggacttcatttttttttgtgtgtgtgtgtgtgtttatacatgtacttatatttggttacagtttggtggggttatttttttcctttttggatgatattttattttgtttggtttgggggagttttgttgatatactggatttatttgttttgtaagaaagagttggggggaatgaaggggaagatctgaaaggaaatgagagagaggaagaatattctcaaaacatatttaatgttgaagtcattataaataatttaaaatataataataaagaagagaaagcttactgagtctgtttttgaacaggatgatgtaagtcgagcaattaaaatggattcagctatagaaatgatcctccacattcaagacagtttctccattttgttctctagtgggatttatatgcttccttcaggttaatagttttctgtatccagtcctgcttcttatgagccttgtctgccttcagcttgtggatatgtcccattagaatctattttgttttggacacaccccctttccattcatttttatgtatacatatatacaaacatacatacatacatacatacatacatacatacatacacacacacacacacacacacacacacacacacactccaaaaacatgacttcttataaaagtttcttatatgtgaacttacaaagtatatgtataagaaggactatacaattcttattgtcatttttctataaccaggaaggaagagtcctgacataagttatctatcccaaaatgagtcagagaattgactttacttaagataaaatataaagaggcaagattgaggaaaacagcctaaagtttgtggtcaactaatacttagactttttagttactaaacatttagtaacttcaaaaattttggtggtacagcacatttacaagtaaatgatcaaaaccaatattctccccaatcttttgagagaaaagaaatttttaaggtaattattggatgaaattggagacaactgagtctctaaaactgtcaacattactgttataatctagtgttgttattatactactattaatagggaggagaaagaaggaagggagaaggaacagtaggatatttgaaagatgaggaagagaaggagaaggaaagagaacaggggttttaaagcatacattccaacaaagctaaaatatcatggaaatattataaagaaattaagtattatgatagaatggtcagtctaactcaggatggttcttatgattgccaagtccaggaggctgagaaaggtctataagcttttctagggtgctgagatcagtcagtcactaaatatcactcttagaatttgaaaccctgggataaccaaccatgcagttcaaggatgactattcaccacagtctgagttttgtaaccggctcatggggaaaatctgaagattaattagccggtacaaatgcgctgtgtataattgcttttattttgtgttgaatacaagaaaaaatgcatttcttaaattagtaagaactgagaaagaaaagatgatctaaaatacagcactgggtgcattagattaatgcaatcagcattctgtttaacaacccaattttattaagcttctaagatggcaggggaacctgaagaaaaagttcatgtgctgaactgaagtttattgacccagaacaactccttgtactgaagaaaagaaataacttgaccttttaggcccctggaattataaagccacctttgaattataattttctcttggggaagttgattgatcactactaaaaatgctgtcagtaaatattataatttcctaatactttgtgtaggattcctgtaaagatggagattgccattgagacacaagtagaagaaacattgtttgtaacctcaggaaggaaaaggaataatttctaatttatttgcaaaataacaaatatgcataattcatctcttctggctcaattagttaaaaactgaagagtggatgaggaaaatggacttaatatcactatgtggtaagcacatggttggtgtttccaaatggagtagataatggcttcattaatggtgtgtgaatttctcaagttccacatgagcttctctatggtcttgtctccaaagcatgtaagccaaacctcatatcacactagaatatcatgttgaagactcactgaaaatggaaatatgacttcagactcacaataaaacaataaaagaaaacattaacttgtagctaaaatttctattgcactactaccagaagaataatattaaatgtaaattgctaattatctaaatgtattttgttgtacctttttttatttctccctctctcttattctccccccctcatctgtatcacacatacagatgcaatgttgaatattcactttacaagtaattatcaaatgatttaaatgcatgaaggctatttatatgtctatctttaatacttttgaaaatagtggcacacatagagcaggttacatttaaacacccagcatttccaattgctatagacatggggcgactttgcatctcaatgcaaaaccaaggtgggcatccagctcccacactttaaacaaaaagcaccgtatgacagaaagtaggaaatttgcagttggacaagtaagcatgttgtctaaatgaaaaaaagagaaatgtatctcctgctagctctattgatgaatttgtatttatgaatggggattctagacatctttagagggttgagctgtgtataaccaggggttgaaaatttccaagccttgacaagccttaataacttcataatgcaacccctcatatagtaaattttctttaataataatcatttctactacaggtttttactttcagtggaacactaaatttttgtagttgttttgttgccttgatagacaaatggttgcatttttgttttgtaattttgtggcttccctgaaagtgtgaaattaatttccttacttaagaacacttttgaaaatatctatccttagccatcagggaaatgcaaatgaaaacttagttttctccaattgtgtcacactggggaaacaaaacattcctaatggttggccctatgctcagcagtagatggccaacacgaaatgagctcaatagcatctttgaaggctcactgtctcatgatgttgtatcaggactttttcctcttcttaactttacaggtcctttgcatataattatggcttcctatggaatcctgtgtgtgaatgagtgtgtttctgcttctgtgtttcttatatttttttgggggggggggctttttttcttctgtttatttttttgtcctatttatatttgtttgttcctgttttatcttattttacttcatttttattcctttgatgcctctttgttttctaaggagatgcagaaatgtgtggatacagatggaagggagtcggagaggaactgtggggatttggggaggagaatcagttatcagaatatattttatttaaagatctattttgtttattatttatttatttgcttttttacttaatttttcttattttttattagttcaaattaggaacaagattgcttcacatgtcaatcccttctccctcttcctccccttccccaaccccctacctgctcccatcccatcaaccctccactccccaggcaaggtagggccctagatggggctcctcaaagtccaccacatcatcctggaccgggcctaagccctcccccatgtgtccaggccaagagtgcatcccttctcatgggatgggctctcaaagtcctttcttacaccagggaaaaaatactaatccactaccaggggacacctagagtgcagaggactcctaattgacatccatgttcaggggtctggatcagtcctgtgctggcctcccagacagcagtctggggtccatgtgctcccccttgttcagtccagctgtttctgtgggtttcaccagcctggtactgacccctttgattttcattcctctctctgcaactaggttccagagttcagttcaatgcatatctaggtgtctgcctctgcttccatcagccactggatgaggtttctagggtacttttaactaaaactacagaaagatggagttcatgactcctgtcttctgagtatcaattctgagatcatgtgtttaaaatctgaaattgcagaaacctgccatgctctgaaatattacctgagccttcagtactctgatgcagtacctttaatcatgatgctgttctgtgatacacaatggacataggcaaggacaacaaacctcgggtttatctgtcaatcggtacattagtattatgtgcaatggacctatttaattatgattctactaagtaccatgcggctgtgttgtgaaagcacttgaatttaataccaagctctgaagaagagaaagcaggagaggctgccaagtatgtgagaaacacagtcttgtacacaagctcaaaaatctacacttaaaaattaaaaaaaaaacaaaaacaaaatggagggaaaagtgttaagcaaaaattctaagaggcagttctaagcagtactttcatcctgagaagtttgggtataccaacataggcaaaaacacaatacaaacatgatattcccattaggtttggtgaacacactgagctaaactgaaatgttcatacctgagtgtatcaataaacaaaacatgcatttttactgcatcctaaaatatttatattattgtaaataatatatttacaagggtatctcagaatatatttgtcaaattatgagtgtatttgttttgtgtgaatatggaagcatacgaagcttgtgtacatgattaagttgatgtttgtatgtgtgcatgtacagatacatgtgtggaggacactcagagttctgctctgttacattctgccttattccttcaagtagaggcctcttactgaacttggagctaggctgctagccaggaaatcccagtgatgctcatgtctttgcatccaagtatgctagagttaagcgtggatcctaaatcactaggcatcttttattctttaagcattttttctatattttgcccatatgattgcattgttttcacataagcatgaataatacatgttatattgggcccatagaggtcagaagatgtgctgcatccttctaactgcagttccacataaaaatgagataaccatgtgggtgctagaaatcaaatgtgggtcatctgcaagaagtgcaaatgttcctaactactggacaacctttcaattctcagaattagttccttatgtgggtactggtattagaactcaggctcccaggctttttcagcaagtgcccttacccactgacccattatagttcattctttaaatactagcattatttggatggacatcagggaaacatgagtaattgatttgaacgtttaattaccacttctggattcaggtataaattaaacagttgaactgactgcatagttttgcagcatatacaacatctcatttaatcttcatgattctcttcaaatcactgaccatggctgaagtgtgttaaaggacctaactagaacattaacatctataaatggataggctatgaagataaacagatttcagagaacaacccgaggcagtgcaccagtgatgacctgcctcctgagacatcagcaattccacagtacttttctgaatgctggaaaagaagaggatggacagtagattcactggtgggaaatataatctctgtaatggcctttgtcacactttgcagcttataaaatgttcctgtgagacaaatgtgacacacttagttttgcagtgagctctttagggtccatcagtcttcagcgatgtgtcaggaaagatactaaaggcatggtggagtgtgttcctcaggggagttttatcagctctttaataaagcagccatttgtaaaatgctgctggagaaaacaataatttagaagaaattcatcaagagcaatggcaccttactttgaaaaggcagtgcaaatggagaaagggaatccagtgctgagtgcttcattttaggcctgaggagcaatcacaaaggatcaggggcaagctaatgttgggtttgctactctgtatacaatggagtatgaaacaggttttccacccacaggtcactgcaccttgaacttcaaggggacaatgatgcctgcaaactttctgtgtaaaatgttagtataaaaacttattcatggggcttgagagatggctcagccattaaaggctaggctcacaaccaaaaacatattcatgaatgtttctgagacaaacaagtgttccctttcattgaagtttttttttgtgtgtgtattaataatgtaacatcactgtttagaaacatatctccttagaacattatgttagatgtgtattttattgagaatccaggactaaactagttagtatgaaacaggtagaaagattatcagtaaaatttcttctcttaaaatgttttgtagtttgtgttgagatatcataaacacataaaaatgtattgatacaggatgtcatgtatatatgtatatatgcatatatatatatgagagatgattactatgatgatagaggacagatagatgaagatatatatataatatatctagataagtaggaagacagatggtagataaatagatagatgataggtagatagataaatggatagatggatagctcctttgagacagaggtttgttatgtagtccaaagtggcctagaaccattatattctaggtgaatacctttgcagttctccattctcagcctcaaaattgctgggtttgcagacttgtgttagttcacctggtgtaatgcctcattttaaacaatataaatcttatcctattaccaaatgtcaaatttaaagtacagtgtttttaatcatctcgctgctataaattaggtacctagagctgtctcttacattaatgaaagattttgtcctttgatcagcatttcccaatccccctttattccaaactgttggtaataactatccaattctctgcttctattgatttgagtatttcagattccattataagggaggtggtgtggcattattttctttctctggtcttgctaattttgcttaacaaactgagttcagatcatctatggaatttgctttagtttgctttgtgttgatatcatgaagattatgactcaagaaaagaaagtttgtttgcctcacctatcctatcaaccagtgaagtaaaatcagcagctcaaggaaggatctaaagcagggtacgtggaggaatgttgtttactgactggcttcctatggcttcctcagcttgcttttaatagaaagcaggaccccacctctgcacctgcccaggattggcacatactccagtgtgttggacactcatacattattccttaagcaagacaatataaatatattggcattttctcaataaaagtttcttttccccagatgattctaatttgtctatgttggcaagaaacaaactaaccaaaaccaaaagttctaaccatgtatgtttgtatgcatttttatattcattcaatccccaaaagacatgagaagcccatgtcaggctttaaaaagtaaaagaaagcttcacacaatctttttaatgatattatgtttgaagctgccagtgcttttttgtttctgcacctggcttgtggatccatggcgaatttgtccactatttggccaatggtgggggagagttcaacgttctccttgttaattcctggggaatgctggggagttacaagtgaggtcgtggaattaggaaggttaaggttgacaatgatactaagctggctctgcaatgcaggagggtaaggagatgtggatctcaagagtgattcctatcatgagacttttagtcctgaaaaaaatccctgtccaagttgccactcttgtcatttccacttttgctttttgaatgagccagaaatgttttcagtagtttcttttattctctttttccaaaaggaatggtgatgtagatctaatataatgtttaggaatagaatatacatgggggctgtaagtgagacctggcaaagaattgagctgtgtagctaacacctctggatctgtagttatgctcagaggcctttctgaaagctgtctgaaagctgtcctgtcttctcattcttctcacttaaccattcattgaccaaatgtttctttgttttggggtattttatgggacatttattgaatgctggaatttccacttcagtaattatttctgctactgcagtgttggtttctgattctacagcaagtacagtgttttcaatatcattctgttgtgacataacttcaatgtcaggaaagatggctgtatttctaaacacatgctgatggtcctgtgtctccgacactgctgtccaatgtccatttcaacccattctacacattccctgaaaatgacctcaatgacaccgactcaacgattggcttggctggcttccctcgtatgggaaaataacctcctgttactccttttggcttccttctacccattcctactaattccccatgattaatcaccctcctcccttccctccttggacctttgatagggctcctcttgctaatcgcctttggtccttgagtctttaatcgacctgtggcgtttgtcaagcaacaagtggactctgctactaagcctgtcctgatacaatacttaagccctcctcttcccaggatgactttggcccctctaatataaacaattttgggctgttccctccaaagaggaactaacccacttcctcactgccagcttcagaggtgcagacctggatggtacttacaaggagacctcattttctgaggaatatccctgtgtgcaacggggttgatgtcataggcatccagtcggtcctgcctttcagatggctccaagaagccatccccaaggtcacagaaaaatgtcctttataaaataaccatagattctccaactgggggccaggcctctatccccctctactgaaaaatttggtcacttctttttatacaaggaagggggaatatgtagggagccaaagctaacttggcatgagatcccaggccatgcttggcaggccacatagtttacatagcagctccttagaacctcagctcaagaaaagaaacaacctgacccagtcctccacccacaggctccgtcacctaagcaacccttcctggacctcttactcataaactctttactctgccaaacatcctctttgtggcttcctatatcctgcatatactaacacctggtgcacaaacaacccattttgcccctccccatatcctgactatattagctagccagagaaaaataaagtttgccacttgatcaaaatcctgccttgtggtcgttctttctgcatctcttatccccattccctatccctgactctcttgccccacgttgatgtcctgcaggtcaggacactgcaacaataaaataaattagtcaaataagactaagccatgtagaaataactgttaataacttagtagagaaaactttatggagaattggcaataattgtatctggtcactctggaaagggtaattacatagaaagaattcatattcaaggcaaatttaagaaagataatctgtgtgttgattcaacctttggattattattactattattaaccatttattaaacacctctgttttttttttctaggcctttggaagtgctagaaatatggacatcagtagcaaaacagtatttgtttggcattatagaagaatgccacacaggaacttatagttgctatgaattcatacacaagacaggtacatgatcatgtgagtcactatcctagtatgggcatgggaaagattaaaaaaaattccattcctaggtaagcagctttttttgagagattgtttctggagaagagagagtaaattttcttaagaatattggccttcaaatctagatatgctctagtagatggtccaatatatctacacatatctagcatgcaaagaaacccaattaaaaaatgtgaatttgatttgggatcacaaagtggtggagggatacgggacactttgaaggggaggctaatacttgaagagtgttcatgggctttggatctggagacaggcttgtgggtttgcataatttagatttagatttttttctttcttttagtttgagattataatatagttacaccattgaccacttccctttctgttccctgaattctcccatgtacaccatcttgttctctttcaaattcatgacccttttaatgattaattgttgttaaatgcatatgtgtatatgcatatacattcctaaatatatccatttcagtctatacaatgctacttagatacatgttttcagggttgaccattcagtattagaaaacttattggtgtatagttccctggggtagatgattactcccattctcagaatttattagtttcttatagtactttgtgtagggttggggcctgatagtctttttcctggtcagttgtatttctttatttttgtcgttgattagctcatgctttaggtattcaagttggtaagattttataaggtgtagcatctgagattactaggtgacactatagcaccaagctccgtgatcctctggttcttaaaatatttctgccccctctcttctgcaatattcccttatccttacttgtgggagttgttttgtagatgtgtatgacaggagtatgtgccatgtctcagcattgtgactggttgtagtttttgtaatgatctctttctgttgcaaagagactcttccttgataaaatgtgagcactgcactcgtctgtgtgcataaggacaaacatttaaaatatggttagagattatactagtttggtaattatttcagtagtcctttatagttgtctaggttacctgtacaaggcatgatttcccacttttggggaaggtcttaagtccaactctagagctcttggttacccctaatgcatacatataacactactgcatctttagggctactatgccatgctggtcaatgtcatggttcacaggcttcatagctgtgtagctctgttgactgcatctctcttttggaaggttgcattacttaaccactgttaagtaatggagggtgaatttgactaaaacatatcatttgcatatatgaaattttctagaaatacaaaagacaattaaagcatttgctgtagagccttgtttcttcaaggaaggggctctattgattcttttttatctgagtgtatgatttggcccaagtcatgtttctaacacacctgactggcttataagagatcaaatagcattttcttctgcagattctgattatagctgaggtttgtaaatcataaagggttggtatctcagtgtttaagccttgattaatttgggaccctcttgagttctttaaggatccatgtgtaaagaaatcatctttctttatactaatatgcaggactcttcctgatctaattcaagacatattacttgtcacacagcagataattatatgagtgatattgttaatatacaaggactcttgcttgtttctcatgatttatttttatctgcattgtttcctaaggaccaggctcttaggtgacatgctagcccagcatacacacaaacagatggatacagtacatagatcatttctttccttgactttcagggactacatattcatgcaaatacaattgatcttggatacatgtcagaaaagttcattttaataaaatcatattaaaagtctcttttaaggaatggttgggatttctgtaaagatcagcctgttatgagggaagaagtagcattgtggttttaggagtgttacaagcaaaataatcaagatcaatgctacctggctttcatttatttttcagagaatagaccattttgtcctcacattgatttttgttgacacttgaaatgtttccattttatgatgtgtgtggtttatttatatccaggcactgctagacataccagctttcaagggaaggagaaagacagcctgggcatgctgtcattcagttctaccacttccattcttatttacaatgcaaatgtccctaaggaccattggctttaggaaagaaagatatagaaaagtcatttttaggattctctataactatagacatattcaaagtttacctccaaggagttgaaatggagattttaggaagcctttttgtttttagaattgagctgtaagggaaaaatgtgtacagctgtggggtcagagagacaactctccctagaaagtacttgggaggagattatgaaaatgggaattcaagtcaccaggacatgtctaaactttgggagtttagtatgggagcctacctgtattcccatcccacaggaggtaggagaattccctctgctagattgttagtcagtctcaaccaagtgatgaactccagattcagcaagagaccctccctcaatgtatagggtagagagtgatcaatgaagacacataatgtctttcacaggttggcttcacacattcgaaagtatatatgtgtatgtacttacacatatgggagaatacatgtacataaaccatacacacatataaactttgagagagaaattaattaaacccaggtttgagtgccctgtttactagaaacaatccttaaatgcatagttattataatcaacaagaggtttagttggtaaggcatgtgtaccattataagtgatgagagagggatagatagagtaattcatagcacatcatttgattcctgcagataactggattatacctcgaacactgttctcctttacatttcttgctttttatttcttttccaatgctagcagtcacacttattgcatgtgaccaatatcagataagatctgtacaattgcaacacagtgattagcattttcctgttgaattgtccttaatacaggctgattagaagaaatgatgctgtgtgtccagcttcagttccagttcttaggacactagctactttagccagattgagcttttctcagacaaaagtctagatttctttgctttccatttcccttcaaccaaatcacaagaatttctgtttctatttacgtgactagaatttgcctcaaaatactttgtgaaggagacagcacatattttcaatgttgtttgtttcttagtattaaggatttaatgtttagatatatttattttatgtgtatgagtgtttttactgtagtcaaaagagggcataaaattccttgaaagtagagttatggatgattgtgtgccaccctgtgggtgatagttaatgtacccagctcagttccaaccagcaagtggtcttaacctctatgccacatcaaaagctttattttaataccttctgcaacattagtgcccttgatggaggacatagatttcagacatgcaaagctttccatagcatagaataaatactactttcaaaaactgatcatttgcttcaacctatgtcaacttgaggtaaatcattttaatgtgttgcaactcctgtaggagtctcagaaactccttctatgacacagtgaccccactataatccattctttctcagctacttttccatagcttcttaatttcatcactcatagctatttgtcacacagtatatgtgaaactaaaatagaggtgatatttttttcttactgcctctgagctactaagtagtacagatcacagttctgaaaaaaatctcctaatagatcctttccccagaaatataacttctcttacagtgggtttgatggaaaatttagccatatcaattggcatgtcattaatttgagtccattctaaagtgtttgaggtcaattgagtccatcttccatttttaacacatcttcactttctcagacaaaatgatcttaaactccaaagacaacaaaactccatatttacttgtcctgtttcatcctcttgacacttctttcgcattgggagggtggcaatatagtaaaaaaatattaactggttttgtttttgtatttttgagatagagtatcatgtagcctagactggccaccagctcactgtagttgagaatgaccttgatttcctgatccctctgtccacattaatggttgtgtaagtgctctaccaactgggttacatccatagtttccaaattgtagttattctgttcacaagagagatatattctgtttctagacttaagctatcttcataatctatgtgtacttcagtgtggggcaataaaccaacgttaagtaggagttttatgtcaggtgacacagaccttgtgagacccgagagtccacctaacactccctttataccattttgcatgcattatattttggaatcactagatttctacattcattattaattgatataatgattaatatataatttcaacttaactggatcaagaattccaaagagacacatatagagtcctgtgtgttaagatattttcctaggaaactgaaggttgaggtaccagcataaagacgacaaataacaaataagcaaaccagttgaatactagtgttcatcttctctttatcccaacaggagatctaatgttactgagtacctctcactacttcatccatacctatcttgccatgatgggctgcatcatctcaaattttaagccataatatgccattttccctttaacttgcttcttctttgaaaattaatcatacaatgtgaaaaaaacactagttcttcaattatctgtaataatcactcagaggagcacaatattatttgaaaatgacagcatcatttcacatacaagtttcaaatattgagatagcaattattttcttcttaaatgattactacaaggggccatagccaccactcatatattgtatttactagttgaggtaacagtctactcttcaattcaaatgcataattgtcaggatagagtagattttcttctggaaggggacatgactaagaattgtgttgaatataaaggaactgactaggctttatcagacagcccccctttatcgcagagataaaaagtagctcttatatcctcatccatgtccacacaacagcaagggaaatattgtcaagatgcattttgactgccagacttccaacttagcaagaaattacatcttcaagaaagcatacccaaaggtcattctgtctcatggagtttatgatatcaccaacagagcactttaagattggaagaaaataactctagagttggtattccctccaagcacaccaaaagttattttaaaagagcttaatgagatggaacagtgtagcagtgtaggaatagccaactacgttgggtgaattttggactgatgtgtttatttttaattattaattaaattgatcttttaattaaattgatactgagtttttctacagtatactgttacatcctccaaaatcaaatggatttatcatgcagtagaaataatagtcaggacaatttttctgtgtttgccaagcacaagaatccttataaggatttcaacagggaaagtgtgaattaaaaaagaaaaatagaaacctggaaaagaagatttcagtatacagattaacacagaatgtaggaaggcaaaagtttccagttaggtgctagaagttcttctgtccaaactggaaataggctcagtaattctcagcacagttgcttgatgatatataaaattgtctgctaaaatacagttaatgctttcaagtattttacagtgttgtaaatacagtttcatgttatataagttgcatttgttaggactgattatcagattttcttttaagagaatcactgggacttttagagttggacctcagaaaaaatatttgactcacagaaaaacaagatgcatttaatctccaaaactttggaattacctaaccatccataagaaaagggtgcaggatgtcctgggaaatatgggggggtctttgttcttaccatactttatagtgtaatactattcagtataaacaacattagaacatgaatttaatgttaatgtaattatgaattttgcttatcatttttatttttccttgtataaaagaaaaaagttgaagttaattaaattgtgttgtattttatccactataagctgttatcattagacacataaacataaatttattttatgttgcatttttattataagtaattgaaggtctatgtgagtgtcaatgactctttgttatagctttgtctaagctacttttcttttggtgtaagggaataccatgaaaaaaatcaatttgggtggggaaagggtttgttttaggttagaattcttaagctatattatgtaatgagagttagggagtgtatgccagcaagaacaagcacaaatcttgttgttcacattcatttgtacacaggaagtggagacaggaaagaaacaaagagtggacatgctcaaagcctgcctacaactataaacatagcccagaaaggctccacctttctgggtggaggttctacaacattcccaactagcttctgaatctggtgaccaagtgctaaaacatgagcctttaggagacatttcaagttcaaaccacaacagtgtagctcttttgaatttcagttattagtcatcacacaaagtattatgttccactgaggcattttcaaacataacgtgcttcccaatcactctatgtacatcttatttcctcttccctagcagcatcacattttctattacctgtctgtccttcaaaaccattttttccatcttggggtcttctttctgcacacacacacacacacacacacacacacacatacacacacacattaaaagctaatttgcacatatgaaagtacatgcttgcttattgtctttccaagtttattacctcactgatataatgatttcaatagcctccctttttcctactaatttcatagttttatttttctttacagctgaataaaattgcatgaagacctaggctgattctctttcttcagtattgtgaatagagcagaataaacatatgatggggatgtccttctgtatgctatgtacatatgtttcacctattggctgatgaataaagccaatggacaggcaggatttagccaggcaggaagtataggtggggctaggagactagcagaatacagggaacaggaaagacaaagagacaccaggtagctgctgagaaagcaagaactcaggaatcacctgtaagcgaagaccaggtaaagatacatagaaatgggttaaataattaagagctagccaataagaagcctgatccataggccaaagagtttataattaatataagcccctatgtgtttatttgggactgaatggctacaggatggggtggaacagaaacttctgtcaacaacatgggcattttaatatatagaatacttaataagtaatatagctgggttctactatatatctatatctacttgttttttttgtttgtttgtttttgttatggtttggctttgttttgcattggttgagaaacacccacactgatttccatagagctatagccatttgaatcgtaagtggcctatatggtcccatatgcagcaggtaagttgtcagcatctggtgctattggggggtaacagggccaataggagtaggaccagctagaaggaatttaggctataggtgtgcccttcttgtcttttcacttcctgagcaccaggaaataagcacttttgttctgccatacattttctatgtgcttattgacatgatcctccaaacaacagaaccaacaaattgtgcattggatcttttgcaataaagccaaaataaatatttcatctttataaattgcctatatttggtatatgggtatattgctacagaaattgagaacatacatctttgaaatgtgggatagatatatatatgttcacatgttgtatgtgtttatggaattgtacaatgaaattgatgggatatgaaattccttctctaaggtgatgtccatgtttaataattatttgacaaagtaccttatgatctggtcatatttgatcagctacccattagcttgacacaagaaagaaacttgaaatgtgctgctcaacttcatgatagaagaaagcatgactcctttttcctcatttcctcattctttaaccataaacaaagtaaatcaaaacaaaacaacaaagaaaaaagttcaacaaatgcaacatgttaagacaaagacatcaaacagttcaatttgtatttgctgactatttactttgagcaaaaaatatggcaaaatcaaatcctatgaccttgaagagcataatatgaagcaatggggcatagacatattctgaaaactaaccaatattaattaatgcaagtgactaccaaaactgttctctggagataaagtgatacagagcttggagaaagaaatcaacattaggattcagggtagccttcttgattaaagaagtgggtctcggctgagtcttagggatgaccagtgcttccacatggtgcagacaaacgttagcaaaattaacactagctgatattcagtgatttttttcattgttaaaaatattttggattgcatgtatattattgtaacttattttactatttatgctattgcaacttattttactatttatgttaaaagaacaacttctctagttggatcataaaaatgcaacagacttggcagttacaaccacagggatgacaagtgtcatttgtacattcctgtacagttttgaactgtgtcttcctaattttatagtcaccaacaaaaatgggcacctgtcattgcctgaggcttacctagaagcttgttgaatcaggtaattataattgaaattagattcctgtatcaaacaactgtgctgagtgtttcttggcctaaagcagtagagttcaagctgagaatagaggtcaaatgaacagactgtattttgtataagaacaatggtaccacatgcttcgacttaggttgtttacagtcaagatttaaatctctaggaaaatttacaaattattagcagtataagatcaaagactttctggcattttatgtggcaatcagattctatcataataaggaatagaaaaggtactgaggattgtgggaagacattaaaatataggaaacaaagatgttttctttatgaagtttgaaagtgcacaaggattgaactattagcataagagccagaggatcaggaaccagacttctaactaagagaggaaactgtacccacgaagtataaattaagctgtcataatgaccacaacagatgacatgcctacattgacaggggccactctaagagtttctgctcctacatgtttttttaatggctgataagagagggagaatcagtttcctccaaggacaaactgctgttttggttgttccattccaaatggttagcactgaacatgagcaatgataaatagactcagtagggtttgtgtgtgtgtgtgtgtgtgtgtgtgtgtgagagagagagagagagagagagagagagagagagagagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagagagagagagagagacagacagacagacagacagacagacagagagagacagagagacagagagacagagagacagacagagacagagagacagagaggggatggaggagaaggcaggagatgaagagagagggaaaaaggagagaataataaaagaagccttggattttggaaggatggccagacatgagaggaggtagacacaggggttgaatgcatatattcttatgttagtcagttctcaattacagtaatcaaatgttttagacagtcaacttttaaaggaaacaagttgtctgtagcttacaggtttcatgatttcagcccaggacatattgaaatgactgttttggtctgttgtggataatttcttagatataattttgaagaggagcaatggctctcacctcaaagtggaaaaagaaaatgtgaggagactggtgttctgcaatcccattctgtggcatgctgccagtgactcagagaactgccagtgggctccacatttgaaagttttcacccacctccagcacttgggggcaagacttccagcatctagctcattgtggggggatttaacattcaaattgcagcaatgtcctaattaaatgaatctggataaactatacagtttctatattgtattttgaaaaatctagaatgattagttttagaaatataattgcttgccaaaaatttgaggtaggaaggaggaagtgaattgaatggtgttctaatgtagtaaattagtgcacctgaaactatcacagaggatacatgtcttcacataattgtaaaaaaaggaatttctgtaacagagggttaagaacaatgtatattttggatgatagtaatgatggatacatacacattcactaattttaacaaaatttcccaaacaataccacctgtattcaagaaagcaggtggtgctgatggttacacaggactccataaacaggttgtaccttgaacctataagtgtttggtgtgctccagggcctatcctttttgctaaatctgctgatgcctgatacccttacatgaaaggatgctgtatttacatttaacctatgcacatacctgtatagttgaaattacgttatgcttatttataacattaagtctaaagtaaattctattcatagttttggtgtattacttgggtcatgccagaaataaacactgtaatgttcagaacagacaaattttgtttccaagtatttgttgtatcatggttggttagatttatggatacaaataacatacacattggaggctagctataacgtctgttcaattgttccatatatgtacaattgcatcaaaaaaagtctactaactaattcaaaaataagaaagaggaaaaatatgcagtcctatgcagttagggtctaaacatgaaatgtaacaataggcttaaagactaacaataggcaaacctttgcttgtttactgctaatgttactgttctgattgtaaattgactcttatcataaacagccttgtacattgtgaaataaatctcctggattttatgcatgctaaaattggttcttagcatgtaaatgggctccctttattcttgtataaagcccataagcttctaatgagacaataaatcaaattgtatgttattaagaaatattggatttccagaggtttgtcaccctttaagacttcctgatggagaaatgtgaaattaaggcaatgaatttaactactgctgaagatggacagtcagtcttccacgctcttaatctcaagcgtactgaggttattgctttttttttttttagacagggtttctctgtggctttggaggctgtcctggaactagctcttgtagtccaggctggtctcaaacgcacagagatccacctgcctctgcctcccaagtgctgggattaaaggcgtgcaccaccaacatctggcgaggctattgattcttacataatgcttcttcctaccaagtgtaaggcagagaacccatggtactataatttggctctgcaagcaggggggcagctccattgaggattaagtatttaacatggaggacactttcctaaaatcccaaaataattttccccaatacttgatcccatgtgtgaaactctatagtttatttctcataacaaagccactgacatgacaagttataaagaaaaaagtgagcccatagttctgggagttcactgtctatatgccccatttggtgatggatttctgtactcacagatttctcccttattatggagtcatgatgaatgtaggtccatactgagaccctcatgtgacagttatctaatcctaattgcctttcccaaaccccagctctcctcaccatcttagtatcttgcaatggttatttagactgtattagtaccatgaaaaaaccccataattttgacattctgttttcaaatctcactctcacctttgagaaaataacagtgaggaaagagcacagtcaataaccatacacatacaaaaaatgtgctgtttacaactttcttctgtatttgtcagttttaatggatgtattctttatgtataaacaccttgcttatatcatttctaatattaattgaaaagttaagttgtagctcactaacattcataagtggcacaaatatagacaattaaagaaaaaatgtttttcacaatgtcttttacaccaaaattgctgttttctcataccattcttggagattacttgtagaaatgaatattgattgccactgcaattttttctgttttctcatatgaaacacacacacacacacacacacacacacacacacacacacacccccccatgtattgtaattgcctccatgtcctgttatttctcttaacctctgttccccagagtttttctttaaaaataagtaaacataggataagaaatagtgagggttagaaaacaccacaaatgactgaggaatattgcaaaaaataaaataaagtaacaagacttatcctcttttatgtatgaaatcactatataggatgtatgctgaaatctttaataataaaattgaaattgctgaataaagatggagaagaaacttcaatttcttatccccacatacacagaggatggtgaactccagatgtacatttctatttacttatcttttgactagtattttcatcagatactactctaaacactggattatatttgcacattgctattatttcacatcatataaattattttccaataccatattttatgcaattaaaatgttctaaaaatgacttctaatttctggcatatagtagtagtggtgcaaaaatatttgctcagtgaatgaatgaatgaatgaataattaaaaatacttctggcaagttttgcttggtatcattagattaagctgtgttttttagtgaaatttcaaaaagcaccctgactactcctcataatttttctatattagttttaaaaatccagcaccatgtttctgtaattatatgtcaagtagaacttaacattaaaattgatggaaataattaaacacctctttgcatatacaaatttctcctaagacattgatttgcatccatttcaaggtttattatggatggaagaaagtactgagtctatttggagtttacatgggtaattatggaagcttttctaagtgcatcatgttgctcttgaacaaagttatcatatttactcatgatttgtgttcttttttacaaatgtaaaccctgaaattcattcatggggtaggctacatgccagcatagtataaatactatgcatccatatgcacattaaagcaataaaaagaaatgttattttgccatatatctcgtatgctatagtttaaatttttccttcttagatgtgcattaaagacttgttccactgagatggagtgatatttcagttgataaagtgtttgaaagcatgagggcctgagttgtatccttaggcccaacataaaaagggcctgagttgtattctggcccctctgcaggatctgtgggtgacctgtaatcctagggtttaggaagcagaatccaggatctgggaaagagaacctgcctgagtaaatcaagttgaaaacaattacaaactatttaaattcaatctttgttttccacatgcatttgcaaacatatgaatacacacctgcacatatgtgtagccacacacatgtggatatacacgaactcacaaatgcacatgaatagaattgcacactgtattaggatgtaagacgttggacctctaagctgaccaagaggatctcacattctcttagtctttatagcacatatgttggaacactataattgcatattatttccatggccatttgagaggaaaactttataccagcttcttgccactttcctgacaatccaaaaatagcacacacatttcattatgttattttcaaataaaaattgttttgttaactgtccttccactccccttcatcctgctaccaataaccttgggcactttgatcgaatgaataacccttctgctgccatggtatgtgtgtgcacatgtgtgtatgtgtatatgtgtgcagtcatggctgtttgtgtgagtacacagatgtgatgtatgtgtgtatacatatgtgccatgtgtgtgcctgtgggtacacatgtgtgtgtttgtgttctgtttccccatttttctcagtctttctttgttcactttccttggtatcctttcaagtttcacaagaaatgtctttctgaagcacctcatgaatggttctttaactggtctaaacgttgcaaatgtagtagaggcaggttttgacctttaccctttcctctcccttgctaattctaagattacattactaaagctggcacccaaggtctattctttattttcctccaattcattcctgagactaaacaccaagattcagcaatcaaaattcatcatttggctgcttgagctaaactgtcccatcaggacttactgactaatcctaatatagacttcttttctctttaaaattcacttctaaagaaacacctgtttcagtccttgtccagtctagaagcagtcaccctttttttcctagcccctatgattgtccctcctgactactagatttccttttttgctgacaacttggtgtctattctttgctaagaggttggccctaacacctaagttttgaaatattgccattaaagtatggtgcatctaactcactttctggggagaatcaaagttcagacaagcagaaaacagcaaggtcagatcacatatttacactgacaaacatcaccagaaattcttccagccttttctaccagctcactcactattttttctcttttgttgaaaatagatttttacctcaaataatatatcctcatttcccctagctctattccttggtttcccttccctctactctttccaattcctcctcacttcccctcccttctatcttttttccattttttattagagagcagttttctaagaaacaataataaaatgacaaaattaaaaggaggaaacaaaagcaaacatcagaacagtacaaaacaaacagaattaaaagatcccaagaaaaataaaagtacaagtagtatttgtacactcaagaatcccataaaagcaaacctgtagggttaagaagagaaagagagaataaataaataaataaataaataaataaataaaaataaaaaatatcccagagacaaggaatcttcaatgatgcagttgagtttgttttttgttgactatctactgctgtctctacttgttttgttttcaacacattccagtcctgtggtaatattcttgatgaagactgctgtagtttcctgacatgttcaacctgacttttctctgcctgtttctgttttaagtctaacactattcagaattttcttatagtttactgaaaattttaaagacagacaaagtgatgttacatttcaggatagcaaggcagattggcatataaagcaaggtcaacatgcccattgtcaaaaaggtgataatcatttgaaacatgtcagtaaagatgacattgtcacatttgaagcacattttgaaagcagaatttgtcaagtgctttgtaagacaggtccattcattatgccatttgcatggtaaagcaagtaacttattatctaataggtaagagtaagaaaacagaacaattaatcagtcatgtgttatgggttggagtagcactcttaggaagtgtggccttgttggaggccacacttgtgtcacagtggaggcaggttttgaggtctcatatatgatcaagccctgcccagtgaaacagaccacttcctgttgcctgcatatcaagatgcaaaactctcacctcctccagccctatttatgtctgcatgcctccatgtcttaccatgatgataatgaactgaacctctgaaactgcaaaccattccatcaaatgttttccttgctaaaagttgctgtgttcttagtgtctcttcacagcaactgaaacacgaactaagacagaaactggtaccaaggattggggaattgatttgatggtcctgatcatgcttttgtgtgaaggaatatggaccttgggactgtagattagataatcagttgaaagctttaaatgttgctttattggaacatcctagtaggagcatgaaagacagtggttttgagtgtgatttgaactgtgggtggctggttcaagaagtttcagagaagaatgttagtatgtggcctagacattgatcttatatttggtaaacaatgtggatgccttttacccttgcacagagtctgcctgagactaaagtaaaaatatttggattaattacactggtagaggaaatcttgaaacagcctagtactcactctgttgtgtggcttttactggtgactcttatacagatttataatgaaaaagtacaagctgagcaaggaaaaaatatttaaagagaaaagaaaatgcaagccatcccactaaatgttttcctttgtaggtgttgctatggtcattgtgcctctctacagctacagaaactgtaattaagacatgggttaatgaggaaaccatcatggaaaatattacaaagccaaagtaggcacaaagtaccaagcccagggtctttaacacacaggatggaattctcagtcctgaggctatatacaaaatgtgaatctacattttcctgaaggcaccttatatctcctgttccattacctttttacatacaaaatacacaagtataatctttgggtggcacatggtacatattggctgccaccttttcagtgtctggatatatcagctgatcagaaagtttacctttggagctccctgatttagagaaacaattgcattactatgtaggtcatgatccaggaatttcagagtgaattctcaaggccatttttagtaactctgttcccccaaagtaaaactttgatagagaataaattgtagtatttagtttaaaccaggaagaaaatcccattttccttatcaagaatagaatataaaattatctacatattcctgctttatcttcttcaattactgctctctgtcacattctcaattatatagtatgtggaatcctagcactctaaacacattttgatattgtaaacattttcaaaaacttttcaaaatatgcagaaataaatataattgcatactatgatgagtattattggttgtcaagttacagaacatagaagtatctagaagaaaaacctcttgttgtgacagtgagaatttttagactagtttaattgagccaaaaatgttctaaatttgggtggtgaaattccatggtctggggttctgaactaaatacaagggatccagcaagaggagcaccagttctattcattatgtttcttgactgtaaatgtgataagctcagcctcccccagctctgtccaccattccttcaagggtataattgaatataccctctaactgtgtaccaaaataaactattccttccttagttatttttggcaggttttcacagcaatgaaaaagataatgaatatgcatgtctcaccccatgtgttttcctctcatctttaagaattttcatcatgggcaatgtcatttgtctaccagacaactgtcaaatattttttcagtcccagcacaaccagcattgctcaatattgtcagaaatgtaggattctttacatcttagatctgaatcatgagctctaaggtggatgctgcatattgatttgtattttaacaagtcaccttggtaattctaatatactgtgatgactgatgtctattgatataggttcacaccattgcccttacccagatagattaagttgtaattgatttagatggcatgcatcatttcatttttagtgtaaacatttcagtgtgaagataaatacaaaaaacaatatgttatcaatatatgtaagcatcctgctactgttcagctttttttgattttccgagacagggtttctctgtatagctttggagcgtatcctggcactctctctggagaccaggctggcctcgaactcacagagatccgcctgcctctgactcccgagtgctgggattaaaggtgtgcaccatcaaagcccggcctgttcaggttatttaacacattttatgcttctttgcttgactcagaatcccaataatgactttaaataaacactggctctatgccataaatgtttagtttatggtgtttctatttccttctgatacacctatttaaggtgtatatttatnnnnnnnnnnnnnnnnnnnnnnnnnnnnnnnnnnnnnnnnnnnnnnntatggtgatatattatttatgatttattaagtcttgcctgaggatttagaaagcaaattcagcaacaagctgtagatgtcaggcagacgtgatacacacctttaatcccagctgccatagaggtagttgtggtggtacctacatttaatgccaggactcatcattaagagatagaaggatctctgttagtttaaggccacactgactacacaaattcaccaatgcctaaaacaaagagctcacatgaaggagatctcagcatctagaatcacatgccttaaataacagagctatggaggtagagacaggagcgatatgactgggcatagaaaggaataaaaggcagaaggggacaggaactgagagcttttttgcctctgaggattcatggagacatgattgccatttcagccaggttcttggctgctttgcttctctgatcttcagctggatgcttgaaccccagtataagtctcagagtcatctatttttcatgttacatatacatatgtgtgtgtgtgtgtgtgtgtgtgtgtgtgtttgtttagaatatagttgcctccataaattggaaaaatgtccaatttcctggatccaaagaaacaagttgttgtaagaaacctaatgtgggttcaaagtcccaaactcttgtccactgaaggaatatcaagcattcttaatcactgaaccatctctctagctctgtgatcattccattcttctcaccaatatttctctactgatgtcaccatccctctgttcctatcatctttgtctctatatacacacactcctagcatcattgtttactattttccacaatgtatgttggatggaattaattacctgtcttgtagttttctagagtgtttactgaatctctatgaatgggtttatttttacatgtgtatagaatcccttgatctattccttgtgtttcttgaatatttttaaacaggtctattggcttctacttaattttttctgtacatactttcatgcgagtcttgtcatctttaggggaaaagaatggataaaggaagaccagtttgggaatgcagcatatagattgtaaggacaaggtggattggaaaagtcatagactagtcagcaaatcagtaaatttctaagaatgatacccttagctcctaatttgaataaactggaaaaaaagggaaaatgagaaatatttgaagggattgataggaaaaatagctttggtacctgcctgaccaagaagaaagtgatgactcagtcaaagataaatcttggctttaatccttgctgcttgagactggtgccatttacagaatattgctttgattaacattagaagcagggagcactttgggatttcaatgttgctcttaatttatagaaaatttgtttatgaaaacaatccccatgagccacagaaagctgcaaagtgttcagatatgctttgcagtattttctctcacttttgattcttcaataatagggcctctgctacattgtttcatctttgtgtcctgactgacaactaaaaattaagctttttgtatatccaggcagtctgggaagagcagttgttctttgattatgcagtttcttttagtttgcaattttaatcataagggactctcattacacattctggatccttcatcagagagtcctcattttatatatgaggactctcatttcttcaaccttttgttcatatacatgaacacatttgacacataaataatgtgggaaagttgtcatttgccttgaagagtcctatcctctgtttcaagcatatttatgtcaagtgtcctccaaaactccctatgctgtgtcagactgatacaagctctataccagggagaaaggagaacagcaaacacttaaggatgtggaaaacattgccttctcaagaacccctagaatatatattgtttaaaatggaggtaacaattgtttattttactgtattaagatacctggggagggacttataagctggaagctcattcatccagaaagctctctggtcttcctgatactcttattttggggacttcaacatggctatttcaggatggcttcctttaagtttctataggcagatgcaagcatctaatctgatattattgcctaggatgctctgtcaggtaggctgttccagccctctctgcttgatgctgtaagtgtgtggttggttgctagttatcttctgcctctctctgcttgttgctatttgtgcttttactgtgtcttgctgagttcttaatgaattcactcattgatggctatgatgacccattctccacataaaacaccattaagagtctttttttcttacaaattgacataagagaaatggagacatattttttctcatcatagaatctatatacatttctatatgatataaatataagtgtatttcgtggtttaattaaaatacaagcataaatgtctatttgtaacttaattgaaatcaatattcatatttcctttggtacaaaacaggttttaaaatcagattcaagtaaatcttatgtgccatgtctattgaattgtgggagctatatagttatcttagtatgatcatcttagaacaaagctagagctggattccatttccttcctcaattccattccagaattgttagagtttacttattgaaaagagggcactaggcaggattgtgggcaatattcccaggctgtctctccttccagagtaaagcttcctctggctccacttcagagcaattaagccctcaaaaaaaaaccaacataacagtaacaatacgaggccaaaagaatggatgtgtactttaatatgtccctcatcagaaagtcagatgaataaaagaggaaatccaagatgtggtaataaaggaaacatgaaaatacctataaatacctatttaatatctataagcacctacttaatttatttgtagctaacatgctgcaatgtctgatattccctgattgaattccatctaattcacatataattctagaaacttgtgcccagaaaaaatcacaagtaacttattgagataacagatatatttctatttatgttctagatcttggaaaagataaggaatctctcccatcatctgcagccttccacttccccttctgtcctttgctctctctgattctgatgggccttgagactgaaaggaagaaacctcttttcctcttagaggtggaaattcaagtgtcaagtgattcatccttcaccctgagaaaacaatcacattccataattcatactgatagataatgtttaacatttgagtaaaactaaacatatgaatgtatacttctcgtgaagatatctttgtagaactcattcattgatttttacataaaataaacctgaaaaagaaagattttcattatattgctgagatgcttcaatgctcatgagaataaaaataaatcagctatggcaatactctttgtaaaccagatgaagtcagcaagggcactgctatattaaaggatcctaaaaggaaatataaagtctccttcatgtttaccctcatagagataaatagttgtgcagaggagtgtacctcagaaatgtctatatcatttataaaacactcatgataaagtctctctttggttcacagtattatttaaatataattttatagctgaagagtggcatctgcaaacataaattaagtcattgtgatgatattttgtttatgatctaaaaaataaagcttgtctggagatcacaatgcaaagctacccatactagttatccatagaggccagggagtggtagcacacacctttaaaccgagcagccacactagttaggcacaaaggccagacagtcatggagacagaagcagagggatctctgttcaaggccaccatgggctacagaagactgaatctgtctaaaagggcaacaaagctcatataaaggtgataccagtaccttaatcccagcactaaggaggtagagacaggagtgataatggctgggttaagtgaggaacattaggcaggaggagacaagagagagatgcagtctgaggaacagtgcagtctaggcactctgaggaacagtgcagtctaaggaagagtagagtctaagcagtctgaagagcagtgcagtctgaggcagtcagtctgaggatgcagtcaggggctgccagtctagtgatacactctgaagatgcaattggaggacaggatcacccctttggtctgagctttagtagagataagaacactctagtggtcagccactttgcttctctgatcttcagcattaaccttgataggtgactcagattttattaagaaaaattagaattcattttctttcaaagtgttatttagagaaaaataatcttgattttacctatcaaaagtctgaagagcagcatgtttgcacatcacaggttcactgaaggagggagtattcactttttccccagttaaagaatattcaaaattttaggaaccaacctaactacataattgtaacttggtctacaacactgtcatattggcagttgtaattataccttaatattcattgatgaagaacagattttatcaggaagggctcatcacatcccattactgattttgtactgtatcttaggatgaacttaaaaacacagtgggttgatttctgaagcactagtgggtcaatggtaatttattttgtggatgattatgcatccattgtcaacggtgttagtttgacacaaatctgccttgattggaagggctctctattaaactttacaagcatcttattatttgggtagttactatttattagtggaaatatcatttcattaaatattttcaagtgatggcaaggatgcacaactcttcacttaattactgtcttaacctgtatcaattaacacagaagtgaagatagagatttatgttaataatatttatttttcctttttagcaatttttaaaatgagtaccaaatgtataaatgagggaaagtaggatggtaagaggaaggctatggtttgaggtagaggctgaacttgggcttgcctggagctctggagctcaaattgaaccatggagttctcctgttcagtggctagtgggttgtttgcatttatcccaaacctgttcagccattgacatccaatgcctttgatgcctacctttacaatctaaagactaatgatggcatcattttgtgcaagtgtaacattttagaaaatatgacatatatgaatcaagagccaaagtactcacagcctctggcaatgggcacaaagcaaataagaggatagcctccagtcactcctgaatcgaatagcaattgattatgtttttattccccaagggaaattttcacatttcactttattttcctaaagtaattctgctttttactgaactgatgtttgattatcctgtttacacatccttattatgatgaagtgggctgtgaatgttcctcaaggacccagacacacagaagagcaaatagaggtttgatcttcagcttgtagcactaagaggacttggtaaaatcccctgggttggagcttagtttgaaagagatgcagttagtaggaagggcttagtaagaaggcagttagaccattttagacatgccattgaatggggtgcaggtgctttgccttttggcttctttggctttgcttccaaggctgaatgaaacaaacagattgtccctgctatgggcacctgtttatgaagcactgaacgagccagaggcactacaataccagccttaaagtgaaacctctgacatggtgacttacacaaagcaaaccttcactctcttttggctgatgatctcaagaagaaatctgacattcacaactatttttgtctgagaaacacattgaaaggatgtggttagtaaatatattttccattttatttgtatattttaattatcgatgacagtggattcattaggacacattcatgggagcatatgatgtatgctgagaatatatactccacattccctttcttgtcctccttccacactttctcctcccaaacagagtccttctactcccagttttttcctatatgcagagaagtaatttccctgttttccccgccatgagaattcagcaaagcacagcagtgatagattgatattgattactacaaaattatagagcgttcaggaagcagatgttttgtttagatttatcaaagcaagacataaatagatcccaatgaaggtcactcttttgtgtcaagagcaaaaactgtttatttcatcctatgacttctagaaatgctaacatgttataaatattcagatagttttggcaggttggttaacctggattagactgatactgcctctgaaacgcggttacttttattttgggtggttcccacttcttccattttcaatagataaaccttctctttgcctcattctaagacacccttgcccatttgcagataaagagaatctttctgaaaagaaactctctcctggtcttatacacatgccaggaacctacactgctgctaggtttgactgttttgtcactggtactgctctgaaacaacagacaccagggtaatatgtgtatgcaattacatccatgtacagctcagaattctcccaaatgcaggcttttgcttacttcagaagaaatctgtttttctctgtgttgctctccgtttctgcccatgtgtgtgttgtatatgggaatgtaagtgttcacgtgtatggatgtgagcacacatgtgtgttcatatgtgcataggccataggttgagtcaagtgacttcctctgtgttctccttatttgtgagtaagagtcactcacttgacttgcatctcactgattcaacaagactacttggccagagaacctaagtgatattgtctcaacctactcaggtttaggattaccagtgtgtagcactatgtcttgctcattttacatgtttgttaggcatccaaactcaggtcctcctacttatatggcaagtgttttacagactaagccatctctatgggtcccacagaataaactgataagtttgtttttgttttcctctacctgtgactatttacaatgtaacatgaataaagaaaagacccagaatctgatatttgggttcaagcttcaagctgaagaccagaaaatcaaagcagctgggcactagatcacattctacctcagactaaaatggctgatccaggagctctcccaaacctcagaatgaagcctctccccagtgtggctagagaatcctgagacttcaatgtcttcctatcctcaatgtggctggaggatttacacttgatagtgaatactgaagaccctttttctatctttatttgcctcgagtgctggaattacaggcatgtgttcctaggtgctgagatcatctttgtgtgagcactttatctttaggactcaatcaatcttgtgtagatctgggtggcttaggactcagagagctctgtttacctcttaatcctgagtcctagggcattaaaggtatataccatcacttcctagtttctagctactgagattaaaggtgtatatcatcactgcctgatctttatagatgaaagctgactttcctttttgaatcctcaggcaagatttaataaattatacataatatatcaccacattacaatagtgtgttatatccataatcagagtagtactggcaatactagcagtctctaccatgtaacaactatatgacaaataactactagcatactatttactggatcaatctttaaaagccataatctgtttcagggcaatatatggtggtttacactaatgatccttaacaggagtgggttaaaaatcatttgacatccttctgaggtagttttgatcattattgtaacagtggagtgagtactatggccatctagtgagttgaccctaagcctgctgatgggattcttgtgactcatataacagtccttgtggcaaatgatgatcagatctgaaatttcagtagtgaaaattttcagaaccttgagtttaaattaaggcttcgtgaccataatttaatagtggcataaaattgatttgttcttaaatagcttctttctgttattaaaaagagacatcccttactgggtatgatgatgcatgcttgcaaccctgacactacagacattgaagcagaatgttcaggtcaacctggttaaataataaacaggaatttagcctaggccacaaaaggttaccatggaaacactggtccactgcactctgcctctctattgtcctattcaaataaacacagccaaaggcaacataattaatgtaaaatgtatctgtaagaatcaaaatgattgcatttgctgaaacaggctctatactttcaaacatagtttctgtattagttgcacagtgtccatcctcttgtattaatgtaatagaacccaagaatatagctttttctgtatccttgatttttttcactcaatctgtctgtctgcctatctatcatctgtctatctatctatctgtccgtctatctatctatctacctatcatttatctatgtacctccaactatcatctatttatcatcaatggttatctatctacatcattgcatgcatctcgtcagtattgttttttccatatgtcggtttcagacttctagaacccaatcccattgattcaatgcctgacctcattcagtaaaattctcctctgcagtaggtcaagattgtgttgtaatgctcagtgtaaaggatggatccccacattattaattaatttcatttaacttcctgattggctgaacagtcactaattaggagaagaacttggtaaagtgcattattttctatgactaaatcaatcatgctaacttctaaaaagctagaccatgtgccccttaaatcaatgttctaatttatttttcttttatatttaaatttgtaacaggattgttttacatgtcagtcacatttccttctccctctcctcctcccttgccccctaccaactaacacccataacccaaaacctttctgctccccagggagtgtgaggccttccatagcggtcttcacaatttgtcatatcatttgggatagggtctaggcccttcgaaatgtgtctaggctcagggagtatccctctatttggaatgggctcccaaagtccattcctatgctatggataagtactgatatactacaagagttcccatagatttctgaggcctcctcaatgacacccacattcatggggtctggattagtcccatgctggtatcccagctataggtctggggaccaagagctcccccttgttcaggtcagctgttttctgtgggtttcatcagcctggtcttgactcctctgatcatcactcctccttctctgcaactggattccagttcagttcaaggtttagatgtgggtgtctgcttttacttccatcagctgctggatgaagggtataggatggcatataagttagtcataaatctcattatcaggggagggcatttaaggtagcatctcctctgttcttagattgctagttggtgtcatctttgtagatctctagaccttcccctagtgcctgatttctccttaaaactataatgtctccctctattatggtatctcttatcttgctcttttttcttcccccaactcaaccttcctgctccctcatgtcctcctcactcttcctcttctccccttctcattctcctagctccctctccgccccccatgtcccaatatgctcaagagatcctgtccctttccctttctccaagggatcatgtttgtttttcttaggatcctccttgtttcctagcttctctggtggtgtggattgtaggctggtaatggtttgctatatgtctaaaatccgtatatgagtgagtacatagcatttttgtctttttgtgactgggttacctcacttagaattgtttcttctagttctatccatttccctgggaatttcaagattccattttttccccactgagtagtactccattattgtgtaaatgtaccacattttctctatccattctttagttgaaaggcatctaggttgcttccagtttctggctactacaaataatgctgctatgaacattgttgaatagatgtccttgttgtatgaatgtgcttcttttgggtatatacctaagagtggaatttctgggtcttgtggtagactgattcccattttcctgaggaatcctcatactgatttccaaagtggctgtatgagttggcactaacatcagcaatggaggagtgttcccctttctccacatcctctccagcataaattatcattgctgttttttttttattttagacactctgacaggaataagatcgtatttttatttacttttaaatctgagcatctatttaatttaatatttagaaaatgaaagttgtcacaaaccacatttgtaatttggctgatgcaaaagttgagtttattctgtgtttgtgttcactgaaatgaatgaatcaattttgttttcaacaacagcacagtgatgtagaaatcaggtctgagggcttagctgggaagccacaaccattccaaccatccagggttaattcctgaatagacttgtttttgatatcttatttgcataagcaacaatcctattcttactcaaggagcagcaaaaagtaattagtgcttttgacacatgcttcttggactccttgttcctcttcttctccttttgatttcaaatctgctaaagaaaacaaaactgctcaaacaaaaggcagctggcagaagcagtgtcttaaatattcaggagaggagctaagcatattgttttctctgtccattcatggtttgcttttatagcagcaacaccactgaaaatatgaaggtaaatcattgtagataatatttattaacatccagcctcatcttccatgtaagccacacagtcagatggacaaggagctcacttatctgctttctttcttatatttccccgatccatttctatgggaagaacaaggaatctgcaccactgaggagctgtagtgagttctttggcaagggcccttctttcacagctcaggaaagtagatgctgaaaactgtcaaagactcacaagggcagagtgtgcagagagttagagatcttggaataatcagccttcagtgggatgtctccatcaaatctcttcccccagagctcaaggatttctgtagaagaggaagtggcaatattgtaagatgtagtagggagagaagaaatgaaagaactagggtcttctagatacaagagaactgacccacatctaaactgacagagactttgacagcattcacaaagtaatactggtaaagtctaagctagatggtgtcccagtgctgagagaggaagcagacacaagctgccatccctaaccctgaagctatctacaaatgacaacttttcataaacaaacaagtcgttttcttcaagggagtttcactagatatacaaactgctcttaaaggtgggctccatgcccaggaatagatgttgaactaaaaaagaactcaatggtattttgggaggttgtctcaaaatgctttgtctgggctttcttccttacaggtcttgcttctgattttgtgtttttatgggatttctatgtgtgcaaatgtctgtgtctctgtgactgtttcttgggctctttttttttaatcagtttgttttatcctattctgtttatttttgttgtttttgcctgtttcttttctaatgagaggaaaacgaatgtggatttgggtaagtaggaagatagagaggatttgcgatgtgttgaggtgggttaaatctattatcgaatttattatataaaaatatattttaaataaactgacaataagaagaaaaacaaaagtttaagataagacataacataaccatttaagggacacataataagggaaatctatgacatatttcagaatattctattatttgtttatacttttaaaaatagaaaatttcaaaaatagatttatatacaatttttaaagttcccaaagtaatacagacactgccatgtagctctgccagcattcttaaccactcagctttatttccaggcttgactttgttaaaaatatgtttcctctattttctctcttctgtcctcctgccacattagttattcacattttaaactatctgatgttgtcctgcacactagggagcctcttttatgttttaagcttttcattctataatgttccatgctggaatttggctatttcttttatgtggtttttatttgaaggctaaattgtttcacctctcaagaaaaaatgagtccatttatttgctgcttttaatcaaatagttaatagtttgaacatctacatttactaattcccatatcttaatatcttacttgttcttaaagagacactgcttttacagttttactttagttctactaagtgtgtgtgtgtgtgtgtgtgtgtgtgtgtgtgtgtgtgtgtgtgtgagagacagacaaagagagacagaaagagagagaatttaggcacatttgtgccaagacaccctcatgaaagttagagaagagcttttgggatttgattatctctttctacactgggtttgaagctaatgttgtaagtcccttctttccctcacaggctatagctatatctattctaagccatttgaatctcaaatatagtgaactgtgtgttagccatactggcttctctttcaagcctttattcaacatgaatgtaggtgttactgttttagtacatacctgatttctcagtactgcagactaaacagactgaaaataattctctgtattcattgggccttctgatccttgaaatcagctccaagccaatgagttacatagctacaaggaaccctggagggccttgctaactgaatcttttatttctgatgtttccctttatattttgagaagctatagagtcagaatcttccctttaacttttcaatcctcagttttatttccatgcatctgaatctgaaccactttgtcactgttagtggcttgttttcagttgaaaaccagaagacttgtcaacttaacttgtgcctctatcttttcagctggctcccattcttattgtgcctgccccaaccatattgtcaaaccttctgtataacatatgtagtaaatttccttttcatgataattttagttagctctgacttttcatagacttcactatagtgagcattctttagcataagctggtgaaaggccaacattagtccctgtaggagaaatacttggtagaatctttgaggcaaaaaatatcctgctttctaaagactttttaaaattgaagctgttcagacttgtgtttttcatgaatgtttagcattgaaagattctggtatgaggacttgctgctctgtggtgtgtggtagcacatagctcaatgctttgaataacaaggcaacagcacatgtcttccaggacaaattctctccaggaattcttatgaaaatataacattatcagcttatgttttactgatggggtactcccaagcagaccatttatgacattttagaataaaagcatcattcctctggtttatcctatgtactaaatgtgagcctgagcatgagatatgctttctgatacctttgtcctcagaggtccactttgtcttgataagtgtcagcataaaagagtgccacagctatgacagatttcactcactattcttgaacatgcaactatttgctctctgtttttaaaaatagccagtacaaaaagaaaagaaagattcaaaatcataatctcctacacaatatggttattttatcaagccaatttaattatttttaatttaaattttcctttgaaaacaatattggcattccccatgcttttctgcctgagaattggaaataacctactctattacttactagtgcttttagaacatactatgaactaaaaatgatatttatataaatgttagtcaattgaatatagaatatttaatgttgaaggcaagcaaatgcttcttttgtactgtatttaaaaggcaacttggttaagaaacatctgtaataggatctgatgccctcttctgacatacaggcatatgtgcagacacagcacgcatatctacacatcctgttttacatagatagatacaaatcgctagaaaattgtgaaactttcttgtcaatagacatcataacagccgtgagtcaaagatacttgttatttctgaggtgatttctagttaaagttacttgtttagataaatgctaaagaactttattaagatgaaattatcataatgagaaagtacactgtccttctttgagtggattttgagagtttaacacatctgttgcatttttagacatcctacaacattcccttagaattacccatctcataatccacatgattagctttctcagtcatcaacacacctatttcctatttcaaagttggaagtttaccctacaatttcagacttgttactatgcatttataagaacaggtaacaaagcatccttattttttgaagaacataatcccaaaaatgagtatatgattaaagaatgtagaaattctccaaaatttctttctttgccacaaaacattgcctcccgtaaatgtgcatgtgacccgcatcaggtttcatgttcaattgatgaactatatgatctctttggttggtattaactaacttctttgggtaagcacaaaattacccccaaaatctttgccaatcttcttacaccctgaaagtcactttctgagcaacagctaccatatcctaaagtctcaggtttgatgtatacttcaagacactatcaagcatgtttcattcatgaagaacattacctctgtctcttactaacactttgaaatagaaaacactcaaatgcttttgttgtcactcatgtgaaagtgacacaggattcacagaaattagaggtgtccagaaaacaggcctgtcctaaatacaaccaagtatagaatctgttctttagggtgtaaatattccaagagtttgattttacatattagagagagtatgagaatgatgaaggacattttgatgggcgattaaccatgattgttcagcaaaaggtacatagtagaggaggattcctttcatgtgccaaaacatagcaggagtgcaaatcatgacctgaatggattgacagttcagagcggagctctgatcaaatctgacattttccttttttgtctcaacattgagattaagggacataattctctaggagtagattaatgatttagtactcagagagacattttctttacaatcatcaccactatcatcctaaaaactgacattgtggttaatttcccaagcacttcactgccacaggtgacaagtggcctcttacattcttgaactcttctgtgttcaaacatcaatgaggcttgacataactttccatgttttttttcttcttttctttttttttcttttttttttttttttttggttttctgagacagggtttttctgaatagtaaaggggccgatcctggccctcgctctggagcaggctggcttcaaactcacagagatctgtctgcctctgcctcccgagtactgggattaaaggcgtgcaccaccaacgcccagcttataacttttcatgtttaaagaattgagatttaaacttatgcgtaaggctccagcccatgatgtttctaaaatatgtcactaattctactctacctataattggcactgaaacaacttatctctactttttattattaatgtgaaatgcacttgattttaactattgaatggtgattccctattcttgaggaaaatcatgagctcatatcatttgattttttattgattttatgtgtatgagtggtttgtgtgcatttatgtatgtacaccacatgcttacctgtcacctgtgaagttcagaaaataatgtcttagcccctgaaatgaagtgtgtgctgacaagcaagcatgggtcttctgcaagatcaacaagtgctcttgaccacttaactatcagttcactcccaaggctgattaataaaagatatgtacttactgctaaatcagataaaaatacactactgtgcttctttgggtgggttaattaggctactttctttgtgatttcaaacttgcttctttaccaagatcttccttctgtgtattttatcctaaaatgatgttttctatatccatatttcatgatagaatcagaactggacctaagatggacatatacaatgtggtatttgttgtgaaacagtgagaatttacttactatgtggaaaacagcagggggaaattcacacaagcatgaaacttctacaaaccaaagaaaatatcaaggaaaaattcatcttgttaaagaattattttgagatgatggcccataataagctgcatatgatgactttattgtttgtgtgagatcatattcagagctgtccaccttttcatgtaaatcagcacgagcaataactcagtaacactgctgaaattcaactgtatctctcagtagcttgaggcctacagaagtctcaagcttcagtgtaaactttcaaacattattgtagagagagaagcctctgctagattttctcccaaccttccactctcttgctggcttgttcccttccttccttccttcttccctctcttctcttataataaccagagaattagaaatctgtgggatttgttttgaacaagagacatcccatttttctatcattggccaaagacaaatggtaaataaacttaatgtgagcctaacagtaatttaagggttcttgcttgttactgttaccttaagacccttgtcagctgtataacctgccaagtaattgaaataactgccttgaggccctattcatatttcaactgtgttgattagagcctgtgagttccaaacctgaaaggttttaaaaaatacatgttgagttgcaaaagcaaacttacaacattaatatttgatttaggatctatttataagtttaggacagaccataaaactttatttcgcatttttacagtcagcactgagaactagagagtttcatgtgtgaaattttctgtgctgtgtctccatctagtattgaagagcctctgaagtaataattttttatctgagtacctattgttaatattcaggcctgtccctggggttctgagagctgtagccactaagagtaccacctgtgcatattcactatgttcccttttaaaagggccccgcccacctcccattctcctttatctctctttctttctgtccctttctgtctatccccctctctctgcccctctttcctctctcctgttacttctgtccctggaggccagtctctcctctcttctttttatgatctctccccctaataaaaaatccccccctgcttgaaccctatcgcatggtgtctttctctgtcaagtggattttcttaaattacaacacctatgtaccagaattatctaaaatgttggttaatgtaatagttcttgtggtgacagttcttgtactctctcagagtcagaaagaaaattgcatctgaatttttgcatggatacttaattattttaaccacagattactgaacatacatggtttagcaaattcatgctgagatttcatcaattctgagtattatattaaattatcatattttggactatcatattttatattctgaaagattttctaatgtatctcagaacattcttactgtaggggcagtggaaactgacagaaggtctttattgaagaacggcctacctgtcatctctctagcaatgcttttttttttcctttagcaaagaaattttgtgtaaacataacacattttcctaatccattctttggttgaggaacatcaaagttgtttccagtttctaactattatgaataaagatgttatgaaaaaagtgtctttgtggtaggatagagcatctctgagtatatgcccaagagttgaaaagctgggtcttaggtagattgccattttctaaggaaccaccacattcatttccatagtggctgtgcaagtttgcactaccgcatacaatggcagagcatttccccttgctccacatggtcactagcatgagctgtcacttgtgtttttgatcttagcaattctggcaggtgtaagatggaatcttaaagcagttttagtttttgctaccctgagtgcagcaggatgttttgggctgccagtccccaaatcatgatacagtgattaattataaaagctcattatatagcttagggttttccaaccagctccttttttaaatttttattattgatatttttaattactcatatttacatatgcgtccccccattccctaaacctcccctcctcccatgttccccacccaacccaccccaacccaacatccgtctacactccagggatagtgaggccctctaccaaggaccttcaaagtctgtcatattgtttgggggggtctagaccctccatgctgtatctgggctgcagtagtatccttccatagggaatgggctcccaaagcccatttgtgcactagggataaagactggctccgctgtcagaggagccatagactgtcttgggctcctagctggtaccatattcagaggatttggtttgctccaatgctgcttccccagatttatgactaggatctccattctatcagtaggtcagggccactgtttctgcagatctctccatctctgtcttggctccttgcctcaacccttttccccctcaacaattgaattccagtagtatgattcagtgcttagctatgggtatctgtttctgcttcaaacagcaactggatgatgtctctccttcctcttcctgcccccgggctccaatttggtcagaggttcttatccccatccccttcatcgaagggctatgcaatcttctcttgtggtcctctttgtttcctagctgtttgggcagtgtggaatgtaggctagtgatcctttgttctacatctaaaaatcaaaaatgagtgagtaaaaaccatgtttatctttttgtatttgggttacctcagtgaggatggtttcttctagttccatccatttgcctttgaatttcaaaattccattgttttattttttttccgctgagtagtactccattggtaaatataccacattttctctatccattgagaaatggatctatcctcttcagttgaggggcatctaggttgtttccaagttctggctattacaaataaggctgctatgaacacggatcaacatatgtccttgttgtatgaaagtacgttatttgggtatatgcccaagagagggattgctggatcttgaggtagactgattcccattttcctgagaaactaccacactgctttccaacgtggccatgcaagtttgcactcccaccagaatggaggagagttcctctttgtccacatcctctccagcgtagattttcattggtgctattgattttagacatagtgacaggagtaagattgtatctcagtgtggtttgagttccatttccctgatggctaaggatgttgagcacttactcaattgtcattcagccattttggattctctgttgagaattctctatttagttctgtattccatcttttaattgcattgtttggtggctagtttcttgagttctttgtatattttggtgattagcgctctgtcagatgtggggttggtaaatatcttttcccattctgtgggctggggttttctcttgctgactgtgtcctttgctttacagaagcttctcagtttcaggaggtcccatttattaattgtcgatctcaatgtttaagctactggtgttatgtttagaaagctgtctcctgtaccgatttgttcaagggtgccacctacattctcttctagtaggttcagtgtggctgaaattatgttgagggatttgattcatttggatttaagtttagtacatggtgatagatatggatcaatctgcaatcttcttcatgtttgagttcagttatgcccgcaccatttgttgaagatgctttgtttttccattgtataaatttagcttctttatccaaaaaaacaggtgttcaaaggtatgtgggttaatatcagggttttcaatttgattcctttggtcaacctatttatttttgtgtcaatagcaagctgttttcaggactatggctctataatttaacttgaagtcagggatggtgatgccaccagaattttctctattttacagggttgttttggctatcctgggatttttgtttttccatatgaagttgagtactgttatttcaaggtctgtgaagaattgtgttgggattttgatgggaattgcattgaatctgtagattgcttttggcaagattgtcatttgtagtatgttgatcctacctatccaagagcatgggagatctttccattttctggtatattctttaatttctttctttaaagattcaaagttcttactaaacaggtctttctcatttttggttagtgttatcccaagatattttattttgttagttcctattataaagggtgatatttctgatttctttctcagcacatttatcttctgtatatcgtagggctacagattttttttgagttaatcttgtatactgccactttgctgaaggtgtttatcagctgtaggagttccctggtagagtttttcgggttacttatgtagactatcatatcatctgcaaatagtgaaagcttaacttcttcctttccaatttgtttccccttgatctccttttcttgtcttattgctctagctaggacttcaagtacaatattgaagagatatggagagagaggacagccttgtcttgttcctgattttagaggaattgctttgagtttctctccatttagtttgatgttgtctgtttgtttgctctatgttacttttatcatgtttaggtatgttcctattaatcctgatctctccaagacctttatcatgaagagatattggattttgttaaaggctttttcagcatctagtgagattaccatgtattttttctttttcagtttgtttatatgatggattacattgatggatatttttatgttgaacagcccctgcattcctgggataaagccaacttaatcatgatggatgatttctctgatgtggttttggattagatttgccagtattttttgaatattttcatgtcgatgttcatgatgcatattggtctgtaattctcttttatcgttttgtctttgtgttgcttgggtaccaaggtaattgtagattcataaaaagagcttggcaatctcccttctgctgctatcatgtggaacaatttgaggagtactggtattagctctctttgaatttctggtagaattctgcagtgaaaacatctgggcctgggatttttttggttggtagatttttgatgactgcttctttttcattagggtttataggtctgtttaacttgcttatctgttcttgattcaattttggtaagtgatatctatcaagaaaattgtccatttcctttagatttttgaatcccggggagtacagtttttcaaagtatgaactgatgattctctggatttcttcagcgtccattgtcatgtcccctttgatatgtaagcaggggttcatgggggaggttgggtggctgagcaaagcccagactcaccggaggttctggtgccacccagaggacagagggaggagtgtggaccccaactacctcttataatttaaattaaccaatttctatgcatctaggtgttaccatgtgatttgtgtttttacccctcttcctgaaacttactccctctacatctggctagcaactccatctttctcttctgagagttccgtgtccccagaagtcccacctaacttcttcctgcctcgttattggccattcagctttttattaaaccaattacagtgacacatcttcacacagtgtaaaggaatattccacagcacctaatggataaggatgccgatcatttcatgtgtttcttagccatttgagattactctgtattgaattctcattttagatatgtactcaataaagaatagaaaaagaaaatgtggcacatttacacaatggaatattactcagctgttcaaaactggcatcatgaaattttcaaatggctgaaacttgaaaacaccatccttaatgaggtagcccagaccctgacagacaaacatggtgtgtactcacttataaatatatattagctgttaagtaaagaaaaatcatgctacaatccaaagacctagagaggctaagtaacatggaagcttcaatgccacatacatggatctccctgggaaggggaaataaagtactagtgactgatccaacttgagacccataccatgagaaacagctcatgcttggctctgcctggatggccacgaaccagaaacaggtcatcgcaggggcccaagatataattaaatacaattggccaataaaaatgttaatgaaattattgcttatgatattctgctatacacatagattgttgcccagcacaattgtcatcagaaaagtttcagccggtaactgataggagcagaggtagagaccaacagccagacaattggcatatccataggaaaccttcagtataaacggaggaagtttgtaggagtcagagggttggaggaaactatgagagcatgggccacagaatctactaagaagggatcaaaggaactcacagagactgaaattgacaaacacataccctgtatgtgtgcgtgagcttcatatgccttatgtatgtgtagcttggtgtttttgtcagactcccaagagtgggaatatgtatgggggctctctctgactcttaagcttgtgcctaggactcttttacttctactggttttccttgtccttctttgatatgaaggttgtgacgagtctttttgcaaattgttaggcgatgttcagtggatatcccttggagtcctgctcactgtgtttggaacctagaagacaaccttcaaaatcattccatttgttttgatacagtctttccttttcctgaaatttagcaaatagtctccatagactgcccttgaggtgtaggatcaattgtctctgcctcctcagtgctaggattacaagatggagttgccactcctgggtttgtttatgagttctaagaatcaaatcatgtcatttttcttgcaagggaaacacttcagtgattcaactctctctctggttctctctctgtctcagtacatacgattttgggtttatgtgtatgaatttttgtatgcatgtatacgtgtgtacccttgtgtacttggtatctgaggagggctgaagaggtcatcagaatcccgggactagagtaacataaatttgtgagccacaatcgcatggaatcacattcagatactgtacaaaaatgttagtattcttaacctcctaaccatgtctccagtcccaaagaacaatgcattgtctttttctataatatctatgcttatttaattttgcagtataatgctcaactattgcatttaattatattactataagataatatttgcagagcactttttggatataattattttgttatttaccacatgatatataattcttttattatttaccactctgagcattttgaaatgaatattgagtatgagttaataatttatactgctctgtcttttttccctgaaatcaattttctatataagcatcagtaaaatatactgatgtcttcaaaactgcctatgtaacttacagaaatgttatttctcttcccctttgttgagtatagcatttggaaatgtttattcacttaattaattttttatttatctgtatgtggatgtttggctttcatgtatgcctttgaacttcatgtgttccttagtcttcaaagactagaaaaggctgccagataccctgaacctacaactcaaggacagttgtaagctgccatgttggtgctgggaaccaaaactgtttttattggaagagatgcagatactcttaactgctgagttgtctgtccagttcctaaacttacattttatttggataatcaacaataccaatggcaagtttgaagtacattattattattattattattattattattattattattattactttgtgtaatttaaagaaacatattgtggtttgaaagatgactaaggggttaaaaccatgcactgttcttccagagtagcagaggttgattcctggtacccacctcaggcagcacatgaccatttgtaactacagataaatgaggaattgatgcctctggcctctgtggacacctgctcaattatgcaaacactcaaccacagacaaatgcacataacacctaatttaaaattatgtataaagaaacatatgtacactttcatacactggcatatggcagagtgaagagttgctcttatgagcaaaggattccagcatggaattcacaccaaaactgtatggatatgctatgctgagaaattcattacagatatacaattaattaaagaagaactgaggaatataatttatcatgtgaacaaatgtagatttgaaactttcattgaaacttgttggtaactggtgattagcattgggtacatatgaaggagaaaattgtaaatacaacagaaatcattcatgtaatttatatgctgcttgattatattcacaaactgtaattaggtttatgataaattttataagttacgtattttatacatagattattagaaaatatccatataatcatttctagcattatattgtttacagctatagctttatccactttttgctcattttaatgtgttcctcttttcaattaaaatttcaatgagtagctatgtgattatatatttttatttctcatttgctattttctagggaaatcatttacatatgtggttatcgataggaaagtagccacatgtactaaattcttaatgttggcattttgatattcaggaagacaaataatatttgagattctccacagaacaaaattatacattaaaaagtgatttttccttaacacacatatataagagcaacacttatgggccatagtaggttagagagatatatgtgtttgtgtgtatgtgtgtgtacatgtgtacatctgtaacattattaattatagagggagtcatgagcaaggaaggagttggataggggagaaggaagagtaaaactggcatcaataagacagttttcaccacagggagttttcaaaaaatattttaaaacaaaggtctcaaagaggtgatttatttgttctcaattacaataataatggattcttaggaattttaataagtatttaaaatacaggaaatgtgtctactatcctctagaaattcatagttgaacatagaaaacttcctatagatcaaataatgtgcagataatgaggcaaatcttacaacacatgactgaatgaagaacattaaagacataaagagatgcacattgcaggactttgacattatcttgctcattctccatttctgaactgcaacagcaagtacttttacacattttttaatattccaaagccctgtgttttattgcttgcttaatacaaagggtgttctacccattgattattaagaaaagaccttataactgcttccaaattactttgttagactgacctcactcagtacttctatttatgtactcctatttcgcaatgtccgaagtactatttcaaggacaaacaagtaacacattctggtcatatgaataaagaatgcaaatgaatgaacaggggcaagagaatcttgaaatggttatgaaacttcttatattttaacttgaatttcattatgagttttgttatatatctctaccatcacttaatacttcaatattgattactcctttgattcaagaacaaaggggtatacattgctaccacctctttgcagttaatttgatattttattttattttgtttcatgtgtgatgtgcacgtacacattcaggtgtatattaaagccagagttagtatcttcttacacacatttttatttaccaagactgtgtctcttcctaaacctgggcctttgaattatggtcacatctgggattccctatttccacctttcaattgtggataatacaattgagccctcatacctatccagcattcacatggattcttggaatctgaacccaggtgttcatgcttgcatagaaagcactttatatctaagcccccctttttctaaactcaaacaaatagcatgcatagcaatgtaacaataaatcttttcaacaagccgctagagccccacagccatacagagaccagaataacacaagagacttatattaattacaatgtggatgtccaatgactaggatttcttatctgctgctctgtcctaagcatcaaccataattattaatctatatagtttataaagacttatctgatcgagaacaccagtgacacacatcctctcttgccaggctcacatcgagtcaccacctctactacattttccagaaacctcttcaactcctagttccacctatcttgcttttctattggccaacagtgctttagtcatcaaccaataaggaaaacatatacacttaacaacatcccccatcacagcgtctgtggatattttgttctatatttctcagtactaaatgatgtggtttttcagtaaatagtggttgagcacagagtagacagaaagttgcacataacaaaattatcactctgtagaattcttgttctgtctaattttttaaagagttgataatgattgctccttgataaatatactaagatacattcagcaatagttttagaaatcatacagattggtaatgaatgcccaagtattttgagaaagattattgtgtatggtatttgtcataaatatgatatatgatatgtctatgtctaagttagggtttctattgttatgaagagacaccatgaccagtacaactcctacaaaagaaagcatttaattttggctggcttacagttcagaggattagtccattttcatcatggcaggaaacatggtggcatgcaggcagacattgtgctgcagaaataactgagaattctatatctggattgccaggcagcaagaagatagagtgacactgagcatgacttgagtttttgagaacttaaatccacccacacatctattccaacaaggtcaagtctaatagcaccactccctatggacccatggggaccgtttcatttaaaccaacacaatgcatatgtattttcaagtaactatcagattcctgatcaaaaagactgcaacagggatataatgtagagcattatcacaaaagtttcttgtattaccattttatgcctgcatcatctgcattcatctcaactttatcaataactaatgtatttgttgtttctaatattttatttcaataaaaatataaatattcagagtacaactttaagtattaattcttcatattcagcttaattgttgatggtttatttggattgctgtgtgtatcagtagctcaatttctttttcttgacaaggaatacccttctgaaggatatagtgaagttgtgtaagccctgtctatgaatgacatttagatttttacaaataaagctattaagaattcctgtttgtgtgcagactatgacatgatcacactttcaattctgtggagtaaaatgtagaaaataagattacatgtttgtatggaagacaaatatattttaaattatttttgtatgttcagaaactaaacataatcataccaccccactttcttgccctccagtcaaactttcccatttaatccatcttttctccttcaaattcatgattttgttatacattaatattttatatatgttagggatgtattatgtatttttcttttcatggacagcttatgaaagatccagttccttcatatgctcaccagtattcagcctttattttatattaataaatgtgctatgaaaattcatggttttttaaatgtacttccttacaggcaaaaacatataaaatattttattatgctaagtttttgtgttatttttcagcgttatttatctttgtgtttttttttttcctgtttcctaatatgagtactgagtgttggatttcttgagcagcttcactgttatggtatgtgtacaggagttatacagatgatagcagttataacaataaaaataaaacttaaaagaccctaagtaaccccctgaaaaacatttaattatcttcatgctgcatgattagtaggaatacattgaattgactcatttagatagactagtatgagaaagggttatatatgaccatattataaatatgcataagtttattttgatttggcacacataaatattctattatgcattagttactttcagatgcattgacaggataattaaaaaagaaactagacaaaagaagtacaatttggttcatagtttgagattataaagcatgggttgatgggaaaaagcatggtggcagaagtgtgaggtggctgatggcattacatcattagtcaggaaaccaggaaaaagagataatgattcttagcttatggtcaccctttactcacttgtcttgtctatctcttcaccttttatttattccctgaatcctagcctatgcattcactgacctttgtgctcctggtttcatctgccccacagagaccatagtattgcatacacttcattgttttggttgactagaagtaaacacaactgaaagaatacatgatacaatcagtaattaagttagctccaccacccacaaaaagtttatggaataataacagaaatcctaaatccagcattggtatgcaatagtacatgatatttgctagacttcaggaagatgaacacagtctgagtcatgctgagtcttccaacttatgttaagcatttctaaaaacaccttcatgatagggaatgtcttctgtatatatgtttgtttcattggttgatgcataaaacactgttggccaatatggcagcaagataggtgggaccaggatatgaggaggattctgaggtgtaggcagagaggagttatcatgtgatctcaggaagttacttagctgggcagaaactgccactagatggttagaggtctggaggtctttacagacaggaagtgatatagctgggcagaatcagaatataagcagggacaaacagatggagcctgtcactagctaaccatagaagactggaggtctttacagacaagcagaaagtgatatagctgggcagaatcagaatataagcagggacaaacaggaaattgcttatcttctctacataccactgagcagttgacatgtaggataccagagaagtaacaggtcccttgacttttctccggtaagagaagaccatatggaaatacttagattattataaatgggttaatttagacagaactatccagccaccagctaacagcttcatactaatatagcatctgtgggtttaatttgggcagggaaggttagagggacccagcagggccagaaaaatcagattacacctttacacaatgcccagaattgtatcatttagtcaagttaatacaaaactgaaccaccatcaccagtatagcatcttatataaactatgattatgataatgataaaagtaatacttctctcaagcaaagtttggcatgtataactttccattaattaataaggaaaatgtaatttaattaaccaagatcatgaattacttttttggaaacaggttctgtaaaccatttgtaactgaataggggttacaagaaaatgagtgatgcataagcatcaagatgtattggttgtgtattgattccttcaaggaactatgatggaatcttaaggagaaaacagaacactcctgttcacaattttaagctagtctattgttcattaatttaaatgattcttgtttttctcaaactggtaatattaatagtaagaaaattattcacaatatcataagcaagagaaacaattctgtacgcaagaagagagagtgagaatgctgacactgtgtgcctgctgggatcaaggatggaataaatgtcaaaaagactttggatttagaatcttagctaacagggaccaaaggcaccttgggtattattaagaagcaaaaagtggtgcaccctgcaaaattagttagactggggcattgcttggtgacaagttctgagacatcctcagaccaattgcctccaatgtgcatacaattcatgactttgcttagaagaagtaagcaaagctaaaagactacaagctggaagccaaggagctgctgtatacacatgtacctcaggaagaaaggtgaagaaattttaagacacagataacaagtatgagtatcaataggtggaatttgcttatctttctgcacatgaaattgagaaggaaaatgtccaggcaaatgcaggaaagcatcacttggtttggaagccaatgctttcaaaaacaaaagggaaaaacttaagactcatgttttgtttcagtaaaatgccaatatgaaatatttacttaaattgcaatagaaatgactcaagggataaaacacttgtatgaaagcctggggatatgagttcagatcccttgtacgcatttaaatattgcttcgtggatagagctgcttgccaataattctaggtcttagaagtcagaacctgagtgtctggagcaaattggctgaactagctgtgtaattagaaaagaatcgttagactagttggataggagagttttgggtgtacttgacagacttgtctcactgagtaaggcgaaaaatgtctgatgtcaacctaagcttctacaagcacaagcatgaacatacatagaaatgtcaatcacatagtcatgcatgccatacaaagatgcatccaaaaaacagcatatgcattatttcaagagttgcataagtttggtaccagcatctaagaggacatcttaatcaatagaggaataaactataattatagggaccccaaatagctcaggagcacaaaaattaaaagatgaaaaaagaaactaaatagatcatcacacacacacacacacacacacacacacacacacacacacacacacacactcacacacacacacagctttcaaaatgagaatgtgtcaggtcctatcttcttccaaccaaatttaatttaaattaagaaaactctggagacaacctggtacaaaggtccaacacagaaaagaaaagataatcctgtccagcaggtaaattaaaatatgttttaacctgtggtaactagtgcgtgcgtgtgtgtgtgtgtgtgtgtgtgtgtgtgtgtgtgtgtgtgtgtgtnnnnnnnnnnnnnnnnnnnnnnnnnnnagacagagagacagagagagacagagacacagacacagacacagacacacacacacacagagagagggagggaggagagagagggagagataataaataaagtttgcctgaaaatcagagtgcagaggtaagtgacatttttagcaatagaggccatgaagtggtaacacacacctttaatctcagcattcaacaggcagaggcagaggcagaggcagaggcagaggcagatggatctctgtgagttcaaggccaccctgggctacactagattgatccagtctttaaaagaaacagagctcacacatttgatttctgtacttgggattacatgcctttattcccagcactagggaggcggagacaggagtgatatggctgggctgagagaagaatataaggctggaggagacaggatctcaaagcattcagtctgagaattcttagggacagaacagcccctttggtctgacaattcagtaggtataagaactagtagctggctgttctgcttctctgatcattcagcattaacccgtatatttcactctggatttttattattaaaataaattagaattcatgctacattagtctgtgcctcatgggtctatataaattgctaagatagtcacagacagagtgagcaggaaaacattctactaagtcttatcaacacaagacacagctctcacctcaaaggtaagaagagtagatatcttttgagccaaatatggattgaggttatttctttttaaattacctttcattaaaaaataaagttagttcaaagaagatagtagacagttcatatatgaaaatgaaaattaacatgctgcatttatttggtaataatactgtgaggagaactttgctttctaaagaaaagacctcttgtttttattcaacaaacgtgctttggagctatgcagactgattataaggacccaaaacaagggtctgagattgttgggatgttcctatctgccaaagtgactttgtttactgttcctaagttagaatgtctattgatatggctgaaaatatcaaccaaatttgtttggattattttgtttttatagtgttggaattatcacttcctgagaaatctcccagggagtgaatcccaggagactgaagtgaaagatcttaatcttaatataatctgctcataattgagtctatatttgtctttgtcccatagttaacctttctatttaggattgtgtccattgccaatctcatgggtagtcctaagagcttaaagaaaaccagttctgtgtgcctagataaattatgactaaagattctgtctttctattcacttcattatacagttcaattgaaactccgaaaaaaagaaagaaaaactatatctgtgattaaacacgcggtttatatttatatatacaatctcatgaatattaaaattctaaaactataattgtgctgcaacatatgttaacttgtaattttataatacatattaagtaaagattcatatgcaaactagcattataaagccaaattttgtagggagttgattcattttattgagcaagaaactgcttaagaaatgtattttatacaaactctactcataaaatactgattctaatattcttattctttcattaagttaaattcaacagtatttctaagcagcaagatattgctggcttttattttactcactataaatacttgtaagtaatacaattataataatgtctatgaaagcattttataacctcaagaatattatgcacatggcatttatgtttcaggcctctaaatgtatactgtaagttttgctctcacccagtcaagcctcaattccaaaattaataaagacttactgtggaagtatgtgttaattctctttgtcatttatttctactgcaactactttcccctgacagttcagagctacccgttgtactgtattttagactgtgtaggcattatcttcaatgccataaacaaattcaattttgcatgaaagatgatatatttttattgatttttcttttaatactaaaaggaaattgtgactatgaacgtatttctttttctttcttttttttctttttttttggttttttgagacagggtttttctgtggttttggaggctgtcctggaactacctctgtaggccaggttgttctgcctgggcatatttccttttaatacaatccaaaacagtgactgtaatataaagaataaacagtcttcttcttctggattatgttatttgttagatggtaaatcctatggtgctgggtagctacttggatattagaacatttgaaggatgttcaggatatacccataatactcataaatatggcctatgaaaccaaaactagagctgtaaaaatctcattacacatcagagaaatgaagcatcaatacagactctggcatcaatacataatagaggagatgtggcatctggatgccattattgttagccagataaacatggttctcagagacctgaaccttatcagaaactttctgatgtagagcaatgatcattagacattgtgtttaaactccctgatgaatgcaatgcacagaatcacaatggtccttacaattgttattcactcttgcccctgctgagtgcctcattcactctgataaactctgctatcatttacaccaagctgtgtatcttgtcttaattatttacaataactaaggagtcaagcagatagagtgagtccccaaggcattagtacttactgagttaccaacacaaatgtgttgttgatatttggatgcatgctattctttctcactattttgtggctttgaaaatatgtatgtaattagaatataatgaattatgtgaaatatcaatgtacttcacaacaaaaataattcttagcctaatattttctagcaattcaatgatgaacagagtatctcagggttcacacactttgagtttaacaaagttgaaacagctaattattagagagcaatagaacagacacttagtgccttctacttctatgataaagcaaatatagtaagacttcatttcattatggttatcactcatgagaatgacaacagctttgaagaaaatggtttttgaaaagtcatagatagtagaaataaatcacacaatgaggaaaaaaatccctatgttactaacatcagctgacctcttatatctcttgatttgtgactatagttttgtggtcctttatgaagaagaaagttgcacagccttcaatcacactatgctgtcactggcagcaggaaatatttttgctatattcatacccatctcaaaggtaactccagactaaataataaatttttttccttgtaagaaccttgaaatattcaacctatcttcttccatgactgaggaaacttactgtccttgcccaattgcaaaagaacttcatgataaatggcctttgttaacatgtgagtttgtactttaaggtgtttcctaccaggactactacaaactaaccttctgaagtgtatcctgaagccaattaaatgtcttcctctattagaggttctctgatcatgatgtctcttcacagaaataaaacactgactaagacagaaatttgtaacagagactagggtattactaggataggttcaaccatgcttttgtttggaggaatataaactttggtactttcaattaggaaagcagttgcacactttaacaaggatttaatgaccatcctattagtaacagggaataccgtggtgtagtgggtgatttggactatggcaggcccaactcaagaagtttcaaatgcaaagaacacagcatgtggcatagagaatattcttgttatatttttgtaaagaatgtggctgctcttttgcacttgtccaaaaaaaaatcttcctgaggctaaattaacagttatgtattaacagttttgaccaagaaaatttctagacaacttagtattgatggtgttgtttggttactaattgccacatttctgcagatctataatgaaaagaagcaagccaaacaaggagaaacaaagcactggggaacagtttaaagaaaaatctgttccaaaatgaaataacaggcaagacttgatcatgctaagcttccaatttgtgaaaaggaattaaagaaaagcttagagctatgtttggtgggacacactcctttaattccagcacccaggaagcagggcaggaagatctctgacttcaaggctagcctggtctacagagaaaattccagaacagacatggtaaggcagtgaggaaaacatcaaaaagagaactctagtaaaaaaatgtttttaaaggaagggtccatgctctgaccacagagagcaatagaacatgacagctttggccacatggctctagctctaaagtccaggatgcaagtaaggagatcttaaatctccctctgtgattaaggaaagctactgagatcacatgtgtggtgaaagtgtccttgtagagaggccattgcatagtactctggagatgaattctggattgccttgaagagctagaaaagggaatggaacctactcaagagaaagaaatgtgctagagtcaatacggcatgccaacggacactcacagagggccaggtttggtcttatactcgttccccagctatcagacaggagtccttgagctcccacttgctcaggtcacctgtttctgtctctttccccagcatagtcttgatccatttgctcatagctcattcgtctatacaagtggattccaggaattcgcctcagtgcttagctatggatatctgcttctgcttccagcagccactggatgaaggctctatgatggcgtttaaggcagtcatcaatctcattataggggaaggacatttaaggtagcctctccactattgcttagattcttagttaggattatccttgtggatccctagtaaacctagtaaacctagtgcaaggtttattgttaagcccataatggcttcctctattcaaggtatctctttctttgctctctttctctgttcttccttgtgatatcatcccacattgccttctcccctcctctttctctcatcttctacccctcccccatgctcccaatttactcaggagatattgtccctattaccttcttgggggtccatatgtgtgcctcttagggtcctccttgtttcctagcttctcttacctcgtggattgtaggatggttatcctttgctgtatgtctaataaccacttatgagagagtctgtatctgggttacctcactaaggatggtttcttctagttccattcatttgcctgcaaatttcgagatgcctttttttttttttttttttttttttttttttttttttttttaccactgagtagtacctggtgtgtaaatgtagcacattttctttatccattctttggtttaggggctcctaggttgcttccagattctggatcatacaaataatgatgttatgaacacagttgtgctttgaatgtgtaccctttgggtatatgcctaagagtggaattgttgatcttgaggtagactgattcctattttcctgagaaaccgctatcctgatttccaaagtatctgtacaagtttacattcccaccagcaacagaggaatgttcctctttcatcacatcctctccagcataagctgtcattggtatttttattttggccattctgacaggtttaagattctttctcagagttattttgattttcatttccctgatggccaaggaagttgaggaatttcttaaatgccttttgccacttgtatattttgaagatcatcccactgtcagaaatgtggttggtgaagatatttcctctttctgtaggctgccattttgtcttgttggctgtgtcctttgccttagagaagcttcctagtttcaggatgtcccatttttaaatattggtagcagtgtctatgctactggtattgtgttcaggaagtagtctcctgggccaatgtgttcaagggtacttccgacttcctattctaagaggttcagtgtggctgaatatatgttgagtctttaatccatttggactcaggttttgtgcattcatggagacagatatggatgtatctgcaatcttctacatatcagcaatatttgttacagatgctttcttttttccattgtgtaactttagcttctttgtcaaaagtcaggtgttcatagctgtgaggattaatatgagggtgttcaattcaattccatttagacaaatggtctgtatttgtgccaataccaagctgtttaccttactatacttttatgatagatctggaagtcatggatggtgattcctctggaagttcctttattgtaaagagttgttttgagtatcctgggttttttgtttttccatacaaagttgagtattgttctttcaaggtttctgaagaatttttctgggattttgttggggaatacattgaatctgtagattgcttttggtaacatagccatttttactatgttgatcctgcctatccaatagcatgggagatcattccattttctgatatcttctttaatttctttctttaaagatttaaagtttttgtcatatgggtctttcacttgtttggttagagttacctcatgatattttatgatgtgtgtgactattataaagggtaatatttctctgatttctttctcacccatttattgtctatatataggaggactattgattgtttttagttaatcttgtatcctgccactttactgaaggtgtttatcagctgtaagagttccctgaccaaatttttcaggtcacttatataaactatcatatcatctgcaaatagtgaagtcagacttctttctttccaacttgtatccccttgatctccatttgttgtcttactgctctagctagaacttcaagtacaatattgaagagatattgagagactggacagccttgtcttgttcctgattttagagaaatcacaataaattttgctccatttagtttgatgttggttcttggtttactttaaattcctttattatgtttaggtatgttcccattatccctggtctctccaagaaaatttatcttgaaggtgtgttggatttcatcaaagaatttttcagctctagtgagatgaccaagtagttattcagtttgtttatctggtggaatacattggcagatttttcatatgttgaaccatccctatatctctgggttgaagcctatttgatcatggtggatgatttttttctgatgtgcttttatgtttgatttggcaggattttattgagtatttttgcatctgtcttcctgagggatcttggtctttactttttttttcttggttgtgtctttttgtggtttaggtacaaaggtacttgtagccttgtagaaagagtttagcaatgacacttctgcttctattgtatagaacaatttgaggaatattggtattagctcttcattgagtttctggtagaattctgcactgaagacatctgtccctaggctatttttggatgggaaaattttgatgactgcttctatttcattataggttatagatctatttaaattgcttatctgttcttgatttaattttttatatgatacctatccagaaaattgtcgatttcctttacattttccaattttgtggagtacacatttacaaattatgatctgatgtttctttgatttcctcagtgtctgttgttgtgccccccttctcatttctgattttgttaatttgcatgttctgtttctgccttttatttagtttggatgaaggtttgtctatcctgttgattttctcaaaagccaactctttgtttcattgattcttttcttttttctactttatttatttcagccctcaatttgattattttctggcatctacttctcctgggtgagtttgcttcttttattttagagcattcaggtgtgctgttaagtctctagtgtgactattctccagtttctttatgtgggcacttaatgctatgaactttcctcttagcactacttttaaggtgtcccataagtttgggtatgttgccttttcattttcattgaattctaggaagtctttaaattctttctttaattcttccttgacccaggagcaatgtttttgagcattgctcaatttctatgagtttttaggctttccgcaatttgtgttgttgttgagttctaactttaaaacattgtgatccagtaatatacaggggattttttcaatttattttgtatctgttgaggtttgttttcttgcctagcgagaatgtggtagactttagagaaaatttgatgtgcttgctgagtagaatgtatattcttttgtgtttggatggaatagtctatagatgtctgataggcattcccagtgataagagtggggtgttgaagtttcccactataagtgtgggggtttttatgcatgatttaattttagaaatgacttttacaatcatgggtacctttgaactttggacatagatgttcagaattgagacttcatattgaggtatttttcctgtgaagaatattaaatgactttcttcatgtcttttgattatttttagtttgaaatctaatttgttaaatactaggatatcttcaccagtttgtttcttaggcccatttgattaggaaatcttttcccaaccctttattctgaggtaaagtctgtctttgaagttgagttgtgtatcttctatgcagcagaaggatggattctgtctttatatacagtgtcttagcctgcatctttttataggttaaataagaccattgacattaaggggtcataatgaacattgattgttgattcttgtttttttacttgttgctattagtggtattatgtgttcatttcccttttgttttggcttttggtaatgtggggttatctgttgcctaattttgtgattgtagctaactctcttgggttagagttttccatccagtactttctataaggctggatttgtggatatgtattctttaaatctggttttgtcatggaatatcttcttttctccatctatactgtttgaaagctttggaaggtatagtagtctgggctggcattcattgtcttttagtgtttgtagaatatttatccaggaccttctggcttttagagttcttttgagaagtcaagtgtaatttttataggtcttcctttatatattacatggcctttttcctttacagctcttgatattcttgctttattctgtatgtttgttgttgtgctattatgtggcaaggggacatgtttttgttctaatctttttagtattctgtaagcttcttgtactttcattggcatgttcttctttaggttggggatttttttctatgcttttgtagagtatgtttactgtggtcttagctgggctttttcaaccctcttctttacctattattcttaggtgttgtcttttcactgtttcccttatttcctgggtattttcttttaaggattgttggatttaatgttttctttggttgatgaatctatttcctctagtgtatcttcaacacatgagattctcttttccatctcttgtatcctgttggctttgcttgcatctgtacttcctgattgtttacccagattttctttatttttccaagattccttcaggttgtgttttatttatggcctctatttgagtttttaagtcttgaactgtttgaattatttccttcacctgtttgattacattttcttgactctctttgctgtctttaagacatttgttgattacttggattctttttggtttgtcttttcttccatttattcattttttgttagtcttttttccattgctttaagggagtttctcatgggagtttctcatttcctctttaagggcctctatcatgttcataagttattttaaggttacttttttctgctttatctgtgttgggatgttcaggtcctgcttttgtagcattcctaggatctggtggtgtcatattactctttatattgttgattgtattcttatattgtcatcctcccatctattcctccagtggttacaggtggggtctctctatggtgggttgggggcaaaggctcagatagtgcagagtagtgatggatggtttgggctgccccgaggtctctggggatttggtgggcaggacgaggtgatgtgctcaagtcaagggcctccaaggattgttatagaagggcaggagaaggccaggtgttcacctctccttgtgggtgtgtggccaaggctctaatggcagcaaattctggatggtgtgggctgcccttgcatctctgggacttttgaagttggactaaatgcattttccattaaactgtggttacaaaccaatggaggcaggaaatggaaagtagaatgttgaatgaaaatgacttctgtagctacacagagattggcattattaggaggaggggccttgttggattaggtgtggctttgtaggaggaagtttgtcactggggacaggatttgagctttcagatgctggaaccaggcacagtttctctttctctcttcctgctgcctgttgctctagatatagaattctcaggtatccctcctgaatcatgtctgcctctgtaccaccgtgcttcccaccatgacaacaatggactaaacctctggattataatccatccccagtgaaatgttcttctttataagtattgctgtggttatggtgtctttttaaaatcctaacttaaacactaacctagcctgtgcatcattatagacaaacaacctcactcattattgtctcaactttggtaatgagtgctgtcttgctaactgtctgaatgttcagttttgtgtctgaacagctgctactccacatagtgaggatgacacacacaaggtaacttttacaagcccactagtgatttagtacacagaaaccttggtagcttcaaaagctcaggtgaggaacttagaccacatcctgtccataacttctgttcatgatatattaatagacttttatacatagtataaacagtaagaagatgccacgaaatgactttcttttcccactcaatgaatttccttctgtcacaacagataggtttaaatttctaaagatgactgaacatagtaaggtcttgttcttatttacattaccctgtcaacctccttgtatcatctccctttgtccctcacttttgctattattcctaaaagttgttaccatgtaatcttttatctaaacgccattatcttcaaacaccattatcttcttgagtagtgaaaattcaagtacttgacacttgtcacatgtccaagaacctgatatttggccttggcaggctgtgggcctagagggaatccaaagactgttgttatgctgaagtaacagtaatgaagtgactctttagggcattttcatatactcatagcacagtgagtcactcaagtcatcagagaagcttcattttgcagtagatggtaacagagagactcacaactgaacaatgtgcagagagtgaggaactttggaacacttagtccaaaatggcatatctttcacactcaaatctactctcaggtctcagccagtcctaaagaagaaaagaaaggaagattgtaagagtccgaggaaatagaagagacataggaagcagtggcttcaagacacaacaaaattcacacagatagactcacaaagaccatgacagcatgcagatggtgtgcataggttcactctagatgaagtctaagcactgagaagtgaaaagctcccatccctaaccaagaaactatggcaacttcttgcaaaagagaaaatagttttctgtaatagcttcactgggaatacaaaccacacttaagggtagacaattgtgcagtaatcttttggtacattgtgaagctgtgtctttggcaaggtaggttctgattgatttaataaagaactgaatggccaataactagtgaggaagaggttttgggcagagagaaagaagagatcactctaggtatggaaaagatgccagagaagatggagagaaagcaggatatgcaggaggagaggtaaaagctatcagccacatggcagtatgtagattaacagaaattcattaatgtaagttataagagctagatacaaataagtaaaagctaagcacaagctttcataattactactaagtctctgtgtcctgatttgggggctgatggtccaaagaagacttccagtgtaggccccttactcaacagtagattgccaaaacaaaatgaacttaatcatgtatttgtagactttttattttcattttgccttgtttggctatttttttgggtttttttggccttactgatatgttgcttgtatattacagtttaagatgttatctttgtatgcttctatttttcttatgtgtgtgtttcttgtgctttttccttttttcttttttgttttactattctggcttggtttttctttgtttatttatttgttttctgaagggaaagagaaggtgtggagttggtggaggtagatagaaagagctggaagaaggaaaatcataatcagaatatggtgaatgaaagtaattttcaagaaaaataaagaactatgaaaaatatttaagtattttgtgtttgcatacccctgacattattcttacatgtctgagtcattcagtacagaaatttgaataagaaatctttcagtgtcaaacctaacacagaaaaggaccttcagagattgctcagaagttaaatcattcatgcttttgcaaggcacctgggttcagttcccaggaccaacatcatggctcacatccatatacaactccaataaaggaggatttgatgacatctcctacctctataggcatcaaacacacaagtggtgagtatacacacatgcaggcaaaacactagcacatgtaacaaaaatacatcaaaatatttttgaaaatttaatgtacaccatgggcctaagtgtttgccagtttttttttttttttttttttttttttttttttttgacaattttttttcgtttgcaacatccagacaactatgggtaaaatagtcattttattttgtcccatttctgggttcttctttggtgtgcaaattaatctaaaattactgtcatatggagattagaattcccaaaagcacagaaaacactatctctgtattttctagttactacgacttgtataattatttacagtttattctttcagattttattttataaaacttaatattgttagttggtaaagaagtaaaatgttgggtagtcactggaatttatactccttcttctcagataaatacattgtatatcttattaactgctcaatactggaaccagcatcttgtaattgtcctgtgtgcatgaaactttgattggaattttataagctgaggtagaataacaggaaccttcttggaaatgaggaaaacagagttaacaatttcctaacctgacaacaagtggattctctgttgatataatactctatccaacagtcatcacttctggggttcaatctggggagaaaatatgccactcacttcctagtgatgaagtactttttttcagtctctgagtcccttaaatatatcttggacttcctcaaatcaatcatgtagcaccagcaatccagagtaatggttcatttcaaaaggttattgaactaatgaaaggtttagggaaggaaactaattcattggtggtgtgcaactcaagcatatcttccttttcttctgttgtcagactaaacttaaaaaataaagcttacctacaaaaaaagaaaatgaaacaaatgaacaacaataacaaagacaaaactgtgaagtattttatagaaccacaaatgacatctgtataagtggcatgtatattttatcagagagaataagtaaagcttttgtttattatttttaagtattaaatattacctttatatatttatttttcacctagcttacaaagttccagatttccttatggaacttgtctcaatcttttattttggttggttttctcccttctacttccccttatcttcttgatccttctttttctgatgtgacctttcacagtcattaatccatcttctttctgctgaatctattgtctttcatgccctacttcccttaaagcctcttatattctagtctcaagacccttccttagctttctggacttacattgttcccacctagatgcactgttttaagaacagaagttactttctgcatatgtgagaacacagagtcttttgttgttttcctgagtcagggttatatttttttaaatatattttctttgaactttttaatcatctttctaaacttgtggctacttctaaaataaagaaatctccagcttcaatcggtgtaacattgttaggcaccacatccatgaaggacaagtatggtctaatgtagaaactccaacaaggaggaaaactactggatcacagatttttgacatgatttttttttttattttaatacatcattttctcattttacataccaatcccagttcccactcccttctctcccctgtgtccccaccttactccaccccaccccattcagtcctcagagagggtaaggcttcccatgtacagtcaacacattttggcacatcattttgaagcaggactaagacccccccatatctaggctgagcaaagtatcgctccaaagagaatgggctccacaaagccagttcatgcactagggataaaatcttggtcccactgacagtggccccacagactacccaagccatacaactgtcacccacactaagaggccccaatttggtcccatgcaggctccccagatgtcagcccagagtcagtgagctcccattagcttaggtcagtggtctctgtgggtatccccaaaatggtcttgacccctttgatcatattatctctcctccctctcttccactggattccgggagctcagcccagtgcttagctgtggatctctgcagctgactctttcacttgctggataaaggttccatgatgaaaattcaggtagtcattgctctgattacaggtgaaagacaattcaggtaccctctccactaatatttagggtcttagggtatttttgtggattactgataattttcttagtcacaggtttctcctaatgactctctcaatcaaagtatctctttccttgctctccctctctatcttcccccatctctaccaccccattccctcatgttctccttccccctcttcccctccccctccctttctgctttcttttctcctctcccattatgctccctattttcttaggatatcttgtctatttctcttttccaggagaatacaggtattttagggttcttgttacatatcttctctggggttttgggctataggctggttatcctttgctttacatctattacacacttatgagtgaatatatgccatgggtttgagttacctcactcgggacagcttcccatgttttatctcatatttaccatgtagagctatattaacaataaaattcactgtggaacagtgtggggatgctgaaaggaacgcactccaggaaataacttgaatattgcattttgctattctcatttctcaaagtctgtgaatctttaaagttggttcatacctggccctgcaaattaatatgacatttttttctaaaatggacattttattgacctcagaattgattttaatttcaatataatttaatgtatacacaataatgattgttcgcaaagaattatcttcaggacttctgttcgatctctgatgcattctttttaaatttattttatccactgttatgacacatttccattctttcattttctatggcccaatttataattctatccttttactttgtcctttcaattcacccttttcctttgccaatcaatgtctataaatacctgaagattttatattggataaagatctgtagcatacattggggtttataatcaatatttagatttaatgggtgtgtttaaagagtaaacaaacaagtactttattactataattcatcactcaaactatagcaaagcattaatacattgagcttctagggcaaaactgttaattcctctgtccttaaaatgttagattctttagctttgttttatttatatgtattttgtcatcctttgtaaagaatcacaattaaaaccacatagaagataatatccagtgttcaaatctctcccagtatctccaggtatcagacaaacctagaatggtacacatgttggcagtacgagttctaattgctattaatagtaaaaacccagagtcagatatcaggataaatgctaaaagatcagagagacaagggagcaagttgcagctacctcttacctgcccaacctcttaaccaaaaagagcaaagttcctgtctcttccctgcattatcactttctctctcctcccagccatatcattaattgattcttcttcttaggtgctgggattaaagtttccaccactactttgcctccatggttaactcatagctatctttgccctctgatcttcaggcaagcttcatttgttacagtacaaagaagatatccccacatttcccctttttggctgaaataaaaaagattataattaatagaagaaaaactatatataataggaacaataacaatatacaatatatacaggcaataaatacatcaacaatgtctactccatgaacaattgacaaactcagacaaaatattctatatctatcctaccttggtgagtccaaatggttgtacataactagttttctattcttacttgtagtaccaaaactatctttttatgtctctcaaccttatttactttacattttttactgaatttcttttctgaatctggtaacaagggaaattataaccgtaaatatgaagtcttcaattccatcagagatacaggaaagaaatattatgcaaataagcatcaagtacaggcaagcaaattcaaaataatgtgagaaataacagaaatatctagtttcctaaacagtcacacaaggttcctctgcaatgtcggggcatccatctttgactgaaaggcatagtatatctgacagaattttctgtgaagcatgatattctgaagggctgtcctactttgtcttggcaaagttcagaaatcactttattttgtgtcctgcttgtcaaatttggacaccatactgccagcaatcaaggcaagagtattttcttgcccagtggcttaattttgtcacaaagaaagtaaaattccatgtggagttgatttggtacccatcatcttctccaaagtagattgatgctgccaagagaaaaaataactcaatgtcataaaaagaagaacttatgttattaaaacctcttaattgccatattctgtagatctctgaagtgtttgaagacagcctgtctatttaaattatatctctgtttgacctaatatgactacacatttgattgtagtaggtgactaattgctaacctgctttcaagggtaaaaaattgcattaatttgttaaatgagttgcatattacaataccttgaacaagattaaaaatgtatatactgtatgttctaacaaaatcttgaatatttatcaatatacaaaaatccatatcaatgtaaaatatttaaatctagtagttgtcttttggtttaaaagtagattcaataagctaccattatcctaccatggctatactcctctttttttcttttcagacaaagattcctgaatattcctttgttcaacttttttttctgattattgctaataataacttgtaaccaactaccctaaattgttacagatatccataatccactgaataaacaacaaaccatccaccacatctcttggggatgtgggtactgtgttcttaaattcacttccagctgtcttgggatgacagcatctttaggttatcctgaaaagaaaatatgaattaattgtcaagtcctgggagaggtaactatatcattcgtcatccagtctctgattaatgcgaaagtgcagggcttctctcaagtcctggctagagtagtttggaaggttggatcatttccactagccacctcaaaattgtcctgagcagtttgtagtccaaagcagatcttttttatgtggtatttttcagcttagttgtgttatcatagtcttggtggaatcaacatttggggccctatcatccttttggagacttgaaaggtttctcttaggcatggctatggttcattacagaaaatgtaaatgatttaaatgtgatatgtagcagatctcaaagaggttaaaagatcaatatttgttatgtgtatccagagaacaaaattctaattcctagttatctgatagagactcaaacctgaaattatgtgcagaaagcagaatgaagcctttttctagaattagtactctatatgaccattaatatcatgacaaaaatttaaaatatgtgtatattagtcttataaattatgaagtagtatttataccttaaggaaagctttgagtgtcaaaataaaaaccaatggattatgagatcactgacagtaaaatagtccttatattttgttttttcttctgtcctatatcaggtagcttctttgacttgaggcagagatcatggattttactttagcatgcatacttgggtttagagaaggagagagccacactccaactttgatttttaattggaccaggaatacaaaatgaccatttgcattatatgtttgtagagaaaagcagaaacaaacatttgggaaaatccataaatatttattctgttggagatgtgatatactaaaggccaatttattcattttcttgggacattttttcatgttgcttcacatgtcttatttgtctagcaattttcagattctgtagctggatgccttccttctcttctatggaatccccacaccaataagacactcagttcctgactcaaccctgccttatcacttcctctctctctctctgattttgcccagccatcttatttcttgtttcccccccccagccactaggattaaaggtgtgtgtcagcactgcctggcctctatggttaatagtggctagcctctgatctttaggaaagctttatcaccacacatgtccacatacataaaccaatagaaacagtctatcctcaatacccactaaaacttcaaagcagagcccacagtgtggtaatgttctgttccttatgctcttattatctagtacatttcctaatgtggccacctttctcaagtaataaatgttcacatgtcaacttttctattaccttcaaatgcaaatacaattctttaaagatttaccacccccatctcttaagtttagatggaatttcttgatatgacagcatttgtccttacaaaaagagaaggtttaggaagcatgtacatatttggtcctcttccttcttaatggtttaatgattgacacaaacaaaggtgttaaaactgagcacactccaagggaaagaagctttaccaaactatttcattaaataatttccatttagccacagaagggggttgactttcattgaaagttttattctagctagatgtatttccaaaaaaaatatttctttccaaaataatgttgaaggatttgatccatagttagacatagttgaagatggatttgaattttttgtcttcttgcctcaacccaccatgcactgggtttacagttaccaccacccttgatttataaactgctggaaactaagcacagggtctcatgcatactagataatgactctatctactaaggtgtatagtttgctcaagtgtctatttattttgaataattctactttggccttattttacatgtatctatattctaaagttatataacctcacagagatatgtgtggaagccatttacattctgttatctcaaccatgctaggaaaaccaactctaatattaccctatacccacaattatattgctgtcatcaagacacaaggcaagaagctcatttttctgctgtccactaatttcaagattttagaaatgtgaggttacattctcttatttatcataaaattggtcaaaagaacagacacatcagcattttgcttattttcaaataagaataaatttattcaaggctctagaacacaagttttgattattgtcatccaacagcataaaaagtacaaaacagatcggtgtatttctaatatattaaaacaaaatgtacagccatatacagtacaccctataggcagagaggaggggtaagagactgtggttggggtctagtaatcatttatcttcacttcaaaggttgttcaagtatttaaatccatatgtaatatttcagcaagacttctaggtatcatttatcccttgataacttttatatactaaattaccttaaataatatatatttcatattgaagagttattgtataggggatatttttactaaagaagaataaacagttacctaaaaaccaagaaaagtatatcacactgaactaagcatagttttcattattttataaccgtgattcggttttcatcacccataaaacattaagagtagataaaaatgtctagcatgtgtgacaggagaaatggcttagtgattaagggcattttctgttgtggaagctgactgaagtttgcttcctaggctcacaaatacctctgaaactggtctgtaagggcacaagcatgtatcgtaaatgaatatacacagacaggaacacataaataaatgtaaaacagatcagctttttttgaaaataatttttcctctcatactatacatgccaaccacagtttcccctccctctactcatctcactctacccatctcctctcttttccagatgcactcctcctcctctgttttcttttcagaatagagcaggactcaagagatgacagccaaacagaataaaacaaaataaaaaaaatgacattttggagtttggtatatttgtgggactttttaacaatggaatcaggggctgggtcttgggaaccaactcctcttactggattgccttgctcagcattaatacaaggagagttacttacccttacctcaacttgatatgccttgctggttgattcctatgggaggcctgcctctttttgaacagaaacaggatgaatggattgggaaataggaggagaagagggaggggaacctctagttgggatgttagttatatagatagatagatagatagatagatagataggaaaaacaaggcaaaggctctcttttagagtacagagaaggcaacccaagtggaggaaaaatggataaagagcaggcaagagtcagtgatatacccactcttgctgttaggagtctcacaaagacaccaatgtaacagctataacatatatacaggggacttggttcagacccatgcagggcccctccttgctgcttgagtctgtgtcagcacttgtgagccctgattaattgactcagtgatacatgttctcttggtcctccccaccccctctgacttctacattctttctacctgtttctgtagagttcctttcctgaggggcagtagcagacagagaattctaaattagactctgcatatattgctgtgggtctccacatttgtccctgtctgtttccagaggaagactctctaatgacttctggagaaggcagtgatctatgagtataacagaatattattagggatctaagtgttggtcctttcaaaagaaaatcaagataaacagatcactacccttaatagctaaaaggaagaaaaggaagacctaagttaacaggactaaaagtgaacaagaaaatgttacaacaaatactaaagcaattctgaatagttgtttggtttttccccactcaggtctgctggtcatcttgtgactaagtgtgacgtgctgtgcccttccacattggagtctgctgaccatcttatgactaggctagagggagaatacttgaatataataaaagctctatctaagaaacatacagtcaccattaccctaaatggagaaaatcttggtaacattctactaaagttaggagtgacagtggtagttcattgtccccacatcttttttatgttgtgcttgaattactatctgtagaaatgacacaaatgatttaaaagaaagggatataaatagaaatagaaaagcaaatatttcctatttgcagatgacatggtgccatacattaatagatgcccaaaattttcccagagaacatctagaaatgatgagcaaattcagtaatatggcaggatacagagttaaactgcacaaatcaataggtttcttatacaccaacaatgcaaatacagaaaaagagctcatagagaccccatccacaacaacctccactccaaaaatctaggaataaacctaagcaaggaaatgaagttactttacaatgaaaactttaattctctctagaaagatctagagcaaagcactaggaaatggaaagacattccatgctcctgattggatacaattaatattacaatcattttaccaaaaaaaaaaaaacatttagactcaatggaatcccaaatgatgccctgatcttatttattatagaaatacagaaaaatatttttatattcatatgttaccaaaaaggaccccagatatccaaaataatatagagtgaaaacaatagtactagtattgcagagccatggtgacaatgattccctccaagagacaaagactttatttcaaaaactctaatatcatgcatgagaatatttcttttgtattgtttatcaaagttgtccaaaagattctcaaaacattatatacttttgctactgcccttgattaccccatagttggaatttaaatttatattgctgaagagaattttcacttctaatacagggactagaggcccctacacaagaactgaactgtgagccttatacctcatgattagcttacataacaccatcgacgttatgaaagctttcaaaggaggtaggcaaccaacagtctacccagatcaatgactgtgatccagaacaaggatctgcatggtatgatatgtaggggaagctgtagccacacctacttagggcatggccagggtgacatagagtgagaggttcaggtggctggttgacttttgttttccctttcagcttgctgtacagactgttgccacgcgggctggctaggtcactttgtaagtaaggcttttccctattaaatacccttatatttctacctgactctgtattggtaatttcccaatatatctggttgtcaggagtgggatattggaaacctacaccccatttgggacaggctgtgggttcaaccaggccagcagcctaggctgggaaagctccctttctccacaggtgctcccggctcccagccaacctgctgcaacacacaagtgcattcctgctgcagctgagttgctcagaaccatccacccagcttggaggcagtttctatttgcctacagtcgagtaggcctctgctttcagcaggggcttcccctggccactgctgtggtaaaaccacatctatttcagtggttgcagccacaaggcggtataatctctaagataagcgcagctacttttgtgacctctctccatcactgaccaaccactgccaaacgacacatggagtagctgaacgcctgtgtcacctgctggtcaaagatagttactgcatctggagtagaaatcaggtaaaattatggcggaatatttatcatttgttaaaattggtaatatttttgcttattacatgaattcaatgtttgaggaggatgctaatttgccatttacaggcctatatgccataatggcagttagcctactggtacaaataatattactagccagaggactcaggaacagggacagagataacctcacaacctgcttgcaggaaataacagctttacgcaatgaggttttggagaacagattaggtaagaccacaattgtgcagcaagcagaaaaaaattggatgataagcttggctctgtgtccaatactctaaaacagagctgtctgttactcaagatgagatgcagcatatttatgataagataaacacagagagatcctccatgtctgaggccttagaggctaggctgccagaagaccgtgaaaagctacagaatatctgcagtcagctagaaactcagataggcaatgttacccagaaactagatacaaaggtgcaaaatacccaggatatggttgaagaattgtacaattccaatcaataaattattgaagcatctaaggtagcagatcacaaatttgagtctagatttgaatgtttggaagacaatttacagtacagggctgacagattacatagttccatacagtggattgctgaggactcaaaatcagcaaatcatgacctcgaatctagtctctaataactaggatgcagtttccatgccatccagatcctgcctaaggatgatcatattaaagacttagaaaaacatgtaaatgagcagttagagcaatttacagattcactaacgtgcttggaatcttttatgattaaggagattgaaacttttcaaaaggatatcattgctaggcttaaagatcaatgggatgcctcagaagcagaatcactccaatcccaggcacctactccacccaggtatcgtgactattcttctaaggttgttactcgtacaccattagtgtacccagctaccatggtagaaaagccagcttctaagaaaaaccctcatggacagatggcttatgaatggcaaactattcagctgaaggatcttaagactattaaagaatcagtggtctcatatggtatccatagcccataagtaaaacagctattacattcatgggcaacctttaacaaggtgacacccacagattgggaatgattggtagcagctgtacttgagaattcatgccaaatccaatggaaggcattgctgagggaagaggtgaagctccttgagcatcagggaataaaggaaggttttgaagcccctctatataaaattcttggtgagggtatttatgctaacccagaggctcaggctgaatataatgacgatatactgtccctatgcaggaaagcagcattaaatgcctgggataaggttgctgagccaggagaatgcctagaagcttataccagaatagaacagggacctacagaacagttccaggacttatttggaaggttaactagggcagtagaattacaggtaacagatccagaaataagacaattaattatacatacaatagcttatgaaaatgcaagcccaatatacaaaagaatacttttgcctttaaagatcagatcagctccgctagaagaatgggttttgtatgcagccaacattgactataatctgcaagacactagagcttgggaaggagaagccatttcaaaaggtttaaaaggcaacaggaaattaaatgttctagaagtgaggatgcaaaggcttgggaaggagaagcaccttacagaggtcaaaataggtaccaagaggctagaggttactactactatgaaccttgtgtaggaggagccttcccctggagaccacaaaggtgccaggaacctagatgtttcaactgtggtaaaatgggacatactaagaaaaattgtagacaagcgaaatctttgtttttgttttgttttgttttgtttttttccaagcggctagaggttactactactatgaaccagaaccttgggtaggaagagccttcccctggagaaaatgaagggatcaggaacctagatgtttcaactgtggtaaaatgggacatactaagagaaattgtagacaaacgaattcttacaattcctcatgtggaaggccactgccttctggattgtgtagaagatgaggtaagggcagacactagaccagggacatgcaaggaaacccgttaaggctgggaatccccgaggggtgcctcaagaagtcccccacatcgagaaaggtccagtcgttcccagtagcagtggaagacaatctgtcacaggatgaatagatagttctttgcctattgtgaaaaataatacggctctagatggtagtttgaagagtgatgaagaatcaaatgtgaatggacaaaatgagaaacgcatattttggtaaaattctattaatggtttgtcaagcttctattaataataaaaggactcagttgaatgtgaaaattaataataaagttattactttcttgggcagatgtaactatcattaccccaaagtcttggcctcagaaatggcctcttagagaggcaaatgtacaatttttaggaattggaactctatctagagtgttaacctggtggtctgcattggaccggaagtacagaaagggatactgaaaccatatgtggcagatatacctataaatctctggggtcgtgatctcttatggtaatggaatactcagattaatattcttccaatgttggatacaaattatatataatctttagatagtagaaaagagctggtaagacactatggaaaacgtttactgtacagaaactaaataaaaatgatggaccttcagaggaaccaaaggccctgccattgaagtagcttacagatgaaccagtttgggtaggacaatggcctatgacctctgaggagctagaggctttagaaaagttagtacagaaacaactagaggctggacatatagaggaatctaccagtccctggaattctcctgtatttgttatcaaaaagaagtcaggtaagtggagaatgctgacagacctgagaaccataaataaggtaattcaaccaatgggctctctgcaacctggaatgccattaccttccttaatacctaaagtatggcctgtcacagtcattgatctaaaagactgttttttcacaatgccattacaggaaaataatagagaaaaaattgcatttactgtaccaactcttaataattcacagccagttaggagatatcagtggagagttttgccacaagaaatgctaaatagtcctactttgtgtcagccctttgtacagaaacctttggaaataattcttaagaaattttcacaatctcttgtttaaccattaaatggatgacatttttttatcagattctaataaggaaactttggaatgtatgtttgaaatggtgaaggaagttcggcctcgttgggggttacagattgccccagaaaagatacaaagaggagattctattaactatttaggttacaagatagacttacaaagactcagaactcaaaagttacaaattaggagagatcgttatcaaactcttaattctctacagaaattattaggggaaatttctcaattacagacgattattggtgtagaaggacatgactgtaacgcatttaaaaatggcccttaaaggtgataaggacctaaacagtccgagaacagtatatatatacaattaatgaaaaaaagaaagctgtgaattttatggagagaaagatttagcacatgtctcatattttggagggttggggaggaggatagggaaggaggacatgatgtaaatatatttatctaaagatactaaaattttaaaagtagatactagtccctaaactgtcatatgatgtacctgtgaaaacgtagactgcaggccttaattgtttctatgtaggcccagtactcaaccaaagaatctgcaatttttgttattccatgatgctaatgcagctagtctgtggcccacccttttacttatgtaaagttctatgtaattgccttttattctttttttgttgttctctattctttcttcatagtttttctaaatgccagaaagcaagggagattttcctataaaattctagttcctttatttaaaaaatattctgtgactaccactatggcattagaactcaaatgtctaggggctagtgagctggctcagtctataaaatactcaaagttttggggagtttaacttagatgtccagttttgtttaattgatggacatggccccaggcttgtaatcccaggactcaggagctagagagctgatccctgggtaaattgactatgtctactagctgaatagggtgagcattgggtttatgcatgtctcaatacatttggtaggacaatcaaggaagactatgtgaacttctggtctccattcgtacattcatatgaatatgcagagtgaacctcatagatgtgtgctcatatacattaaactcatgtacacatatacatattcaaattcatgcaaaataaccccaaaataaacaaaaaatacaaatatccagcttgtgccaatggattcaaaagtaataccacatttttttgcagctagatggaaagttctctcttatttacagaggtaagacagtttgttttatttacccttttgcatgcaaaaaaaaaaaaacctcttttaaatctctcttcaactctgagtttcaaattcaggtgtcaatgtttaccatttctggcaattagactcttgatttgggtgctttatctaattcacaaataatgaattgggtatttttgatgtttttatttaaattagaaaaaaattatatatgaatcccacccagttccctcttcctcccattctatcatgcccctctctgaccccaatcccatccctcttcttctccatagaaaaggtgaagccttgagagtttgtttggaggttatagaaggggagtgcagctactcatatactattgatggaagactggtccctagcagaggccttaccctctccgaagagcagaagggaggtggggggaggagtgaggcgagttggaggagaggaggtagggggaactgagattggaatgtaaaaaagaattaataaaaaagaaacacaaacaaaacaaggtgaggccttccatgggagatcattaaagtctgtcacatcatttggggcagggcataggctctcccccatgtgtctaggctgagagagtagccctctatggggaatgagttcccaatgtccatttgtgcactagtgataaatgctgttccactaccagaggccccatggactgcccaggcctcctaaatcacacccgatattctgggggccaagttctgtcctatgctggtttctgagttgtcactctggggttcatgagctcccctttttttcaggtcagttgtttctttgggtttcctcagcctggtcttgacccctttgctcatcattcctccctctatgaaactggatttgggtatttttaatccattgtataaagcagaggtctttgaatatttatggtactggggtggagaaaaaaaatgactggatttaaatgaaatctgagatccctggctagaaagcaaatgatgaaacactgcacccaaattatctagattccaatgctctgtgaagaggaattctttaacaaataaaatttacagtcatagggcagaactgaaatgagaggtgaccccatggactagtcagtgccacctaactctggagattcaagtgctgctttcttaataatcaagcactgtcattgcatttaacttatttttcttaaacagaagttacacaaatatgagtgttcttccctttgtttacttcagtgggtgtggtcctttgcagttgtgatgatgttgagtttgagccaatcttgccctctgttcatatgacagtgatatgaagatgcagtcctacactttgtgacttccaaggaatcaccctcttccatagggtaatgagcagctaatacaagctctgcccctagtttatatttataacatcaacaaaaacattttcttgatgattccttggggcaccaggaaatttacaacatgatatccactacaaagatttcatgaaggaaacaacaaaattgaagtgaaaaaaggtgcaataaaatgaaataatgaaatgaacaaggaacaaacatagaaacttatcttggtcttctgctaagattatggtaagatggaggcaaggtctccagaagtcttcatagtgaatcaacccctagtgtctcagttatagcaaacttggcagtataaataaaagctggaaataaggatctcatatcaaaaggaaaaaaaaagttttactttctttaaaagtgcttaagcatgtgaagaagagaaacaatattgggacagcatataaaaggcacattcattaaaagttaatggtgtaggatacagataatgagaaatagaaatggaattcatagagacatattatctttgcagtgcgtggcaaaatataatgtataatcaacattactgcagagttccaagggctatttttataccagggcctttagaatccaaacacattaaagattcatgatccccaaaccatgtgttttccacagttagaagcatttatgtcaagtgagcaaactgtttgctaactgaaacactagctttccccattgtaatagatagcatcgctttgcctgactcattcatcctgtaagcataaggtgaatccgtgtgactggatgctctttttttttttcttaaacccacaaatttattgctattctctaaagttaagtcttctcagtttccagtccccacaaccatagtgaccatggctctgttctctgtctgtcatggattcccacagtcctcatgactgtggtgagcatggctctgttctctacctgccatgagctctcactgtatgttcatttttgacacatcactgatttgttccttggccatcccttccctgactacttctattacttggcccttgaacgttgaagatgtaatactctctgtgagtcctcctagttggttacatctgtgtcttgtattctttcttgtgacaggtgggtcatgtattagttcccatccccagggctcacttttactcatgttcattctcttaacaaatatgacattttttatggctgtctctaacatgccaagcaaaaatgatcacttccaaagaatgtaggatatactcagtgattaatttcaatgattagatattaataaaagaagcaaacacataaatatagaagtcagtctgtggccagtgtcacagagcagaggtatgttgtggtaagagctcatagatcttattgggacagacagcaaacgtttatggggaagttcatgttgttgttttcatctgttatttggatgacctgtacatgattttatttttaaattttttaaaacattttatttatttattatatacatgacattctgcttccatgtatatctgcacaccagaagagggcaccagatctcataacagatggttgtgagccaccatgcggttgctgggaattgaaccagaagtacagccagtgctcttaacctctgagccatctctccacccccacatgattttatttgttaataacttgcatcatgtttgaaatgaaactgtcatttcctgatggccagtgtacccaggaattttagatgggtgaaatttcagcattccatccctcctacagctcatcaaacaaatgctgcattttgttctttttttttcctttttttatatttgagttacaaacacgattgaattacatgacaatcccagttcccttctccctcccctcctcccctaccaccccccaactaaaaccctaccaatcacatatcctttcttctaatctatacctgtctcaacctttctgctccctcatgacctctacatccttcttcttcttcccttctcattctcatagctccctccgccctcttcgcatgatgtcaatttgctcaggggatcatgacccttttggatgctctttttaaagtgagaaaagttcataactagctatacctcaaagaaaaatcaaataagtgtatggggcatggaggaaaaacagaggaggaaggaaggtggcagaatatagaacttctcaagcaattttgggaatctggctgggggagtatctagatcaagttaattgacatacaaaaataccacccaaaatgtggacagcaccattctcttgacaatgtccccagaatatttttaaaaagagaaaaacaatctcttcctgagtgtggatgcaatggaacaagttgcctcacattcttgataccttatcttctctgccccgctcagactatgagacaaactcatgctcttcttcttttcagtggcttctgtcaggtttttgccacagcaatgagaagaggggccaattcagatactatagagactggagaactataatgctttttaatgcaattttacaggagaaggactttggagatcaaagtgttgtatattttctcagagttggtaatcatcacactccattcttctcctgagctgtctgatgtgggtgctgagaactgaaatctagttgcctgcaagaacagtacaatgttaaaccacagagctatgtctgtagctcttggcttttcacttctaataagtgagatgtaaagatgagttagaaatgaaaaatgatggatgatattaccaccgagttttacggatgtaatacagcagcttcagtagagtactgttgtgtttccagacctctctaccacttatacttcccaccctaaccttacatgctcttccagtttggatcaagtttggaacttctatggtattcttcactccttcaatatgtaggataaaattagcattctcctctctcacaattcttttatttatgtatatgtgtgtatgcctgtatgagtgtagcctgcatgggtagggtactcaaaagggtcagaagaaaggattagatgccccccctggatctgacgttgtaaaggtcataagatggctgacattggtgctggaatccactctgtgttctcagcgagagcagttaagtgttcttaactcttgggcaaactctttagctgctagacagcatattttcaattctaattatggccatctcattttaccggacaaattaatatttaagtttgatatatttaatatatgattccattttcaaaactgcaataactagcatttatgaaataacagacttattttgttaaaaattttaggagcatattacttttgacttaatttctacattagaccacaataaatcatttcaaatgaagtaaaaagtgtagttacttaatctgatttacaataaaactgaagctttaaggaattagtttaagcataaataggccattttgcatttaaattcaggaaattttatttcacttgtgtctatatagtagatgtcattctgtttgacccttacacaaaaagcaagttgaatttgagcagttagtttattttcctcttgttatgtttctttgccctttcattatatgactgattatccatccatatacaagaaaaaggttcttattgttttcttaaaggaggtaggtaaacctgtggccatttttactttgggtattattttctataggacaatgccacgtatatttgtggtcaaagtggtttcaactaattacagtacatagcttatttttattgtcatgatcacatatgtatcatgtgtttagttcagtttgaattccctggaaataattgagatgaacagttttgggcagtatgttgattgttatatttgcaggtgatacactaataaagggcagaggaagacaggaattgagcttagaggaaatattcattatatctgaaaattagttctcaacaactccagaagagaagaatagttctgcagatgattgaactgtccataacaggcctgagttttacgtgctcttaacttactttccagaatctgtctctgaatatggttgatactgaaaaattttctaggaaggttgtcaactgtgagatcccaccaccaatgtttagaaaagaaaaatgtgtgaagaagtgattaaccttaaaagtggattcttggtggtttagtgcatttgacacatgctaaaagaaaaaaaatctatctaaaaggatgataaagttctcaataagtatggctaagaaatggagacaagaccttggaagacttggtttttcagttcaccttcattctgcaccttttgttccatggtaactaactcttatgggtgaaagcaaaagtaagaatcttctacagttgaatgattaggaagtttgggtttcacaaacatgtaattttagttctttctcctccatagaggtgatatgatctagaagttgagaaatttataattcttgactaatgtacatcttggttttaattagaattattagcattactatgactattaatagaaaagtgaacaaaataatgctgaaaataccagagggagaagagtaggtagattttaaaatgttatgaaactgtcaaaatattgaataattttttagtgtttctattacaaatttatgggcaaaccagaaattttcactattcctcttcattctgtcagaaagctgaagatcagaagaatttaatcacttaacttgactctcagattacttaggaatttggtaaatgatgcctaaatcattctaaatttcagtgaggtatacatctgtcagtcatctgctacagtcaaagaaataaagatttcaagctcagaagttttcaggacttcttctttttttctttcaggacttcttatacaattcatatctgaagtttatatcactaccttggtccataagtagtattccctctggtaccaatcattttgctagtatgagttaagatctgatgtctgttatttgcatatttttacagcatccaggaaattgaggtaaaattcctgatttttgagagttcttggggaaataatcaaatataataaaataaaagggataaaaatattcaatatcaatatatatgaagcagaaataacaatataaaacaactacattcttttctttgttctcttattgtgactttactgattagtatttgttctttacatccataacatacaaccagaagcataacctacattgtaatttggtatatttatttgttaaaaaacatattcagaatttttatacagtgatacttatctgcatttgttttcctttagttcatttttcttatattgtctttggttttatggtaatatgactgtcataaaatgaggcagaattcattcttctctacctttttgaaagattataggtaggatggatattgttttctacttaaataacaaagaaaattgacatgagaagttacatgaaaatgttatcatgtgtaaatttccaattacaaagtcatatttcaattgatcaaatctaataatttttatgtttttcttggacatcctgtaggcaatacctgaaatcatgctttattatattctttacaagcctgaattgatatatttcttgtagtgcaattctcatagtaacttaattaaaagtattggtattgtctattattcccctttcatcatgagaatggaaattttattgtttttattattttttaaatttttattttatttttatacatgtaattagaccaatttaaattagaaacaagcttcttttgcatgtctatcccagttccctcctcccctgccccaccccactccctatcccaaaccctttctgctccccaggaagggtgaggcctcccatgggagattttcaaagtctgtcaaatcatttggagcagggcctagacccactcccttgtgtctaggctgagagagtatccctttatgtgaagtgggcttctgaagtcccttcatgtactagggataaataccaatccactaccagaagcctcatagattgcctagacctccaaactggcatccttgttcagggagtctggatcagtcctatcctggtttaccacctatcagtctggggttcaagagcaacccattttccaggtcagctgtttctgtgggtttctccagcctggtcttggcccagttgctcatcactcatccctctctgcaactggattccagagttcagttcagtgtgtagctgtgggtgtctgcttctgcttccaccagctactggataaagggtctaagatggtatataaggtagtcatcaatctcattatgtgagaaaagcatttaaggtagtctctgaactattgcttagattgttagttggggtcaattctgtagatatctggacatttccctagtaccaaaattctctttaaagctataatgtctccctcagacatgtcaggatggtttcttctagttccatccattttcctgtgaacttcaagattacattgtgtaaatgtacaacattttctccacccatccttcagttgaggggcatctaggttgtgtctaggttctggctattacaaataatgcagctatgaacatagttgaacagatgtccttgttgtatgaatgtgctcctttgcgtatatgcttaagagtggaattgcttgatcttgtgatagactgattgcccttctcccaaggaatctccatactgatttccaaagtggctgtaccagttggcactcccaccagcagtgggggagtattcgcctctctccacatcctctccagcataagctgtcaatgatatttttgattttagccattctgacaggagcaagatggtttctcagagttgttttgatttgcatttacctgatgactaaggatgttgtgcactttcttatgtgtcttttatccatcttagattcctcctttgagaattctctttttagttctgttccccactttttaattggattacttggtgttttagtgactagcttcttgagttctttgtatattttgaaaatcagtagttcataatttgactgattctgacctgggtgttatggcacattcctttattcttagccctcaggaggcagaggcaggtagaactgtgagataaacatgttgtacacaacaattttccaggatagataatgctacacagaagctctgtctcaaaataataataattgtaaataataataatgataataatctgactcttgtattttaatgtttcttcttttccttccctgttatatgttcttaacctaagcttttactcatttatttagaaaggagggtcttatgctcttgtctaggtttacacagaactaactacatagttcaggcttatatttataatgctctccctgccccatcttcccaggaaaggggtttgcagcaataagacatctcatctggcaatttattcaaccttttacttcttttttcctactttatgtttaatttcttcaattataaagtgaaactgctattttagaatttatgtattttggaaacaatgcatgataatattctcttaacactactatgatgaagatgttctgaatcaaagctatgttgaactatgtgatcattagtcatagcaaactaattatcaaatgtgaaagattataatgaaaacttcttataatggtaagtgtgaactcattgtatatgagttacatggtaatccagatactaaagtaataaacattgcttggagttcttatgtggtacttagacttcagcttcaaatgcaagtatgtagaaagacagaagtgaagatctcaaatgcctttggaaaatgatactctgaggtaaaacaacagtgatagcctataacatgcttggtttgtgtttgagttgcagtgtgttttctggatctttgaattcatagctccctaatgtttgaaaagtttctctccattttcaaccatatataatgtttgtaattactttttcacctttattgagaacaacacttgtatctatattagggtatttgaagttctgcttagctgtgagcattgttttaattactttgttgaagaaatacttattaattttccttttgtttgcttttgaatagcttttgtctgtttttcaaatttactgattttttccagattgtataatctgctttcacctatcaagagtgcacatgtcagtttatatattgttactcattttaaatatttaaatttagcttgtttatacttccattatgtctttggagttttctgaatacaattgatgcctttgtggcaattgtttaaatgtgtttgggagatggatataacattgtgtcattgtacaatctctattgattgagtttcctcttttctcaagttcctttatttgcaggatttctttgattatagtaaacactgtactttttaaattaatgccaagctatttatagtattacatcctttgatctacaatataaagaacttttgttatttattaaatgaagacagaggctgctttagttgaaaataatttatctctattactaaggcaagacttctctaagtgttgcattccaagaatttactgaatttatgtattctttattcttgttagtaaggataggcactgttcatgaccagcaggtatgttgccatcttagaattctcagagactcagtccttcacagtgccttcctgaatctgccagaaacactgagagttgatttttctaatattgttcaatctttgtttgtgaacatttattattttagaagataattccaactacgagatttcaatctcatacaatgggatgaagatagaagtaaatgggttaaagggaaaaaagatcagttgatcattgatggatattgactggataaataatgatgctggtgagagtgaaatgtcatatgaactacaatcaaagggtctttttgtcagtgtggtatattgggttcagaagtaaacactctgcagataatgatatataatgtataattgatactggtgattaaagcagtggcaaatcatattaaggattagtaatatatgcaatgggagagttgcagtttaggcaggttaaaatggagcagtcaagttgctcaaatgtagctggaatgaggttcaggtcacaatgccagatttttcttgggcgacatgcaaggttcttgatggcaagaaacctgctggaagacacacattaacaaccttcaaaggaggaataattagaatttattaaacatggtaaactatataataaacttatgttgatgttagcagaagaaaaaaaaactcctatcttcataccaaacctgaatcatacttatgagacacttgtgacacatctagtgatatgcatggcattggctagaaggctcttaaggatgaagggattatctatgaatatgtactatttttagcttgttattgacgttgggattagattattttgtaattctgttaggataaaccagaaaatgtaaattatatatatgatactcttgaaaataaatcttggctaaaattggtaaaaatgatttctgacaccaagtaaatacaatccagaaattctggattcatcacagtgatgaatgctgtgaacatgttagtcatcttatttgtattctttgtcctaactaaatacacgtgattctgtgattctctttaaagtaatcgcattattgtataccaattattataaatgtttaaatatgtttacaatttaactttctctaaaaggcaaagagtttacattttacataggagacagaattatttttaacttgggaaatgtatataaaatatgacatccacatatgaaaacccagaaggctgagtaattacaggaacatcttccaagtcattgtttatagcagcaatttatttaatttgtacttccaaaatcaaagctttgcatcattaaacttcagaattagcatagaaatagatacttgttgtgaaagtataaaaggatgtttaagaaccatcacaaggtctaacactgtcattgagaaaaatgcctttacatcaaaatagaaaacattggaagttaaagtcccataagacaagagcctatatttatacaaaattttatatatgattatctatttatctatatgtgtataaagctttaataagcatatgtacatatatgtgtacatatatcataaatgtgtatatatgcatatacatatatgcatgtctaccggtatgattgcatacatgtgcaaatgtgtacacatatttacatatctaatatatatatatttatatatataaagcatatgggtatatttatatactgcatacatatatgattgtatatatatatatgtctatatgtttgtatatatttataaagatattgtatgtatgtgatctcagaataatattacacctattcactagtctttgagtagaatatacagatgttgtccaatatcagaagcactggatatttcattagtattaattcctaatttacagcagtacattttctttaatcatcaatgaaataagtgttttctaatcagtgatctctattaatgttgtatacatatttaattagtttggaatttgtatcatatcaggaaatttatattgaagaatgattgcaatggtaatgaggtattttaatggcatgagacattgggatgatgcgtactcagcaagctgaagatcaaagcccttgatattttgaatgaacagagattcataagacagttagtaatgtaagcttctgcgagaaagctctctgattctaagaagagaagagctgcctagttttatactagattatggattcacactctattcatttcaacaatgattttggaatttctatggtttgctaagttaatatttctgatattttgttgcttcctgtctctactttgatctaattttcatccagagttttctacacccagatactcactatgcatatgtaattattggaacagaaatataacaaaaggaaagcaaaacatctaattaatgttaaaatcagtttcaacccagtttttttcttgatgattttcttatttattctctctcctttttctctctctcctcatgttttttttcacagcttttatatacgaacagaatcttccagaaagtacaagagtcaaaacggttgcattccatttgttaagtgaatgattataggtaaaaacacgtttttcatctccatcacatgagtaagcattttatgtattacaggtgataaacaaattattccaagaacacacatacattcatacccaagcaacttgttatagatttactgtgtggggaagtaagttgtttttatcaggtctttaactggcaggctgcattttgcagttactaacaaagggccaattacttgattacttatcttgaaacataatctttttaaattttttattatttttgattactcatatttagatttccatccccccatttcctaacactaccctcctccgatgttcttcacccaaaccacctccgactcatctccagggatagtgagaccctctaccaaggaccttcaaagtctgtcatattgtttgggagaggctctagaccctccttgctgtatctgggctgcaatagtatcacttcatagggaatgggctcccaaagtccatttgtgatctagggataaagactggctccattgtgagaggagccatagactttcttgggctcctagctggtacccacattcaaagactttggtttggtccaatgctgcttccccagctttatgactaggatctccgttctatcaataggtcagatccactgtttctgcaggtctctccatccccgtcttggtacctttgctcaatccttctccctcaccacaactgaattccagtaacatggttcagtacttttctatgggtatctgttcctgctttgaaccgcaaatggatgaagaatctccttcctctctctaccccctgcctccaatttggtcagggattcttatcccatcctcttcttcgaggaattaggcaatcttcccttggattcctccttgtttcctagctcctcggcaatgttgaatgtaggctagtgatcctttatgtataaaaatcaaaaatgagtgagtacataccatgtttatcattttgtgattgagttacctcactgaggatggtttcttctagttccatccatttgcctgtggatttaaagattccattgtttttttttcctgctgagtagtactccattgtgtaaatataacaaatttactcaatccattcttcagttgaggggcatctaggttgtttccaggttctggctattacaaacaatgctgctatgaacattgttgaacatatgtccttgttgtatggaagtgcattatttgggtatatgcccaagagagggattgctggatcttaaggtaaactgattcccatttttctgagaaactgccatactgctttccaatgtagctctacaagtttgcactcccaaaagcaatggaggagagttcctctttctccatatcctctccagcatatactgtcattggtgttattgattttagacatagtgacaggagtaagatagtatctcagaatggttttgagttgcattttcctgatgacaaaggatgttgagcacattcttaagtatttttcagccatcttagattcctctgttgagaattttctatttagttctgcattctactttttaattgcagtgattggtgttttgctggctaacttcttaagtattcttgtatattttggatatcagccctctgtcatatgtggggttggtaaagatcttttcacattctgtgggctggcattctgtcttgctgactgtgtcctttgctttacagatgtttcccagtttcaggaggaaggtcccatttattaattgtcgatctcaatgtttgagctattggtgttacattcagaaagctgtctcctgtaccgatttgttcaagggtgccacctaccttctcttctaggagcttcagtgtagctgaaattatgttgagttctttgacccatttggatttaagtttagtgcatggtgatagatatggatcaatctgcaatcttctacatgtctgaatccagttacaccagcaccatttgttgaagatgctttctctcttccagtgtataaacttagcttccttgacaaaaatcagatgttcataggtgtgtgggttaatatccgggttttcaatttgattccattggtccagctgtctatttttgtgccaataccaagctgttttcaggactatggctttataatagagcttgcagtcagggatggtgatgcctccagaagttccttgattgtacaggattgttttggctatcctgggttttttgtttttccatatgaagttgagtattgttctttcacgttctgtgaagaattgttttgggattatgatgggaattgcattgaatctgtagattgcttttgacaagattgctatttttattctgttgatcctatctatcttagagcatgggagatctttccattttctggtatcttctttaatttctttctttaaagactcaaagttcttagtgtacagatctttctcatttttggttagtgttaccccaagatattttatgttgttatttgctattgtaaagggtgacgattctctgatttttttctcagcacattcatcttctgtatatagcagggctactgattatttagttaatcttgtatcctgccactttgttgaaggtgtttatcagctgtaggagttccctggtagagtttttcccgggtcgcttatataaacaatcttatcatctgcaaatagtgaaagtttgacttcttcctttccaatttgtatcctcttgatctgcttttgttgtcttattgctctagctaggacttcaagtacaatattgaagagaaaaggagagagtggacagccttgtcttgttcctgattttagaggaatatccttgagtttctctccatttagtttgatgttggctgttggcttgctgtatattgcttttatcatgtttaggtaggttcctgttattcctgatctctccaagtcctgtaccgtaaagggatgttggattttgtagaaggctttttcagcatctagcgaaatgatcatatggttttcctttttcagtttgtgtatattgtggattacatagatggattttcatatgttgaaccatccctacattcctggggtaaaaccaaattgatcatggtggatgatttctctgatgaatttttggattcattttgccagtattttgtcaaatatatttgtgttgatgttcatgagggatattgtaattctctttttttcaatttgtctttttgtggctttgataccaatgtaattgtagcctcataaaaagagcttggcaatgccccttctgttgctattttgtggaacaattttgtggccctgtacagcaactaggttgtagtaaccttaaagatcatttgtgactaccaatcaggacatggtggctgattcactactctggctccccgtattttattagaaataagcttcttttctatggcaaacccattttcttctccctgccttcctgccatgctcctcagggagagtgaggatttccatgggggaagtcaaatctgtcatatcatttggagcagtgcctagaacctcccccatgtgtctaggctgagagaatactgatccactactagaagccccatacattggccagacctacaaacttacatactcactcaggtggtctagatcagtcctatgctagtctccaagctatcattctggggtccaagaacaaccatttgttcagattagctgtcattgtggttttttccagtctggtcctgacccttttgctcatcactcctccctctctgcaactggattccagagtacagctcagtgtttacctgtgggtatccacctctgcttccatcagctactggatgaaggctctaggatagcatataagatagtaatcaatctcattatcaaagaaggccatttaatgtagcctgtcaaccactgcttagattgttaggtggggacaaactcatagatatttgaacatttccctagtgccagaattctctttgaacctataatggctccctctattatggtatctcttttcttgttctcctcaattcttcccctgactaaattatcctgctctctcacgtctgcctatctcattctcttctcccactctctttcttctagatgcttctccccttccccatactcccaattagttcaggagatcttgtcctcttccccttttctgggggaccatgcatgtctctcttagtgtcctccatgtttccgaacttctttggtggtatggattgcaagctggtactcctttgctctatgtctaaaatccacatatgagtgagtacataccatttttgtctggttttgactgggttacctcactcaggatggtttcgtctagttccatccattttcctgtgaacttcaagattccattctttttttcccccactgagtaaatgtgtaaatgtgccacattttctccatccattctttatttgaggggcatgtaaggttgcttccaagttctggatattacaaataatgcttatatgaacatggtttagaagatgtcctccttgtaagaatgtgcatcttttgggtatatgactaagagtggaattgctgggtcttgtggtagactgagtcccattttcctgaggaaacatcatgctgatttccaaagtgactgtaggagttggcactctcaccagcattggaagagtgttcccctttctacacatcctatccagcataagctgtcattggtgtttttgattttagctattctgataggagcaagatggtatcacagaggtgttttcatttgcatttccctgatgactaaggacattgagcactttcttatgtgtcttttaggcattttagattccgctattgagaattctcaaagtagttctttaccctcctttttaattagattatttggtgttttgttaactagcttcttgaattgtttgtgtattttggaaatcaggcctgtgtcagatgtggggttggttaataacttttcccattctgtgggctgccttttttgttgttgttgacagtttcttttgccttacaaatgcttctcagtttcaggaagtcccattcattaattgtcaacctcagtgtctgtgctacggatgtaatgttcaggaagatgtctcctgtaccaattcattcatgggtaccacctacttcttttctaagaggttcagtgtggctagatttatgttgatgtctttgatccatttgaacttaacttttgtgcatggtgatagatatgtatctatctgcagtcttctacacaccagcatccatttatgccagaaccatttactgaagatgctttctttttcattgtttaattttagcttctttgaaaaattcaggtttttgtaagtgtctgagttaatatagagtttttcaatttgattccattggtctacttgtctatttttgtgccaataccaagctgttttcaggactatagctctataatagaacttgaagtcagggatggtgatgcctcctgccattcctttattgtacatggttgttttggctatgctggttcatttggctttccatataatgttaaaatgattctgtcaaggtctataaaaaattgtgatggaattttcattgggattgcattgaatctgtagattgcttttggaaaccttaccatttttactatgttgctcctacacatccaagagcatgggagatctttccattttctggtatctttttaaaatttctttctttatagactcaaagttgttttgatacaggtctttcacttgtttgcttaacattactctatggtattttatgttatttgtggacattgtaaatcatgatgtttctgattttgttctcagctcatttatattctgcatatagcagggtattgtttttttaagttactcttaaaacctgccactttgctgaagatgtttatcagctgtaggagttgcctggtagagttttcaggtcacttatttaaactatcatatcatctgcaaatagtgaaagcttgacttttccttttccaatttgtatacccctgatctccttttgttgtctaattgctatatctagaacttcaagtacaatattgaagaggtatggatagagtggacaaccttccttcctgattttacaggaatcatcttgagtttccacccttttagattgatgctgcctgttggtttactatatgatgcttttattaggtttaggtatgttcctgttattactgatctctccaagagctttagaatgaattgatgttgcattttgtcatatggtttttcatcatctggtgagatgatcatgtgatttttatatggtggatggattgcattgatggattttcttatgttgaaccatccctgtgtccttgggaagaaacctacttgatcatggtggatgatttccctgatctgttcttggatttgatttgccagtattttattgagtatttttgcatcaatgttcatgagagatattggtctgtagttttctcttttagttgtatctttgtgtgacttgggtaccaaggttatgaagtctcataaaaggagtttgtcaatgacccttctgcttttttgtgcagaaaactttgaggagaattagtattgactattctttgaatttctggtagaattctgcactgaatccatcaagttctggcctttttatcttgttggaagacttttgatgactgcttgtatttcattatcagttatagatctatttaaattgcttatctgtttttgatttaacttttgtaagtgatatctatccagaaaattttccctttactttagactgtcaaatttgaagagtacaggttttcttttcttttttttaatgttctagtgacttttatttctatttgtttttgcatgtagattcattaacaggattcttaattgtaaattaattctggtagcatttctttgcaaactattatgactaattcttattatttccagcctcagaaatataatcaacaccctagatatttggtcatttgtgttaccatctgaaactcttaatttttttttcatgacaatccaatttaatagccatgaccataaacccataaaaattttaagtttaatttcaatggaattaagaaaaatttattggttatgcttccagaattatctgcattgtttaggaccatctttttatggcttttgttaaaagtttgcaataaaaggggtttagtgtctttgaagactaaattatatgtacatatttgaatatgtatttccaggtaattcaccattaagaaatattaagcttctctttatacttgcttgaaattttgttttatttttttagttatttttcatgtgaattagaaacaggattgttttacatgacaatcccagttttcttctcccacctgtccttccctacgcccccttatctaaaaccttatttgtcacacatctttcctgctccccctggatggtggggccttccatagtgtgtgataagagccttttgtatcctttgggatagggcctaggccctcacccgtgtgtcatggctgagggagtattctacatggaatgggctcccaaagtccacacctatgctaaggataaatactgggcttctacaggaggtcccatagatttctgaggtttcctcagagaaacccatattcctggagtctggatcagacccatgctggtattccagctatcagactggggagcaagagttcctgtattttcaggtcagctgtttgtttttccccagccttgtctggacctctgtgctcttcactgggccttctctgcatctgggttccaattcagatcggtgattagttatgagtgtctgcttctacttccaccagctgctggatgaaggcaaacaagtcagtcatcaatctcataatcaggggagggaaattaagcctctcctccattgctgagattgttagctgatgtcatctttgtagatctccagacatttccctagtacctgatttctctgtaaaccaaaaatgtctccctctattatgatatctccattctttttttttaaattttttttattagttcaagttagggaacaagtttgtttcacatctaaggcccttctccctctccctcccctcacccctatccctcttctcccaccctaacctaccccccaacccatccaccgaccactccccaggcagggtaggaccctcaacaggggctctgcaaagtgcaccaaatcttcctgtgctgggcctgggcccttccccatgtgtccagggccagagtgtatcccttcacttgggatgggctctaacagtcccttcttataccacggaaaaatgctaatccacttccagaggctccctggagtgcagaggcctccttatccatgttcagggggctggatcagtcttgtactggcctccaagatagcatctggggtctatgtgctcttccttgtccaggccaactgtttctgtgggtttctccaacatggtacagaccccttcgatcttcattcatccctctcttccactaaattctaaatttcagctcagtgtatttctgtggatgtctgtctctgcttccatcagccactggatgagggctctaggatggcataaagagtagtcatcagtctcattttaggggaagggcttttaggttatcctctcctccattgcctggattgtcagatcgtgtcatccttgtaggtctctggtgatctacctagttccagatctcttttcggacctatattggttccctctaatatggtatcactaatcctgctctctctcctctattcttcccccaactcaatatttctgttccnnnnnnnnnnnnnnnnnnnnnnnnnnnnnnnnnnnnnnnnnnnnnnnnnnnnnnnnnttcaggagttcatgccacttccattcctggggaccatttatcccttagagtccttcatgtttcctagtttctttggtgaagaggattataggctggtaatactttgccctatgtctaaaattcatatatgagtgagtacatagcatgtttgtcttttttgtgactgggttacctcactgaggatggtttcttctagttctatccactttcctgcgaatttcaagattccattgctttttttgctgagtagtactccattgtataaatgtaccacattttctctatccattcttcagttgagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcttaaggtgtttagcagctttaggagttccctggtagagtttttcatgtcactattgtagactatcatgtcatctacaaatagtgaaagtttgacttcttc

SEQ ID NO: 35 - DNA, 299915 bp, Cricetulus griseus
  modified_base (13250)..(13534): a, c, t, g, unknown or other
  modified_base (13911)..(14388): a, c, t, g, unknown or other
  modified_base (14737)..(14802): a, c, t, g, unknown or other
  modified_base (15246)..(15845): a, c, t, g, unknown or other
  modified_base (16787)..(17421): a, c, t, g, unknown or other
  modified_base (18086)..(18095): a, c, t, g, unknown or other
  modified_base (21804)..(21813): a, c, t, g, unknown or other
  modified_base (26981)..(28006): a, c, t, g, unknown or other
  modified_base (28248)..(28369): a, c, t, g, unknown or other
  modified_base (31491)..(31713): a, c, t, g, unknown or other
  modified_base (56827)..(57662): a, c, t, g, unknown or other
  modified_base (57859)..(59029): a, c, t, g, unknown or other
  modified_base (151817)..(151913): a, c, t, g, unknown or other
  modified_base (152822)..(152840): a, c, t, g, unknown or other
  modified_base (157086)..(157160): a, c, t, g, unknown or other
  modified_base (157291)..(157378): a, c, t, g, unknown or other
  modified_base (161790)..(161817): a, c, t, g, unknown or other
  modified_base (175685)..(175697): a, c, t, g, unknown or other
  modified_base (199034)..(200558): a, c, t, g, unknown or other
  modified_base (219251)..(220607): a, c, t, g, unknown or other
  modified_base (228162)..(228171): a, c, t, g, unknown or other
  modified_base (228773)..(229720): a, c, t, g, unknown or other
  modified_base (243173)..(243327): a, c, t, g, unknown or other
  modified_base (288565)..(288820): a, c, t, g, unknown or other
  modified_base (289272)..(289303): a, c, t, g, unknown or other
  modified_base (289625)..(290055): a, c, t, g, unknown or other
  modified_base (290441)..(290553): a, c, t, g, unknown or other
  modified_base (290691)..(290700): a, c, t, g, unknown or other
  modified_base (290963)..(291039): a, c, t, g, unknown or other
  modified_base (291549)..(291611): a, c, t, g, unknown or other
  modified_base (292019)..(292222): a, c, t, g, unknown or other
cggtcatcaggaaccatggaacctgcaatctacagccacactgccctggatgcacccaatctcatttgatctcagaagttaagcggagtcaggcctggttagcccttggatgagaaaattctcttttttctgattgaaaacataaattttactgatggacctccatccttcctaaagcactggcattgcatctgcagaatagggtctgtcaatccactgacagcttgggattagcaattctttattgtggtacttgctataagcactgaagaatgtctatcagtgttcaggcttcggtatccacaggccaatagccctgtccaggtagccttaagcaagttacctgaattcccagagtctcagttttctgataatacaatattcatcccctggatgactgtggagatttaaaaataagatataaaaatcgattagcatagtgtcaccaggtagtatgcacagaatccatcttagctgcttttcatttgggtttgagtagtatacattacagaattgagctaaaatattttcatgtctttcttggccagtttcccaaatcagagtcctctttcaaatttcatttaaggtaaaacacaaattcagtggcattttatagctatcctagcaatatttattcctaaaataagaaaaaccaggaaggatgacccagagaagagagattgatactgtaatgagtattgttccattttagtgtataataccctactcttgcacccaatctcatttgatctcagaagttaagtggagccaggcctggttagcccttggatgagaaaattctcttctttctgattgaagacataaattttactgatggacctccatccttcctaaagcactggcattgcatctgcagaatagggtctgtcaatccactgacagcttgggattagcaattctttattgtggtacttgctataagcactgaagaatgtctatcagtgttcaggcttcggtatccacaggccaatagccctgtccaggtagccttaagcaagttacctgaattcccagagtctcagttttctgataatacaatattcatcccctggatgactgtggagatttaaaaataagatataaaaatcgattagcatagtgtcaccaggtagtgtgcacagaatccatcttagctgcttttcatttgggtttgagtagtatacattacagaattgagctaaaatattttcatgtctttcttggccagtttcccaaatcagagtcctctttcaaatttcatttaaggtaaaacacaaattcagtggcattttatagctatcctagcaatatttattcctaaaataagaaaaaccaggaaggatgacccagagaagagagattgatactgtaatgagtattgttccattttagtgtataataccctactcaagattggaaagatgggacagcagtctaagtaaatgaagaagactgacagttttcctaaaatgatttgtgtgggggcttgcacacatgtgtgactactcatgaatgcaggtgtggaaagtggaggtcagtgttggatgcctgtagggagagacccctacacacctgtggcgctgaccacacctgtttgggtgtggccacaggtatgtaaggggcatgtgggataaagtttagaaaagagggggcacttcgctctctcactggttctggtcaggtttggagagctgttgagtcaaacctgggtcttcggatcctcacgtaagtgacttacccttagtaaattaaccatctatatccgtattccgtgtatggttattttcctctacaggtgcctaccttttttctctccaccttactttattaaaaatgctttttattgaaataaaataacattttcccactctttttcctccctcctgcccttcccagttattctctctttagcctctcccatatccccccacgctcaagcagatagtctctctttgattatgtttgttacatgtacacacacacacacacacacacacacacacacacacactgattcaggtagactggatggctagtgatcccagggatcctcctgtctctggatccctggaattgcaagcgcaaactgccatgcctggctttttacatgggtgttggagataaaaacccaggtccttgcttgtaaagcaaacactaacccactgaggccctaaaatgaacctgtacagaccattctccttagacagaatcttaaaagaatactgtacttcttttgcattcaataacaaagaatatcagaactctgtagtttaaagtgtatacctaaaattttagttgttctaaaagatagtgtattctgaggccagtggtaaggctcagcagttaaggacacatggagcaaggtttgagtctcatcccccacatggtagctcataattatctagaactccagctccaggaaatctgaaaccctcttcaagtctccagtgtgcatcagatacatacatggtacacacacatacatccaggcaaaacacttatgcatacagaaataaatatatttttaaagtgtattcctaaagctttcgttgggctaaaccaaggacaagttgttgcccttaaagagtgaatctctgagtgtttgtgcttttgagtagatcaggttttctctcttccttcttcatcatctctcatcccccacacaaaacctggagtcactgaggttgtgagttattttttttctcttaaggtatatcaacacacaaaggagaaatgcccaactagagtaaataatttgatagactgtcttggataaaatattaattttcagtacctgataaatgaatgatggcagtggtttataatgtgattggagcattacttagataaaagaataaagaagggtatgtaagtctctggtgatgataaatggcagcctatcaacttagaagaatccatccaggaacacaacaaaaagatcagtattaagtcacagcatagggtctagcaagaactgaacgtttgtttctttcagtttgtattaaaattgtaagcctcaagatgaccacatcatctttgggaggtaataaagttccagtttatgccactgtgggattagtgcccccaaactgaggtcccacagggcttcttcaccactgccatcatatgaggctacagtgagagaaagttattaaggaaataggtccatagataccaagtctattggcacctcaacctttggtttccaggcttctgcaactgtgagaagtaaatttctgggttttttggttgtttatttggttgattggtttggtctttttttttcttgttgttgttggtagttgatggtgatggtggtggtggtactaggaactattgaacgtaagacctgcatcttcaagacaagctatatgtctagcccatatttttgctggttttttagaggtagtttgaagtattttgtcatcatgaatagagcaagaaatgatcttaacaatacatattgcaaatgtcatcattctaaacacttatgcttattcccacagagaaacttattttggagaggtcaaagaccattacagagatccacattagtcataatgctaagatcaaatgacaatgggtttcccattcccagctcacacatgtatggatcaaggacatatatataaaaggggacaaaggattgtcatagccaaagccctcagacacttattgtgagataatttcctctataaaaagaaagaggacatgaaatgaggtggacatagaggacggagtagatctggaaagaggtagggactgaatgtgatcaaaatatgttgtgtgaaattctcaaaaactgataaaatattatattatttaaaactttaagagacattgactggctaggtactaggaacagaagaacagataaggatatggagtaaatgggtttgtgaaaaatagcaatattaagaaataaagaatgtcaaaacgggaagatgaagtctaatatatttggaaataagttcattttcaaacccctatatttaattccatcccattaataattcagcacagctgggaaaagcatttggatgagagtagtacttaaagagatttaaatatgatcatgatgaagccaaaaaaaaggtagatatgagtttgccaagtgaacctggaaatattgctaatgtcatctgggccacagattctgccagccatggacatggagataagttatttaaacttgctttttctttgttctacggtatctgttccttgcatgaaaatcttagtcaaaaacttgaagtatattatatcagtgactgtaatggccaatcttcattgttagcttggccagtttgagaatcatatagcagacatgtctttgtgtctgtgtgggtgtttctagaggcagaataattaaggagaaagaaggaatctagctttctgtcagcattcatctctctgttcctgactgagggtgcaatgtagccagccaactcatgcttatgtcaatatgccttccctcttcttaaaccaggagccaaattaaacctgcattgcccagagttgctttttgttggtattttgttagagaaaagataagaaaggcaattaatacagtacctaagcaaagcatattatatatgcagtgaataatgaatacaaaattgaaagtgtccctttaaaacttgtccagatgctatgtcttccctcttcttaaaccaggagccaaattaaaccagcattgcccagagttgcttttggttgggtattttgttagagaaaagataagaaaggtaattaatacagtatctatgcaaagcatattatatatgcaatgaataatgaatacaaaattgaaagtgtccctttaaaacttgtccagatgtggcgattgactgaggaaagagtgccttctggacactgcagagcagctgcacatgtgaactcacagaaattgtaacagcacaccacagcctgtgaaagcccaggacatatcccaacagggagaggggagttgtcatgaagttccacacctggaaattgctattggcagttgttaagtactgggagagtgagagtaaatttctttagtgtgcaatcctcgatagactgaccacactccaatgggcagtacacactgaacttagtattgttttattttgttttgtttttctttatttttaaagagggcacaaagccaaaccagtggacagagggagtagatctaagggaggataggatagagacgaatacgctaaaaatgaatgaaattcttaaagaatatgttataatactgtattaatccaagttctctagagtaacagaacttatagaaagaatatatagatatagatatatagaaagagaaaagggatttattagaatgactaacaggctgtaatccagctaaactaacaatttctagctatgaaaatagaaggttcagtaatccagtagttgctcagtccatgaggctgggtgtctccgctggtcttcagtatatgctggaatcttgaagacataggttctcatggcgttgagggaatggacttgctagtgagggcaagagcaagcagtatgctggaatcttgtgaacgtaggttctcatggcgttgagggaatggacttgctagtgagggcaagagcaagcaggcaaagagtgaggctttcttcttccatgcactttatataggctgccagcagaaggtgggatccagattaaatgtgcgttttcctacccaaaaagatctcggttaaaggtgtaccttcacacctcaaggtttcagattagaaaaggatcttcctacttcaagtgacttaaataagcaaagttccctcgtaggtgtgcttagcccttttgggattttagttaattccagacatagacaaactgacagcaaactagccctcacaaatattaacacattaatattgcatgttatctataaatttaaatatatatgaacttatcaattcaggttaaagtattgtgttaggcacagcaatggcaaaaatcaatagtaatggaagcatgatgaatgagttcttacccattcagagatcaaatttgagttaacaaaacaggtatttccataaaatggtttgaatttatgtagcaagtaagtttaacattcttcagggacaaaagaaatgggggcagtcagtaattgtagggaaatattaagggaaagaacttacagaaagtcctttaaataaaacatagacagataaaggacacttagaaggtagattgagacttttaaggagattgagggaacagatacgtgagaagtgggtaggccacacacacacagagttcaggatgaagggcagatggaggtcagcccagacaagggaaagacaatgacaactggagagacaatctctcagacaaatagcagaaagaatgttctcatgggaaataccagaacagctcttaaaataagaacaccataattttcatagtcaaaaagggtttgcacttggaaaaaattattgatttacactgtacttctgtactttattataaagcccaattctataacttcagcaatagcagatgataaagcagcttaatacagagaaacagtagagagtagaggagaaacatgggtttaggacaaggggtgggtggatactacctctgggcaactagattttcagagccagtgtttgtgtcttctaaaaatagagaatgcttggaattatattcctaaaggatatatctccatcaaatccctcccactagcgatcagaaaacccacagaagaggatgcagaaagagtaaaagccagagggggtggaggacaccaaggaaacagggctggaaatcaatggggtctatgcacataggcactcacagagactgacgcagcatgcacaggacctacacaggtctgcaccggatgggttcctagagctttaaggaggaatggacacatgcacccatccttaacccaaaagctataacagttcctttttcataatgccatgtcagagtttttttttatctttctctccctctttttaaattttacctttttaaattttaacctttctttctgttttttactctacaggccctttgcatattatgttgtatattatggcttccagttttgcatttttatgggattcctgagtgtatgaattagtgggtctctgcatctgtatttgtttcttatgccctttcttgggctcttttccttctgtttgtttgatcctattcaattgtatttgtttttgttttatattactatattttattttagagagaaaaattcttgaaacaggttatgtagtaatgcagtttataaggcttttgatatagtattattaatatagtaagtgttcaatgactagtatttgttttactgtgttataactatttctaaccacttgatgttggcattaactaggaaaaaattaacatcatagaaattattgtgaatttctctcatcttccaaatgcttgggtttttcttcaagaatgaaatgatcactaacattcattaactatgttagtttaagaaacattgaatttgataccatggtatctaaaaaaaatttttgcctttgagaaaaagttttattacttcttttattttttacattataatataatgacattgtttcaagctgggtgttggtgtcacacgcctttaatcccagcactcgggaggcagaggcaggcagaactctgtgagccaggataggctccaaagctacacaaagaaaccctgtctcgaaaaaccaaaaaaaaaaaaaacaaaacaaaacaaaacaaaaaaaccacaagacattgtttccccatttcctttcccccatccaagccctccaatataactctccttgctttctttcaattcatggcctcttttttaataatttctgttacatgaatttatagatgtatgtgtatattagtaccctgctcagtctgtataatgttactagtatgcatattttcagggttgactatttggtattggataaccagttggtgtactcttcctagggtaatattatttctcctgctctcaccattgcttagttgcctgtagttcttggtgtagggctgaggccttgtggattttctcctatccactggcatgtctattgttgtcgtccttgtttagctcatgttttggagccatgttggtgaggctttatgggtgttgttttgacattactaggagacaactctgaatcctcttactcttataatctttatatctactcctttacgatgttccctgaaccttagtgtcaggaatgttttatagatatatctgttgggactgtggctccacaattctgtattttgattgggtgtggttttctgtaatggtttccatttattatgaagagaagtttctttaatgtgggaatgaggactatacttatctgtgggtatgaagacaaatatttagaacatagttaaggtgttatgctggtttggagaaattgatggttgtaggttcttctccaagatccatgtcttcattggccctaggcatatacttctctgatactcagatatgatcaatcattttgtccatgtcactgtgattttcctcacttgaggtaaatgtagtctgacatattgattatttattcttggctatgggatgagattttgctcatattgatctaactgtttagggatgtttgtttatatagatgtcatatgatgcctcagaaaggttatggttcaaagcaagatgcaaccccactaaattatgcactactatgttttgcacatccaataggaaaggagctggggctctgggtctgccctaggaagggcttccctcctaccttgtgcaggggtattgagtcctgttgaaaaacctggctctgtccaactaaagtaactctccttaagaatatttgctgtatctttaacttaattttttgagtctataatttacatgtcatacactgatttgttttaagattacaattgaacagtttcttcaagtttactaaattgtaccatcaccaacacaatctgtcttggggttacgtctgtcatctcaataagactcctcgtgtccatttatggttagttctcgttcccattcactaacttgtgcaacaactgtctacttcatgtccccagagatttgtcatttatatgcgttttgtataaatgggaatgcatattaataatgtatcctttatgtctagcttccttttgtattctttggtagtttcatatattcatagaacatttgtagatcacacccatcctccactctcctctacctccttcaagccccataactgtctcagtgtagcagttttgataatcactcatgctggtcatgcctcagcatgttgttgacaagttgtactcattacttatacatgtgggtggctttctggatactatgaatagtgtatcaatttctttttaggatatatattttcatttcttttgaatgaagacatggagtggaattgttaggtcatattgaaactctagtttttgttgttgttgttttggggtgtatatgtgtgtgtgtttgtgtttgagaaagggtttctctgtgtagccctggctgtcctgaaactcactctgcagattaggctgacctgggaactcaaagatatctgcctaagtctgactcccaagcgctgggattaaaggcatacactaccactgcacatctgtaactctagttttaacatcttaagaaactggaaaactgttttcaaagtggctttagtattttgtattctgattactatatgagggctctgattgtcccatctttgtcaacatattttactgtatttcttagagttaaagctttttgtaacagaacaaaatgatatatgatttctttgttttagtttgcatcttgctattgacaaatgttaaatttttaaaattattttttttactttattgtgtgtatgtgcatgtgtgtacatcaaatgaaaacttgtgtgagttgattctcttcttcatcatatgtctcctacaacccatctcactggtctgatgatgttaaatatcttttcttgtagtttttagcgaaaggttttcattgttcttggtgaaacatttctcaattttttgcccaattttaaattgggtatttatccttcatcattgtgttgtaaagcttgtttatattttctttgtagaaaatattttatcgggtaaattaaattatttgtaaatattttatcctactctgtaagttgtcttaaactttgttgatcatacctcatgaagtataaaagtttttgattttgatgaattctaatttccattttattgttcatgatatttgatattgtatcagaaatctttgcttgacttcaaactctcaatttttattatgtaggtgtgcttgtattatgtgtgtgtgtgtgcttgtggtatacctgcatgtgggtagagtccagagaataatggagtgtcattgttcagaaaccatccaccttggttttttgctcgttttgttttgtttttgagacagggtctcgcattgacttggagctcattcattaggtaaaactggctaaccaatgaataccaagtgttttcctgttactacaccaccataaaaagtgttcactacatggattctggctatcaagttcagatttttatatttgcacgcaaatacttttttgactgagaaatctatattctttttgtaattatttttatttatttcacataagcaaccacaagttcccctccctcttctcctctcattcccttattccacctcctttctatgcctaccatccaaccctcagaaagggtaaggcctcccatgggaatcaacaaagagttgattccatatcagcactgggctgagctcctctttctcttcagcttgactcctgcatctcagcccagtgcttggctgtggatctctgcatctgcttccatcagatgaaggttctgtgataactattagggtagtcaccaatctgagtacaggagaaggccagttcaggtaccctctccactattgctaggaattttagctggggttatccttgtggattcctatgagtttccctggcaccaggtttctccctaaccccaactctgccattccaatgcctcaagttcccatcctccattccacccctttaccccccaaccccaccaattcccagtttatccaggatatatcatctgtttccccttcccagagtgatccatgcatccctcttagggtcctacttgttacctagcttctttgggactggagattgtagcctggttatcttttgctttaatataatatgcacttatgagtgagtacataccgtgtttgtctttctggggctacatttacctgactcaggatgatttttctccagttccatctatttgtctttgaagagaaatctatagtcttagttcatacatttagctctgtcgtctgtttgggattatattttaaataaggtatggaatgagtctatgttctctcatagtttaggatatacagatgtcttagtgtcatttgtcaatgaggtggttatcaaccccattcaattgccctgactcctgtgttgattgccaactgatctgaaacattaagagtttatttcaagatctcaatcctgttctgatgagttctatgtccatctctgtgccattgctacactgctttagtaagatttcagagttgatggaagcttaaattaagagactagaagtcatggctggatttactttgcattttgaaacttcagaaaatacatcagttaataaataactaaatacaagaggataggaaattacttacaaaaaatcctaaagtagagagaagtgaagcagataatattacataacctctacattgctggctcttaatattgtcactcaaagcttgccaacaatgaagaaaagaataggaagatgtccataaaataagtttaataaaattgtactaaattccttaggtatacacaactacttttgtctcttgcactttaggggatttttcctgtgctcatgaaactggggataaatattataaaaaacaacacccttctttgaatttttgctgttaatgaaccatttacattgcaaatttttcttgacatatactgtattaaaatctttatagatctcaaacaaaagatatttgccccaaatttggctgaacttgatgtagatgttttactactagccattgtctcataaattttatttttttaaacactgatctaatgagctgggtgccaaaaatggcattttccttctggtatgagcatgccttctagctatgacaagtaggctggactcaccaaatctcatcagcatggctgactaacccctggttggttatccaatgctaagtggtcagctctggcaacatacctcttcattgaagagcagactcagcaggctgtattccatgtttgttcctttatagaaatatgtaacagcaatggttaaagaagaggtgtcatggatttgggatgagctgggaatgcagacaggaaggtatgtaaggaaagaaagggagaggggaaaatgatataattatatttttaattaaataaaaacaatttaaagtacagtgacactatgacctgaattaaaataaaaatttctattaataataaactcaagcaaataagaagcttgataaagttgcttacctagttcagataactaaccccattccttactgatagaattaaagaaaacctattcttccaaggcagtcaaattataaaaccagagaggcagcccggcctccatccgccggcccagataggccaggagctgtttctggctcctgttcatcatcgctgctcagtcatctgacacaagagacctgctgcagcggtgggatcctacacaccaaggcccagtgacagctctgcccccaactgctggcccggcaggacccggcacgccagaacactgccgacacccgagtaacagtgacacctccattcacgagaagaggaccaatatcagagtattggatctgtttgaatctaccagaagagaacctttgtcccacacccaccaggagaaaaagaaactcttgctacacccaacagaagaaaggatgagaagaggacaaggtaaaagcacattcaacaacaaaaaactcaatatgacacctccagagaataggatccatacaccagcaagacctgaacatcataacacagttgaaccagaagaaaatgaccttaaaaacatcttcagaaaaatgatagaggacctcatagaggacatgagaaaattccttaaagaaatggaagaaaaaacaaaccaaaaaaatacaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaaaaccaaaaaaaaaaccttccccaaccaaaagaaagacatgccaatgaaaatacaagaagcctacagaacaccaattagaatgacccaaaataaaacgtcacctctccacataataatcaaaacaccaaacatacacaacaaagagaaaatattaagagcagcagaggaaaaaggtcaagtaaactataaagccaaatctatcagaatgatacctgacttttccttggaaactctgaaagccagaaggtcctggatagatattctgcctacactaagagaccatggatgccagcccagactactatatccagcaaagttttcaatcattatagatggagaaaacaagatattccataacaaaaccagattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattctcctgtggtggtcttatcagaccaccatgctttaaaattagagttcaacaacaacatgaaccacagaaaacctacaaaccatcaggatgaagtctcaattctgaacatttatgccccaaatacaaaggcatccacgtttgtaaaagaaacattactaaaactcaaatcacacataaaaccacacacacttatagtgggagatttcaacaccccactctcaccactggacaggaacaccagacagaaacttaacaaagaaacaaaagaactaatagaagttatgtcacaactgtatttaatagatatctatagaacattccacccaaatacaaaacaatttacctnnnnnnnnnnnnnnnnnnnnnnnnnnnnnnnnnnnnnnnnnnnnnnnnnnnnnnnnnnnnnnnnnngaaaccacccccccccccgtgtcttatcagaccaccatgctttaaaattagaattcaacaacaacatgaaccacagaaaacctacaaactcatggaaattaagtaacacccaattgcacagttcatgggtacaggatgaaataaaaaaaaagaaattaaagatttcctagaattcaaatagaatgcggacacaacatatccaaacctatgggatactctgacagcagtaagaggaaagttcatagagctaaatgcccacatgaagaaacaggagaataatcacactagagttaacagcacaactgaaagctttagaaaacaaagaggccaatacaccctggaggagcagatgccaggaaataatcaaattgagggctgaaatcaataaaatggaaactaggagaacaatacaaagaatcaatataacaaaaagttggttcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcattgccaaactcttttatgaggcttcaataaccttggtacccaagcaacacagagacacaactaacaaagagaactacagaccaatatccctcatggacattgatgcaaaaatactcagtaaaatattggcaaattcaacccaagaacccattagaaaaatcatccaccatgatcaagtaagcttcatccctgggatgcagggttggttcaacttatgaaaatctatcaatgtaatccaccatataaacaaactaaaagaaaaaccacatcatcatctcactagatgctgaaagagcatttgaaaaaaactaatacctcttcacaataaatgtccaggagagatcagggataacaggaacatacctgaacataataaaaacaatgtatggcaaaccaacagccaatggtaaactaaatggagagaaactcaaggcaattcctctaaaatcaggctgtccactctctccatatctcttcagtattgtacttgaagttttagctgagcaataagacaacaataggagatcaaggggatacacattagaaaagaagaagaaaaagtttcactgttggcagtttacataagtgacccaaaaaactctacctgggaactcctacaactgataaacaccttcagcaaagtagcaggatacaatattaactgaaaacaatcagtagccctattatgtgcagaagatatatgggctgagaaagaaatcagagaaacatcaccctttaaaatagccacaaatgacataaaatatcttgaggtaatgctaaccaaacaagtgaaagacctgtatagaaagaactttgagtctttaaagaaagaaattaaagaagatactagaaaacggaaagatctctgtgcccttggataggcaggatcaacatggcaatcttgccaaaagcaatctacagattcaatgcaatccccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaagatccagcaattccactcctaggcatataccctaaagaagcacattcatacaacaaagacatctgttcaacgatgttcatagcagcactatttgtaatagccagaaatgaaagcaacctagatgcccttcaattgaaaaatagacagagaaaacgtgatacttttacacaatggtgtactactcagcagaaaaaaaacaatggaatcttgaaatttgcaggaaaatggctggaatgggaagaaaacattctgagagaggtagatatgtactcactcatatgtggattttagacatagagtaagggattaccatcctacagtccacactgccagagatactagtaaacaaagaagaccctaaaagagacaaactttgttccctggagaaggggaaagcatcaccattccctgagtaaattgtgaacatgggaagagggggaggaagctacaagagtgcaaagggaagaaaaggaaggatgcagaagtcatgaggaagcagaaattttgagtcaggtgtagattaaaagaaaggacatatgacaggtaggattttagtttgtttctgtgagtttctccaacctggtacagacagaccccttcgctcttcattcctccctctcttcaactaaattccagatttcagctcagtgtatttctgtgnnnnnnnnnntctgcttccatcagccactggatgaggactctagaatggcataaaaagtaatcatcagtctcattataagggaagggcatttaggttatcctctccaccactgcctagattgtcagttcgtgtcatccctgtagatctctggaaatctccctagtgccagatctctcctcagacctacaatgactccctctgatatgttatctctcatcctgctctcctctattctttccccaactcaataattctgctcctccatttcctcctctcctctcctcttctcctgctctcattctggcagctccctctcccctactctcctgctcccaattagctcaggagttcatgccatttcccattcctggggtccatttatcccttagagtccttcatgtttcctgaaaaactaaattcttatacttagtaaataatatataacctaacataccataagttcacagtatgaggagataattattctaaaatcctggttatttttagttaattaataccaaaattttagttaattaataccaaaattttgtcagaaaatataaatacatcaagaatcttaatttcacaatatcaattcattacagatgtaaagagtactcattgtgtaaagttgcagattttccaggcagaaaaaaatgtacaaccttattaggctgcttaacaaacagatgaattcacaattatttaactgcattctacatctgaacatcaaggtcagtgagaggaagttttagaatgggaaagactgggttttctttttgccaatgagcaatgaagactatttgtctccagcactgagaaaggagtaatatcaaaccatagattaagccagctcaaatgctattccaccttttaacaaagacaaagaaaatagttctcttcttcagcctggtcaaaatgctctataactattttgtgtaaatctgaaagagaacccatgatggaatagtaactaacattgacgaagttatacaatggaaactgaagaaaggtgtataaagcatcataatgacctagggtagccaccctaagaaataataacctgaatataacatcagtcttctcaatttttggaagctagattcagtcattctcacatgtaacaggaacttcctgaggggtgctaagccaagccaacctcattatgcctcttctcttttggttccagtttgctgggtgaataactaatgttccaatctgaattctattaagagtttttctaaaaagagttaggctggtggccaacactttcagaaggctgactctgctttatattgaaaatgaagaacctcatgcttcacccaagatctagcaaatatgagggtttaagagtgatactttctgcattctgcattcagcaaatccttcagagtatttatatgttctaacagtgcagaaatattttatttcttttttcctctgtcatgtgcagtacacaccacactctcatgtgtaaacatgtagaggccagagcagaacattgttttttcttcttctagcactgttcacattatcggcttgaggaggtgtcccttactgaatcagatgttcactgtgtgggttaggttggctgagaaatgagctttaatgaccttcctgtctctgtttctgctagtgctgaagtctcaggcacatacagccaagcctggacttttatgtaggttctggagattcaaactcaggttctcatgcttgcacactgagcaatccccaagcctatgaaaacattcttgtaagataaacagaagaggggcagaaaaaatatgacatgtaatattagtccgtatttgatgatgactataaaatagccaatatcaaaggagctcaataaaacagaagaacaataaacaaagtaagtcatatcatagtatatcataattaagttcctaactataggtgatgaggggaaagttataaaagtagccagtaaaaaagcatacaagtgcaaacagagtaaaaactaacagagtgactgaatattgcttttttgtaaacaagatcagtgaaagacaatataatattgataacataataaacagagaaaaagctatagtttagaattctaaaccccataagaactatcctttaaaaataaaggtgaaaagccaggtgttggtggcaaacacctttaatcccagcacttgggaggcagaggcagatggatccctgtgagtttaaatccagactggtctatgcagggagttccaggacacggcagactacacagaaaaactctgtcttaaaaaacaaaaacaacaaaacaaaaataaaggtgaaagcattaatgattttaagcaggtttagaattcatatgtgtatggtgtttactagtgtgatcaatattcggtggaaacttttcaaatagtagatgattttctgacatttagtgaggcaaacatcatatgacttatgagccagttcagagtgcctttcatctagctccaacatctccaggaggcttatgtcactggagctttcacccttctctaaatgttaagagagagacatttgaggtcataatctgtacagacatcatttgtgtgcaagctcctcgaagactataaatagcaaaaaggagtgaatggtagcaattaatagactgagaggttcattggcagatcgatttttaaaaggtgaatttagaaaatcccaatgttcacctagaaattaagatatgatctttgtatagcaattcctgaattctctctgatgggctttgcaatcatcaaagacccagcagttgaatcacttttcatcttcacattttcaacacccccacttaccactaaggatgcagaaagaaacaaccacggcaagtctatacttaaatctgcatttgatgtcagcttgtgctccgtttctttccttcctctgctaccctgggcatctgctgaaagtcttgaggggaatcttattgtttgttagtagttatctttattgttatatgcctgcacattcctgtttattgacggctgtattaccaaacattactttcattttacactccttctaaatgcctttattgtattggagatttcagtagaatttacttagtcactcaaacttagcaagtttttttaaactagaggttagtggatgttaagtactttcttgataaggagactgttttcaggtttacattttgtgtggaattgtacagacccatgtacacattttctttctcaagcatagccagaatagttgactgaactaagaactcaaatgtctcctgtgtagaaaaaaaaaaaaactgggtatatgatgattcatcttactggttcccatatctgtggtaatttttgtctttgaattcagagttagaaatcaaattatcaatatttttggaatgcttgagcatgaaaagtagatagcttgttcaaaccagaattctcaaatttcgagtatttgccttaacatggtttctttctcgaggtgctccaatcttttctaattattgctccaactagtgacttcagaaaagtagactttatccatacctacaattgacaaggagataaagttgttagagacagccacctaatgaaccactgctttctgaaaaataaaaatgtaattaaaaagaagctctttcatggagaaaatgtataaattatgtttatcttgagggcattaatatagtttcccacctgataccatatccaagatcattcatttgtagtaagcaacttaaacattnnnnnnnnnntgtgtgtgtgtgtgtgtgtgtgtgtgtgtgtgtgtgtgtgtgtgtgtgtgtgtttacagtttattcaacactggttacatacttttcactgcattttcaaaaattcaatgtatcagatgcttcttatgtcctcaaaatcccctcaccatctgtcctatctacactaagaccgatactctactcttgctctggtcattttgtcttcacacattgcagcggtctgttctgtagcttgaaggcactgtgctgtgcccttgaacgcttgcttgcccaggcattccctcccactatgctgtctgcattgttcttggctttttctgactgggggattccaggaagcaatgagactatctttcttgtttttaccccagaagggaaaattctgatattctcttcagaaagttcctcagatttctagatctttaagcaagtaatacctagttcaaaacatggtttcttcttaatgttccctcttttctttcatcttctctttttgccaacccctctttcttccagggattacattctcactgtcaaagtagctattggcttacatgtattttgtctgaagtagattctgagactgtagacggcttaacaagcattatggctagacatagtgatccatacatgttattccaaccctgaaacctgaggttgaaatagaaagattatgtattcaaggccagtcccattacatgtgacgaccctacctcaaaagaaaaataaatctgctctcagatacccaactaacttccagttgggcataagcttgtctagatctttgctgttgtagaatttggtgattgtggcatgcatattgaactcctatcaggtatctgtggtcccctagttgcacattctgtctaatgctgctttgagagcatgtctcagtttgctttctgtgtctgtgataaacatcacgaccaaaagcaacttgtggagaagagggtttatttcaccccacagcttataggccttcacgaagtatagttagagcagtgactccagacagtatcctgaatgcaggaactggaatcaagaccatgaaggctacggcttactggattgctctttatggcttgttcaaatttgttttcatataggatccgagaccacctgacccgaggtggctttcccacagtgagccaggccctcccacatgaatcattaatcaagaaaaacctccacagatgtcctacagaccaatccagtagagacattccctcaatggaggttccttcttcccagatggttctctaatttgtttcaagttgacaaaaaacataagtagcacaaactctttataaaacttgaatgcattttctttccaagtagaaatatttgcattatttccaaaaataatgataatatcttccaagaatccactgtgtccataatgaactgacatccatagtctttccttaccaccatcggacgttcaccagtcacttgctaccgtgttcttaaatatgtcttttctgacaggttgcatacaacactgtaagatgatagccagtaactcccactctttaatgatctctgctccttgagtgcaggtaggacctggaaatatggtgtgaaatcagccttctgcttatattgtctgaagaaactaaaagcccctagtcaggtcactacacactaacaaaaaaggatattattctggtgggtctgatttattacagggaccagaaagagggcttagggttttgctaggttgagaaatgctcctagtacatttaacccagcaagctgtcatgaattctgtaactccaaataaattaattgttcaaaacatgggggcttggaaaatagtgtaagatgagattgacactgactctggtcaatacttcaattgaagcagttgagactctggaggcaggatccagttatattgtgcccagactcctgactgacagaaactacaaaatgagagatgtgtgtgttgcttttgcagctttgcgaccctttgttatacagcagtatcaatagcttttgtttgcattagcatttgcctaccaggcaaagttccgaaagggcagtgtctctttttttttattgattacttcaatatctagcacagtgctttcaaaacaacaaacatataataattttttgttaatgaatacctaatagctaacattctgaaaatgaaaaaaatatgaaaaggtctatttgggttttggtagtgtcttccacattaactcacaaatttcaaatagcaacatatcttgggaaatgcaatgaatcacatttggttctcaaagtttttttttcatctggtaatcatgagacctagtaacaccatctattgcaaacaatagtgctagatccaggggaaggggctaactgtttaaacagacatcccaagccatgcttcacttctatagtaatgctcacaaaatcaatgaaacagatcttcactgaaatacaaaatgctagtggggcctgcacaaattggtgtcaggggctcaagaaaaggaaacttgaactgaaataacttaatctttttaaagtgagaaattgaagatcatatacacgttcaccatactgaattttcaaggtattaaagtttaatgtaatctatgcatatagctcaggagtcattgcatgaattaatatctttagcttacttaagggtacttcaattaaatatgtcagaacaacacaaaaatctaaatccctagtaaggtgatagcagagctatctaaaaatgaaaaacataaataagtaagaatttcaccaaatgggaatactcagtgttttaaaagacagcatctgtgtggtttcaggtgggacgacttttaattcttaaagtcatttagcaaaatctattgctgacaattagttgaatttttttatatttgttactcttattcttactggaattcttgcttgtaatggagttaaagattaatcaggttgtccagatagtaaacatgtcgttatttggacaaatatgttaagttcagacttagacaatagtctcttagatgtaacctgccctatattgtttccttgcttaatttcaatacctaaatttagaattgcactttgataagttaatttgtctataacttcagaatgaaggacttaggattagttctcccgatctgtttagaaagcacttcatcacacttctggtaacacttgaaactcatggacaagagtgaaatactgagatcagagataaaagtttccaaaggaaaagaaattaaagctattttgtaagtgagagataaaaaaattattacaggctaagcctttcttgtgttaatttcttaaatgtgaaaagtatccaatgaacccattaaatacattttgacagactaacagcaggaggcttgttgacctctcacctcatattgatttcctcttcagtccttttccttggcgatttctacttttcctgcatatattttgcctcgcagtctattctccacacgccacgtctgtaatcactggcagaggaaacccacaaagccctgagccacacagatatttaggaggatctcgaaaatttattcccatctgtcagtaagttctttagtcagcaaatacttccataaaaaaatttccccagctttctcaataggtgagtcaaaatggtcattaattattatttattcactgctcatcaattccaccagcactgggtgacaaacatgaaaactcaaagaaaggaaaggacgggtaaccctctttattcaggcttttagaaataccatctgtaaggaaaatatctactaatgagaaataagcaaccaagatagaatttaggtactggggggaggggtggtaaactaattgagaaacccatatgaactgccctaaagccaataaagatacaagctggcttgtatacaaggggttggattactcaagttctgaattttgaaagtcgtctttgatgtcatgtctgaggtcagtaaagaatgtcagagatctcagcagtaactattactaagatgagccagagtccttaatgctgcaaccaaagcattagtgaatggccaaggtttgggaggctcagagtatgaacacagagttgtgacagttcttcaatttgaaataacatgcactcgctatctgcaaagaaaactaaaccttcaaaaatgacccttagtcaagattaaatacattgttttgtgagcagccgtatagccccaacttgtagttgtcttcctctgagtccatgtgatggaaaaacaagactcccttcactgttgcctctaaaaaacagcaaagccatcccaaatggtattaaagtgcactgtgtgtttggctgaggattatcagggagagagaagcagctgtatatttgcaataggaagaaactaacacatactgaggcacttatgtccttgtgggagcctcactttggctgccactcaagtcattaccatcttttttcccttgtttctcccttatctctggcctactttatgcagcctacctcacctgtgatttggcttcaagccttatctacttccaaataaagaggtcattaggtaccaggatccacttaacaaaatatctggacagggacactttatgctcattcttccattgacaggaaagttaagtcaagggggttcgatgaagcaatagaaaccctaagacaagttgataaacactattgtcctttatgctcattctcccattgactggaaagctaagtcaagggggttcgatgaagcaatagaaaccctaagacaagttgataccaggatggggttacgtctctgtcagacctcaccatgttttttgggagaattctggaaggactttggaactttggactagaaaaaccatggaatgttggattttggggaggattctggaaggactttggaactttggactagaaaaaccatggaatgttgggcactcagtgcaatgttctgtggaagatgagaatgttgagattagtgaagaggatggaggcctggcttgtgaaacacccttgaatcaatcggtacaggagaccacttcctgaacgttacaccagtagcacagacactgaggtcaaccattgataaactgctcctgaaactgagaagcttctgtaaggcaaaggagacagtcagcaaaacaaaatgccagcccacagactgggaaaagatcttcaccaaccccacatgtgacagagggctgatctccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccccgccccctgctagcctctggagaccacaagtcctgacctcgcagggcgtccttacctcgcaggactgtgcactggtatttttaagctattagttttgcggacatttaagatacagcaatagaaaactaagacagaaaaaaaaaaaaaacatccacacggcagtcagtgacaaaacacgtgaaaaaaaacaaaaaggaagaagaagaagaagaagaagaagaagaagaagaagaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattgtgtcactgggcttggtaatgtgtaagggtcacttaggtagtacttgctttgaaggcatgaaggggtcgtggaaagcagctgaggcttggcactatgagaggccagcaaaggccattggtgaaggtgctgcctcaggggcagtgaaagtctcaggatgaaaagtgtcatgcacagaaactgaggcttggcaccagaaagagagcccatgaggggctcttggtaaaagtgcagcccagttgcagcgagggaccccagcagtttcagaaacgccagtgccatagtgtcttagttagggtttctattgctctgaaaagacaccatgaccacagcaaatcttataaaggaaaaacatttaattgagtttgtttacctttttagaggtttagtgcattatcctcatggtgcaacatggtagcatacaggcagacatgatggtggaggaagagcctaatctacatctcgcaggcaacaggaagtggtctgagacactgagaggcaccttgagcacatatgagtcctcagagcccgcctccatactgacacacttcctccagcaggaccatacctactccaatgacagcaatacctcccattagtgccacctcctttgggggctattttctttcaaaccatcacattctactccctagcccccaaagggcttgtagccatatcataatggaaaactgcattcagtccaaattcaaaagcccccatagtctgtaataatctcaaacttaaaagtataaagtccaaaatctcttctgaaattcatgcaatctcttaggattagattttaatcccctataaacatcaaaataataataataatattttttaaaagatcacatactcccaatacacaatggcaagggatatacattactgttccaaaacataggaaagggagcatagtgaagaaacatcagaacaaagcaagagcaaaatccaggtgggcaaactccaaactctgcatctccatgtctgatgtcaaaacacttttcagatctccaactcctttcatcttctttgacttggactggtcccactgttagcagtactcctcatcaggtattccttgattctgacatctcgaacatcttggggtctccaaggcaatccaggcttcaacttcacagcttcacacaatggcctctctaggcctctattcagggacacccctgacagatgcctggcttcagtggcttttcttagtcccagaagcaaattccatagcccctctcttctgtccttaactccagagccatgtggacaaagatgccaagttctgctacttacgagggctgtaacatggccttcttgttcaattatgccttcaccatcttctattttccttcagtgcctatgcttggctgtcctttaacttgctctgtagaccagctgacctcagactcagacatcttgctatcgtctgcctgcccagtgttgagattaaagatattcagcactatacccagctcataccttttctttaatttcttttcacaagttggaaacttatctgggtgggatcttgtcctgaggttaccactccctttattccatttcttaatctgtttatctccttgaacacgggatttagctccattctatttctggtgttccttttctcctcaaacagttttccttgctcagctggctccctttctttatatatattctctagagttgatgccagtaaccgcacaacagagttatgtggttatatactcttccaacagaattaatacaaaagtcttcactttagctccagctaactttttggatcaaggcaaaaagcaacaactttttacatcaaaatatccaaagaccaatttctaagcaacatactaaaattcttctcctctaaaacttattgagctagcccccccacacacacacacacgcacacacacaaatacttctcgaatcactcttagaaccacagtcttccattctgctactgaaatggccattaagcagtgcttacagcattcaagtgctttcataaccccaaatcccaaagtccaaattcctccaaacaaaaacatggtcaggcctgtcataataatacctcagtattaataataccctgatcaacttttttttttcgagacagggtttctctgtgtagctttggagcctatgctggcactcgctctggagaccaggctggcctcgaactcacagagatccgcctgcctctgcctccagagtgctgggattaaaggtgtgtgccaccaatgtccagcgaccaacttctttcttagggtttatattgctgtgaagacaccatgaccacagcaacccttataaagaaaacatttaattacagtggctctcttacatttcagagattcaatccattatcatcatggtgcatcatggtggtgtgcagggagtcaaggtgttggagaagtagccaagagtcctacatttgcagacaacaggaagtgaactgagacacggagtagtatcttgagcatatatgagacatcaatgcccacatccacagtgacacacttctttcaacaagaccacacctgctccaccaaggccacaccttctaacaatggcatttggagcctttttttttcaaatcaccacacatgagatgggcaccaagatcagcagttgccgtggagtggagacacccagagcctagaatacaagctgtgtgtgctgtggagggcagagccagagaaatgacccaagccctttggtgggctccagaaaatgataagggatcccagacaccggacagttggaatatggttttgctttgatttgtgtgtggcagtgccctgatttttccctcttgaagtaaaaagtatttaactggagcctacaattgagagactttgaattttaaaagagaatggctaatttaaaggaacttaaatatttatgtgtttgaatttgtaaatactgtgggacttttaaagttatttatattttaatgtgagatcttggtgatgaataagaaaagaaaggttatggcttaatattgatgtgtttgtgtgtcaagttgacaaggagccagtttttttctctccattttttatttaaattagaaacaagattattttacatgtcaatcccagttccctcttcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatttccgaggtctcctcactgacacccaccaccttcgtggagtctgaatcaatcccatgctggtttcccagctatcagtctggggagcaagagttcccccttgttcaggtcagctgtttctgtggttttcaccagcttggtctggacccctttgctcatcactcctccttctctgcaactggattccagttcagtttagtgtttagctgtgggtgtctgcttctacttccaccacctgctggatgaaggctataggatggcatataaatcagtcattaatctcatcatcaggggagggaatttaaggtagcctctctgttgtttacattgttagttcgtgtcatcattatagatctacagacatttccctagcacctgatttctctttaaacctataatggctccctgtattatggtatgtcttatcttgctctcctctattcttccccagctcaaccttcctgttctctcatgtccttctcacctctcctcttccccccttctcattctcctagttccctctccccttccttcatgctctcaatttgctcaggagatcttgtccctttccccttctgggggtggggcaatgtatgcctctcttagagtattccttgtttcctagcttctctggcagtgttgactgtaggctggtaatcctttactctatgtctaaaatccacatatgagtgagtacgtgccctgtttgtctttttgtgactgggttacctggctcagaatggtttcttctagttccatccatttgaacaagggggtagttttactggctggttttgtatgtcaacttgacacaagctagaggcattggagaggaaggagcctcagttgaggaaatgtctccatgagttccagctttgaggcattttctcaatcagtgaccaatgtgggagggttcagccttgctgccatccctgggctggtggtctctgtttctagaagaaggcaggcagagccagtcatggtgaagcaggccagtaagcaacagcaccgctacaggaactctgcatcagctcctgactccagcttcttgccctgtctgaattcctgtcctgacttccttcagtgatgaacaacaatggggaagtataagtcaaaaaagtttttcctccctaactttttttttggccgtggaggttcatcacagcaaaagaaaccctaactaagacaccctttgcaatttttatcagttccctttttcatttcttcaacaaatatcaagagctttttctctccataaccccctactatgagataaaagtttggcctccttttaaattgatttgtttaaatcttgaccgatagcagggttcaaatgtgatatatataccctgtaaggtagtaatggagattaaactggatcacaagatgaatccctaatccagtagagatggtatcatccaaataatggaaatttctctcctgatgccatgtgaggacatgaagcaactagaaaccaactagctagtaccttgatcatgtgcttatagcctttagacgaggacatgaagcaaagatagcccttactagaaaccaactagctagtaccttgatcatgtgcttatagcctttagaactctgaaaaggtaaatttcagttgtttatgtcacttggtctactgtattgcactgtgacagattaagctggttaataaaaccctgtattgtacaatttcccatgcagcttagtagatgattgtgcctttggcttcattaagaaaacagaggtcctcccatttttactcatgcattctgttactctaactccaagtgtccacacttctacctagacttgctgctttcccatctcagtggtgggtgggttagcagtgcactttgtggaaaccattcggcttgtattgagacactttctatatcatctcacacttgaaggtgctctcttgcctaaagctgttggtgcaacacaatgaagtttaaataaatctcaaactccttacagtggatatgtggtgtgatgccctaatctcctgattttctgaatctttggaagataaagttgatatcagtaatatgcttactgggagtctagtatttctaaaacaccattatctctttgtctgggcacatctgtaaagaatggcagagagccaattcaacatttcacatctgagtatgagtctatcttttttacatatggtgatctttatgatgttccctttatgctggtgtccaggcaagaagttctctttttcatttctcctaattcttcctatgttatgcagttgttgttttttttttcttttttgctgtgatgaaagactttatataaacagtgtgcagatacaagaaattgtggtggaagaggctgttcatcccatggcagacaggaaacaagatagagaaggggttcggagacaaaatgtggtggtctgaaagaaaatggtccccaaagggtgtagcactaatgggaggtatgacctctgttggaatagttgtggtcttattgaagaaattgtgtgtcactgtggaggtgggctttgaggtctcatatatgctcaagatagaacccagagtctcagttcacttcgtgttgtctgcaagagttagaacccttgcctacttctccgacaccatgtctccctgcatgccaccatgttgccccatgatgaatgataatggactatagtgtaagagagtcaccccaattaaatgttttcctttgtatgagttgctgtagtcacagtgtctcttcacatcaatagaaaccctaactaagacacaagacatacccttcaaaggcatatacaatctaataaaatagagtggcctacttcctccaaccaggattcaattcccaatagcccaatcagctctgaattcatccaataatgaggattacatcctgtgacccgattacctctcatcagtagcaccaactctgcaccaaaccttcattggtgggtgtgttgtaggaacaaggctggtctcctaagtctccctggaagggtcatctctctttagtttctatcacagtctaaaaccaacacctgtaatttttcccttctggatttttgccatggctctttactaaattatcagcctcatgtatcaatccattttttttttttgtatttttgccaaagtgaccttcccaaaatgaaattttaatcatgctactcttccatttgggaacattccaagctttccactgtgtgtaagaacttacagatatcagacttgatccttacctgcacttgggctgtttgcgtctaatgttctcaattctggcccttgttttagctattctctgtgacttttatctctttactgccagtccaaccattttaggggtctctctctctctctctctctctctctctctctctctctctctgctacctttctcagggtaagcagtgacccttctagaggccttccctgacataatgatctcacctcccctagagcctaactaaagaaatgtctacttcacttgcaactaatgaaaaaagaccaaggcaaatattattataggagaaagaacaaaaactctagagaattggcattctttgaaattacagaaaaatgaaataatagagtaatatgtgggtaaaagggggacatctaactgggtgatttttacttaaaatactggtcatttggaaaaatccagcaataataaaaagtttgagctcatgaccacttagtatttaaaacatctgaatgaaattatgttagacatatatataaaaacttatgagtggcaagtggcccatatgcttggccatacagattttgcctggggcaaaaatccttaccaaaataaagtctatgcaacagaaaaaaaacactcattttgatactaatttgataaattcaacggtgtgatagaatcatatttttagacattctttaagatgtctcaagaactcaagcaaattgttaatggcatctataaaacccgagacctacattttgattggtatgattatttatgtttgtatacatacatagttaataaacctaccatatactcacgtatttacaagtgaacagaaaacacattacatgtcaccattttcttatgttcttagaaaatgttgtggccactggcccaaggcttttcaaattgtgggtctccatccactgatggatcaaaacgttaagatggctcctatcataactttaaaaatgaataaaagtagaagtgagaaaaacataacagaaatcacaataagagagttactatttctgcaaacatggttgaaagtccggtgaatgaggactgaggcttagggatgaagtttgaacccctgaactttgaggaatcctgattcagtgctgctgctagctgctcagaaatgtcagaccccattagagccatgagcaaagacatcctcactgccattatgtcatctccccacttgttctgtgttactgagaaaagacaaatttagattctcctagtaggctaatataccatgtgctgtttagtgatgtgaatctgctggctcatttgtcactggacacaagctatagtcaccggagagggaagcatgtcacttgaggaattgctttcataagacctggctgcaggtaagcttatatgacattttcttgattgataattgattggggagggcccagcccattgtggatggggccaccacttggcttgtggtcctgggtgctataagaaagcagactgggcaagccacaaaaggcttgccaggaagcagcactggtctatgacctctgtacccactcctgtcttcaggttcctgccctgctgaagttcttgcctaacttccttcagtgatggactctgatgtgcaagtaaaagtcaaatgaatcctttcctacccaacttgcttttggtcatggtgtttcaatacagcaatagaaaccctaactaagttatctgtttttctcttctagttgctagcaggtatgaagtaagttcagcacattttgaattttcatagcctcatggattccctataatccccttgattgtccttatctggctacttcatcctcttctcccaaaacatattactttaagtcatgtttaatgctatttaagggtcttcagttagctcttaatcctgtaaatttattatatgtacctcagaaccttcctgaaaatgtttctaagttacttatgagatgaggctatcaattctttctttaattaatgagctacatgacaaaagtataaaaataactatatacataaaaattagacttccccttcttactgatgtaaaactcaatgtccatagaaatgattatctgtcctttaatctacatagttttcacttgttatgattacattgaaaatggcaaaaagttggaaattttaactttcttttcaggggtaacacactgtattaaatctataaggtcatatctacgtgggtttgattacaaaaactaataaagtattctctaaataaaaaataaaaaaaataacagttccaaaaaataaaagaataagtaaaaaggaagggtctaggaggaggagacacctgggtctctctggaaaatagaataaattttatgagagggtgggaatggaaggatcagatagggggaggaggggaggtaaggtagagggagagaatatggagtgtagtgatatttagtttatgatctaacaaataatgcttgcctgaagatcagagtgcaaatctatcgacattagttcacaatggaggccaggaagttgtagtccactcctttaaacccagcactcaggagatagagccggacagatctctgttcattcaaggctacccaaagctacacaaaattgatccaatctaagggagaaacagagctcacacaaaggtaatctcagtgcttgggatcccacacctttaatctagtactagagaggaatataaggcgggggtggcagggtggggaagctgggagctcagtgcagtctgaggtttggtggagacagatgcagtctgacaggatcaccctttaggtctgagcattggtagcgatgagaactctctagtgaatggccactttgcttctctgatcttcatctttaaccccaatatctgtctctgggtttttattactaagactaactagaattcctgctaccgtgaagagagacatctggaattgggggatatttgagggacgatatgggaacagtgtaatgagaactccctaaaatagaaggtgatcctcatgaggtgtaataatgggggatatggtgtctcaacaggccatctcttgtcacaaaaccaagggtccagtagtgggactgggttgcacgcaattgcattgttggccaaggaggtcccatggaaatccccaaacaatccagaccattgctaaggcaaagggttgccctccacagattgacagcaaggccccactggtgaggacaattactgtcacaactcacagaccatggagaagtcgagctggtacctacacggagccttcaccctacattctagtctctttggtgtgggaaggtactcagaaggctaccaaaagaaaaacaaaaatgaaagaaagaaaaaagaagaagaaaagtaaaaaaagttagaaattttaactttcttttctagcataaagaatagttaaaggcgacactgaattttattttgctgtagtagagtacttctctcatttcatctatctcaagaggcagttaaataaaagatgcatctattgctttaatttattaaaataactcctcaagtgtgaactgaagattgctttgtgatttttaaggatgttacatcttacatgtatctttggggagctttctaactgtaaaagtgactttttcacatttttcgtgtgtgtgtatgtgtgtgtgtgtggtatgatgtgtatggtgtgtgtgtatgtgtgttgtatgtgtgtgttatgagtgtatgtatgcatgttttatacatattgagtatacatgcatttatatgtgctaggagaagtcttctgtacatgtttctcttattggttgatgaataaaacactgttgaccaatagggaagcaagataggtgggactaggagtggaggagaattctgggaaatgtaggaaacagaagttgccaggtgatccaggtagtaacagtatataagcagggacaagcaagaaattgctctcttctcttctctgtggagacactgagcagatgcgatgtagacctcaacagagtaagaggcctggacctttcctctagtaagagaaggccatgaagaaatagggccagaaaaactcatgctacatgtatgtgcagatgtatgtgaaggcctgttgtcatgtagggaatcatctgctaccatttttctgccttatgcattgaggcatctgaagcaaacccagagttttgccgtgtgaaaatccttcctagctaccttgctcttacaatgcaggtagacagccacacccattgaatgattttgaatcagttaatgtgaaactgttagctctggatcatatttacaaaatgtttccatcgtccttcttgccctcaggtgctaccaaggtgatcactgggcttgaattgattactaggccccaatacattgcatcttaatggagataatgcaagtggatacttcctcgtttacattaatcgaaccagaaggcagtagaaactgaaatatcagtgaactatcaaaccactactacagttgatatcttggcccattttttagctaaggctgctaattatgcagaataatgtccacctacttttctgtttcccaataatgttaatgataagaagctgaaatgagaccaccattacatgacctttctggaaaagaggctaatctccatggaaatgtttagattccaattggctcaattcattggttcattcagaataggattattattgggagcttctaggaatttgggttcaagtgtccaaggaaagagaagttgttttgctgtcccaaagcaccagggccgtctaccgcacaagaaatggggttgatgagtgtgctacaattaatccatgtctattgttgaaattattctcagtggacatgtgacatttccttcactttgtctaggagcatatagagaaataccaagttccacacaagccaaggggtggggaccactgattgctttgtgacactggggaagttactgagaccacggtgacataggattaggaggctgctcatttcttcaaattgcaccatcagacatagcaaataaaaatccaagagacaactaaattattccaaaaatccactggttgatattttagtgcttactaaatactgtatcaaatactgtatattgctacaattacttgctgttcgtatgaaattttaactgtgtgtcctgtattttatgtggcagcagtatttcaaggggtgagtagtatttctcatgccattagtattttcagtggcattagaaatcctagttagaaatactgataccatcttaggcttatttctattgataaaagattttttagaaaatatttcagattgtgagaatctttattttcagtaaaataagacatggtgatatattatttataatttattaaagcttgtctgaggattcagaaagcaaagacagcatcaagctacagagatcagcagtggtaatacacacctttaatcccagcagccagaagtcaggaggtggtggtacacacctttaatcctaaaactccaggattaagagatagacggatatctgtgactccaaggccacccagatctacacaagattgatccagtcctaaagagaaacagctcacacaaaggtgatctcagcacctggaatcacatgtctttaattccagcactagatgggtacaaaagatagaagcagggtcttcagtagtcagtaccaggcattcattctccagctacattgaggataggaagacatttaagtatcagtattctccagccacgctgagaagaggcagcaggtggaggtttggtgaagccaggatcacatctgggtcttttatttatcgtgctacaataagagcagacagatggagacacagatagtcctcatcttcccttgcaatgggcagaatggttagacaggaaaatgaggtaccactctgatttccttttgtaattctttgtgaatcaaaagtatatctagtccgtggtgaaacagtgcagcaaaattgcactgtacagatgctgcattccaaggagcagtgatgcttttcatctagagatactttgtgagagacactgtaacagtgactcatgccccatcttcttctatagaattgcatgcaagcctcaaagtgttgagcatttaaacatatgtgtacattggtcctggcttgtaatattttcatgctttcaaattgcttgatcattttgtattacaagtagtcatggagactacagggacattagttctgaaagtaacttcatggtgttgtatgcctcctcatgataacacttgtcagctacctggccctgtgagtgagagtgtcacccactgattagagaagaaactcagctcagacttagcatattgattgagactgttggatgaaaaggtggcttttgtaagaaaacccctcagatcttcagcccccagtgcacaggtctttctattaggtcaaattatggtctgtgtaatgagtttaaattttataccttggatagttttgagaatgtgccactgaaaaggatactggcatctttcctgagtgcatgaagactggtacctcactagttgttgtgccttatcctgacttgatctcatcagagatttcactaaaatgtagatgttccagtgtctctgcatatcaggattgaacctgcactgtcagcctcacacttggctctttcatacctcttccttccttggttcttcagcatgctgcacctacaacattatctccatagactttctgagatgcaatgacaggaaattaatgaaaacaaggatggtaagggatacttctgtgttttcaatcttcctggtactttaacctctcttcctttacattgtctctttacatccagacatactccctgcccctgattctgattcagtcctcttaggcaaatgtcctaggtagcttgagccacagtaagtttgtgaaatatgcagcaatattatttcaagtctccacattccccagagacccttcactaacttctagccggtgtgtccaaacttttgacactgtgatacttgttgcctacagagcccaggctcaagaactgcacagcagaatttttttaatctcatatgttgagtatgtttcttgtgtgttgtactgcattcctaggtatctgcagtcacatgcagcctataaaacacaggttggacataactacaacttggtctcaataaagttttaacaccaaaactaaatgtaatagtatatcatatatttacatatatttacttatctatttttgaaagtggcaatagaacacatatgactttaaaatgatacaaagaattaataaaaggtgagaaataaagatatccctggctgtactttggaacctaactcatgtgtccactatcaatcttgacagtgtatcccactctgatctgcactattacttcatttgaataatggtatcttgttactttgagaaaaaaaaacattaccaagctataataatgaaggagaaggcaaccaatggaacagtagacagctcagaaatgagctcataccttgcaatccattgagttttgaaaaatttgccaagaattatgatgaaggaaggaaaatctcttcagctactgatattgagaaaactgaatattcaaatgtagataaaagaatgacattggatgcttgtctgatggcctatacaagtcaactgaaaattgtttaaaaacttaagcaaatgttctatggcagtgggctgagcaaacagcttttctagatatgacctcaaatgtacagacaacaaaatggaagtttattaaaataaaaagcttccacatatccaaagataaaatcaacagagatactacagaaatggatataattttcaaactatgtatctgataaggactgatatccaaaatatataagggattcaaacaactcaataagaataaaataaacactccaattgaaaatggatgaacagcctaaacctgtacttctcaaaggaaggcatcatcatggcaaatgggcaatgaaaagaatgctcaaagccacacatcatcagagaaacccaagttaaaaaaaatcataaagccatcacttcatatgcactcaaatggcaactatcaagaaagcaaaagatgagtcttgatgagctggagaggtgctctgtactctgcatgctattgatggtattgtaacttgatatacccaatacaaaaaaaaaaaacactatagaagtttctcaaattattacagtgagaactgtccattgatctaggaaccccactactatataaacattcacaggaaatgaaaccaatatattgaagacatagatgtgctctaatatttactatataattaaacatcataatcaagacatgaaatcaaagttcccattaaaagacagagtaattgtgtttatacacaacttaatgatatttggctgtaaaaataatggaaatccttccattaaaaaaatgaattctgagcttatgttaagtgaaaaaagcccagaacaggtaacacatgatctcatttacatgtgatacataagaagttgatctcatagaaacagagcatagaatgatggttaccaagggctaaaataatggggaaaagagaatatggtgacagaattaaaaaataggggcctagagagatggcataaaggttaagagcactggctgctcttccagaggaccaggctgaatgtctgacacccacaaggtgacggctcacagccatctgtaactccagtccagtggcgaatcacttataaatggcgcccaagcaggacccaaagccaaaattccaggagggtgagagagtgctgtgctttcatgggcctcttctctatgaagcaaagtgtgtaaaggttgccataaagaacaaacaagtgaaatactttatccattacagtggttggaataaaaatagtactgtgaggcctaggcgctctgaaaaatatttgaaggcacgtgaggatattgtagcccttttgcctgttcctgaaggagctccctcagtacaccaccccctcttgacctctagttgggatgaatgggttccagaaagccgagtacttaaatatgttgacatcaatttgcagaaacagtgagagcttcaaaagcccaatcaggaacagtatgcagagggcaagatgagaggggctgcttcaggaaagaagacatctggtctgcaacagaaaaacgttgaagtgaaaacaaaaaagaccaagcagaaaacaccctgaaaaggagatagtggcagtaccagtgagacacctcagcctcctaggaagaaaagagcccgggtagatccactgttgaaaatgaagaaacattcgtgaacagagttgaagttaaagtaaagatcccggaagagctgaaaccatggcttgtggatgactgggatcaccagacaaaaacagcttttttatcttcctgccaagaagaatgtggattccattttggaggattatgcaaactataagaagtctcgaggaaacacagataataaggatatgctgttaacagttcttcaatgtaatgctgggcactcagctactctataaatctgagagaccaaagtgtgctgagattcttgcagatcaccctgatgtgccatgtctcaggtgtatggagcgccacattgactgagattatttgtgcaaattggagcaatgttggcacctctagatgagaaaagccttgctttattactgaactatctacatgatttcctcaagtacctggtgaagaatttggcaactttgttcagtgccagtgattatgaagtggctcctcctgagtaacattggaaagccgtgttacattatatataatacacattgtattatattaaattgtatgttatattatatatagtacacattatattatgttacattatacataatatatatattatatatatatattatatgtacaaatgtatttatacatatgtgtgtataacagttgatgtttaatatatgtatatatacacatataaatatgcatatacatcaacaatttaaaaaagagaccatgaatttgagagagaacaagggcatgcaagggagtttgagtaaagaaaagaaacttggaaagtgatgtgtttatattataacttttaaaatactattttaaaaaaccaacacatttttcagaagatctgtgctccaatagtcacccttcccttatttaaggccatcttgtacttataataaaatgattctcagggaagattttattattcccgtattatatgggaagcactccagaagacaaatgcctgttccttatctataaaggctttcacatggcagatccatagctcctggctctccatattgaatgctgctcactgtggggacactaatttcctttactctctaacacaatgtgaaaccacttaggagaaacagttgatgtttaattctaaagaaagttctagaacactctgattgtgttttctgcttttattcagctcgaaacatccatcttgctctccttttgctttggggttttgctagctagcccatcttttcctctgtttatagagtggtatacatataccttaaaccacttcctattcataggccacaaatataacctgtgatctcttacgacaaaatagagctattttccaaccatagcagtggatagtttataatatcttttcatcttaaaggacaaagaagatagagtgaaatgtccagttatctgccttgcaatgtctgaagtctgtatccttaaatgcctgcttgttggggaggcaaggcagccttcccgaaatactggcaggcatggttttcccttgtgggtttaattctggaagcacaaaagatgctctaacctttctggccatctatgtggtaccgcagagaggtccaccagcctacactgatcactgagaagaaataaaaatgaccatgactgtgagagctgagggcagaggggcaatccatgcttcccatcgcagcagagctctgtgattctttaaatgtaaactgagggtttggctggatagccagccgcctctgcagcctcagaaacatggtattagtgaaatgtcagcttgcgttaagatcaccagtggcctttgctgctcacatgcttccatgtttctgcacaaagataggggagcgcggccatgcctctgccccagagatcgatcggccttcgtgtctgatattaccttacatcgctggggccaggtgggtgtgagagggaggaagggcggggagcaaggggagcatgtttactcactgaaccttgagtgcagctttagcaagtggccaggcggcggttgaatcactgaactcactgctgctggaagccctctgttagggtctgaggtgataagaacagatctctgaggagttgaatgtctgcatgagctaaactcagggcagtcaggctgaagacgatgtgtgctctaacctgtttgcactgaatactctccataaataatttacagcccggactgctcgctattattgcaaagataccggattgcattttgacacatgcatccagcttgtaagtcgatagctacagtttcacccagtgtgtgcagacttggcttaagtcacccatccaagtgtgttttccaataatgtaatttaacactctcaaaccagagtgggaagagagctctaagaagccattgccttccatgagacaatagattgtccttccagtctgtattctatttttcctaataaatgagtttatggttttctcctacttggcattaacatctttatgaatacaaagccattttcacataatggtaaaacaaaattatttggatgtgaaaaatactcttttgttctcctgattcaaggaatgtcttccatggcaacacctggtgttttctctgagacagccttgatccagagagcattttactatggtcagttttagcctcctcccccctttacatccaaaatagttatagatgtccgcaggcactctgtcttcccatgggtgatgctagtttccccatgaagactaaacctgtgagtttttacgttttcacgaatgtgaaaaacagcctgcactgtctgtactctaagaaaacttagggtaaaccatcctaataagtaagcaagagatgagcctcattaatgctactcaggatcactgataaagttacttaactccttccaggttattttttcttaaatgaaagtgtgaaatgctgactctgatgctgcactgtctctaggatcaatcaaccacagagttgcagtgtctcccttgtttttttcagaaggcacatttacatgcaaccagggattgcatgcatttttaataagaaactccactctatgtacacgtggcaggaagaaaatagatgtttgtgttgggtgtaccaatagtaatacatgcatctaaaattatctgctagagatttaaaaggagaatcctgggtggaggacaaaagaggtgataaacgatggttgcaggtgaggtgatactaaaatattgacatgtcaaagtagaatgtgtttgaaagtaagcagttaatagcatacactattttctcagtaaaatatctattctacaagggggttcttacaacacgaagaaagcatccttggggatgggaagagttttccatcgcagtgttttctagatctactcacatggatactaacagtacttgtgatggctaatcttggttgctaactgcttgtgaaacaaaccagagccaagctgctgagtgtccttgtgagggattttctgagcagactacatttgaagcagtaagacccaccctgaatctggaccgcaacttcttgtggcagcccacatagatgaatgtggaagaaggaagcttcgctgtgtgcctgcttcccctcacacttgctggcatgttcatctattttgttgttgctgaggtattatttaaccactattagaacttcttttggtttccaaaattgacaagaagaccactggtagcccgtaagtcctttaggccttcggttccagacttggactgttaagactgctggccttttgctctgaagaattcctctgttctcagcctctccagtacgagttagccactgttgggctatccagactgcattctgtatgccaatttatgatttcccctttaacatatatctcttctatcagctctgttcctttagagaaccctgaataaaaacagtcctttcatgaaacacatgtatttcttgacagaggcttaataaacagcccatagggctgtgtattctgcaaacatatttgtagttggcctaaaagaagtaattttgatcttcctgctcccttatgtcctcctctcccctcctcttctccccttctctttctcttaattccctctcccctcccacaatgttcccaatttgctcaggagatcttgtccttttcccctattgagtcgggcgtaaaattcaggagagcaagaaaagaggtaccataacaaaggaagccattacaggtctaaagagaaatctggcactaagaaaatgtccagagatctacaagtttgacccaaactaagaatctaagcaatatttcatattaatattaaatgcccttcccctataatgagattgatgactaccttacatgtcatcctagagccagtagacacccacagctaaacactgaactgacctcctggaatccagttacaggaagggaggagtgataaacaaaggggtcaagaccagactgtagaaacccacagaaacagctgacctgaacaagggagagctcatggaccccagacagatagctgggaatctagcataggactgatccagaccccctgattgtgggtgtcaattaagaggcctgggctgtctatgtgtctctggcaatggagcagtatttatccttggtgtataaatggactttgggatcccattccacatagagggatactctctcagcctagatacattgaagagggcctaggccagctccaaatgatgtgaccgactttgaagatccccatgagaggcctcaccctccctagggagcagaaaggggatgagatgggggatgggtcggtgggggggctaggggaggaggagaggaagtgggaactgggattgacatgtaaaacaagattgtttctaattcaaattaaaaaaattatattaaaaacaaagtaattttgaaatatacaagttactttttatgaataataataatgataataataagaaagaatcttgctaagtaattcaggctggcatcaagctcaccgtcctcctactccagccctctggatgctagggttgcagtcatggaagtcctcacctggccactaatgggttaatcaataggtctgagcaactaaactacttatcagctctttcaaaggtgacaaaaacaaatcagtatcgacaaatgccatctagtagcattaagttatttataagagaaaattatgtgctaagggttgttcagtctaatgtgctgattaagaaaaatcgtggaaaaaaaaagaaaagaaaagaaaaatcatggcatgcagttaaggcaagagaccaccttggaattgtttttaataaggtagtgttgcttccatgcatatttatgtctttgctctttattcccattctcatggggtctatctcaagctgttttctggatgcttgccttcactcccgttgccactctgtgtgttagtcttctggggaggcactcctctccagccagcctaccggtgggctttccttggttgtttccagcacaaggactcatggctgcccttagccctacctcaacttctgttaaaatgataggttctctcaacaagatcatctttattattagaattgatttagtacaaggtggctttagggtaaatcagttttcatatagggtctcaaaacttctcagagctcatgcctaacccagcatgcagcagtcaaagcatttgtatcccatcagcatctatctgtcctctgctaaactctccctcgtttcaggcaagaacagctgttagctgtgatgagtaagatgtctgtctgttgtgagcaggtaaaacacgtggtaattaaaataaggagttaaacttggtacatttgagaatacaagtctccacagaatagtaattctaaaaggaaaagaaaaaacataatcatttgctttgtccatttgttggaaagggaatttcagagttaacagcagactatggattttcaatcagaatagcattatgtagaatgaaaaatgttgctggctgcacttataatgtaataccattgcttttcttcacagcatttcaactatccccatcctaatgagtctcagtaaacacagaggctctcaaatagataaagacttcaatgtataaaaatatgctgactatgagattcattgcacaaatacagatgtagtaaatcctattttaaaagttaccttgagaagaatgtgagccaccgttcactggtcaatgtataaaaatatgctgactatgagattcattgcacaaatacagacgtagtaaatcctattttaaaagttaccttgagaagaatgtgagccaccgtcccctccctttgctttttttttctttcttttttttctttcttttttttttttttttttttttttttttttggttagcccttccttttcttcataatcaaaaccacaagaaggacagaagaatgatcctaccacaggtcttggtgctgcctccagaagtcttccctaagcaacccctctacgttgaaggatgcagagggcatctgggatgctctgtatgattccagtgttaacatggatcactttgctaggtcttctacatgttaccctcaaagacacagcatacccaggctagagatggagagaaggaataaatcaatatatttcaaaggtgaaggttttgcattcccagacagagtgcaagagctttgagtgcctgtacttgaacagtaaatgctgaactgatgtttgctgagtaactatctccaaagagagaaagcaaatgctgcggcccctgtgggttctaaagagccacagtggttacttagaagaaggcattcatgcttttcatatgttcaagttaatccgttttcattcacaattgtgagattttgtcttccctttttaaaaaatggaatttaaatgaaacagttagaaacgtgaatccctgttctcaaaagtccttaactcagctgcatgttgcattcatatgttggtttgtaattcacctaacaagtgctgtgtgcaagacagcagcaagtgtgtgctctagagaatgaacccgattccaatgcacgtttactaagtcatcactatacctttttgttccatattggaggacatgaagaaaataggattttcctatctgcgagtatcggtcctctgttgcccccgagttgtatctctaattaaactgatctctttcctttcgcgaataaaggccctgtggtctttatattaatccccagtacacatacaaagaaactacttgtgacaaaatcaccaagcatatgatgcgctggacgccactgtctcagttcctgagtatttatattccattttccatcctctttccattttcatttttcttttcatctgtagttttactttccaatctcagtaggtgagttggtggtagctttctaaagtaaatagaaagtattctacattccctgattctccgtggatggcacaaaaggactgttattgctacattcaggctgcacttaattgctgccaaattctgaaccacaaacacgggcttgatcacccaaagacgtgggtgatggatagctactccagccatctattcagccatccatctctgtagaaaaaatggtgatcgctggagacaggggagctgacatcagcagagatgaccacaggagtcagatataaaggcagctgaggaagggaattggtctgcaatctgttctccgaggcttgatgtgaaagaggggaattttagtcacttttgttcagacactttgcagatcgttcagtgcaaagaaaatggcatatctctagagggtagggatccacaaaaatttagtagagcttgtaggtcaaagctattgatcatataactttgctaaaattctgaaagatggaaaacacacgccaaggcaaactgtacacacatcaatccatcagctgcttgagtctattttatggattggaacattgttattgaaaaaagcttctactatgtccacaacaaagccaatgaacgtgtcatggttattacccttaatatcaatcctgataatgtcttgctatctaaatatagaagaaacttctgggatttgagttagcatacatcaaaaattgaattgtatgatgagtgagcttgatggttttaagcaaacagaatcttataatgctacttgtatgagtaagtagtaaaaatatcaatccttcacattttttgttgtgggaggtttaataatatccccccaaatatatgttcacataaaacttaagattgtatgtgaattcaaaataagtatctttatagatatacctcgcctaagtaactcaagtggagactatactgggttagaataacccctacatccattgacaggtgtttttatatgaagacagaaacatacaagaggaaaggttatgaagacagaggaggcagaagttaggataacacatctgcaaaccaaggcacaagcaaagactgatgggaaatgacgctatgggaaatgaggaaagagtacagtacagactcctccagaacttcctggagaatccgacccatcagccatcttgatgtccgacttctgatctctagaaatataaaatcaatatatttctgctaactgaagatactcagtctgcattttgtatagtagtcttttcagcccaagttggtgtcaaggtctatgcttctggttcttagccccaactgcctaacatcatattcccacttggttattgtattagtcatgtttctccagagaaataaaaacaacaggaggtgtgtgtgtgtgtgtgtgtgtgtgtgtgtgtgtgtgtgtgtgtgtgttttatttaaagggactggctcacatgattatgggaggtagcagggctgaaatcagtagggcaagctagccggttggaggtttggatgggggactggctcacatgattatggcagggggcagggctgaaatcagtagggcaagctagccggttggaggtttggatgggaattattgttgtaatctttactctgaaggctgaagtctgtgttgcagtaaggaaatagaattccttcttgtagaaatttgtagtctacaaatgatgaataaaacaacatttaaaacatgattttatactcaaacctagattgatgtttgaataaacaactgatcaccgaagcctagccaaatcgatatataaaattaatcatcacagaagccaaaacaatactgtggtaacacagtattacctataatctgatgttcagaggggaaacatgttcaaacaattgtatttgtattttcaacttcaaatcaaaaataaataaaacaacaaaaagttctcaaagaatcaaaaaaattgattgccacaaaaaaaacagaaacaagcaaaactgtccatcccctctctccacttctattcaacacaatgcttgaggtcttagctagtagaataaaggaagggagtaaaagaaatgcaaatactaaaagaaatcaaagtagagattgcagataatatgaatctaaatgtaagaggcattgtccactggactacaaacttgttagagctgctaataaggttcagcaaagtggcagtacacaaagtgaacacacaaaaacaacacacttcctaatatccatgacaaacatacttttatcattgacactgaagagtaaaacaggcaaacaaacaaaacaatcccattcaacacacacacacacacacacacacacacacacacacacacagcagagcacatacacataattaaagacactgaataaggccacagtggcacaggaaggagtatcaacaatcaacagacaagatcttatgaaactaaaaagcttctgtacagcaaaggacactttcccacagaatgaggaaaaaaaatacacataattaaagacactgaataaggccacagtggcacaggaaggagtatcaacaatcaacagacaagatcttatgaaactaaaaagcttctgtacagcaaaggacactttcccacagaatgaggaaaaaaatctttgacagctatctttctgggtgtggatgattggtgactagaacatataaagaactcaaaaagtcaaacattaagaaattaaacagttcaatctaaacataggctatggaactaaacagaaaatccttagaagaaaagaatatacgtgaccagaaaaaaattcttaaagtgttaaacctccctattcttcagggaaaagcaaactataattattttaaaattccatctcaccgcagtcagaaaggctatcagcaggaatacaaatgtcaaccagtgctggtgtggatggagcaaaaggaaacacttttgggaaatagtgtaatcagtttgaaaggttcttaaaacctggacatagaacttgcgtatgagccagccacaccttcctgggtatctacccaacagacttctaaccccctagaggaactcccacttgcaggtacattgccctgccaagctctcaaattctgggggggatttgtttgttagctgaatttcttgttttattttctgtatgttttgtttttggtcacggatcaccccagtcgggtataggagtccctaggattagggtcctcgaagaataggtgggtaaggattcggtggtgacaaacagaaacaaacacagaggcagtttaaatcagagttctcaaagaaggttttttatagagatattttctcaggggatgtttttgttaaacaaacccaaacatatgacattgttgttacttggcacagtgacactgaaatccaaaacatagaatcatccagggttaatcaaaacaaaattgtccttgattaatcaaaacataagactgtccttgattaacataggatcatccaaggctaaccacaatttcttaaatcaaattaatatattttatggtaagttattgtttaacatctattacctagttcttgtgagtttttgaagtattgagctatttttactattttaactctttcttattaaaagcttttgttaccagacacttaagcccactttcgatgacacatgaacagccatatgaaattttattgttgggaaagcttttactatttgtacttatgtgaatgtcgtgaatgatttggaaagtgctggtttttcctgagatggggtcatggctagtgaccccgtctcaggggatggtttcttatctgtttcttttgtttaaaacatcagcataggtttgtaggaacattttgttaatgcggaaaaaaaaaaagaatagaagaacaaacagaaattgccacgagaatcacagcccaatattttttctctggctgagggttccagaacagtttcaggagacctccttcttttgaagttgtctcctcagtctgtggaacttgtcacacagaatctactggatttggtgtggcaggttttttaagtttgtttttttcattttgcataccagccccaactcccccttcctccccctcccctacccctcttcctcattccactgcatccaaaaagtctggcataccaagttgaagcaaaaacaagccccccccccccccccccccccccaaaccctgagcagggggcccaccccaaaaaggccagttcatgtactcaggataagtcctggtcctgctgccagcccctccccatcaggccacataactgtcacccacattcagagtgtctagttcagtcctgttttaaacgtcttctggatggcaaagagatgcaatgacttcatttcactggggaaaggtggagccctagggcagcaaccctctcaccaatcattttcatcaaagctcacctgtacgatccccatggcctggtgtctcccagggctcttggcaagtcctcaaatttccttcctgtttcatagcatacccatatatttgtctcttaggatattaaatcgtgaatctttaaaaatacatttttttttctgatccttgcattcactttggggttttgcttctggtgtgtgtgtgtgtgtgtgtgtgtgtgtgtgtgtgtgtgtggggggtgtggggggggtgtgtgtgtgtgtgtatgtggtgtgtgtgggatgtgtgtgtgtgtgtggggtgtgtgtgtggtgtgtgtgtgtgtttgtatgtggggtgtgtgtggggtgtgtgtgtgtgtgtgtgtggtgtatgtcaggtgtgtgtgtggtgtgtgtggtgtgagtgtggtgtgtgtgggatgtgtgtgtgtgtgtggtgtgtgtggtgtgtgtgtgtgtgtgtgtgtgtgtggtgtgtgtggtgtgtgtgtgtgtgtgtgtgtgtgtggtgtgtgtggtgtgtgtgtgtgtgtgtgtgtgtgtggtgtgtgtggtgtgtgtgtgtgtgtgtgtgtgtgtggtgtgtgtggtgtgtgtgtgtgtgtgtgtgtgtgtggtgtgtgtggtgtgtgtgtgtgtgtgtgtgtgtgtggtgtgtgtggtgtgtgtgtgtgtgtgtgtgtgtgtggtgtgtgtggtgtgtgtgtgtgtgtgtgtgtgtgtggtgtgtgtggtgtgtgtgtgtgtgtgtgtgtgtgtggtgtgtgtggtgtgtgtgtgtgtgtgtgtgtgtgtggtgtgtgtggtgtgtgtgtgtgtgtgtgtgtgtgtgtgtgtgtacatgtggaagcagaggttgctgtccaccgtcttttttgagacaaagtctttcactgaagttggaatttaccagctcagctaggctgagtgactggtaagtccctcacctcctcctgcctgtgcctgtcccgcgcgatagtctcgccagcaagaaccacacaggacattcggatccttctgcagtaaagctttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcagcaagtgcctgtgcaaccactaccttaccttttttgtttgggttttgagtctacacacagtcccaagcataaacaccacaccactgtagagaattgtgccaaaaagtcccacccccacccattccttagcataggagacagcgaagcgatccatgatgacaatccctccgtcaaggacaggagttaatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccctatatgacgccatggaataggcggggctaggcagtggaaaaacactgggcacatggataccaacgttgtttacttgatccggcagtggatgtcagcgccatcttgtaatggcgaatgtgagtgcggctcctcacatgtgcctgcccagtgctgggattaaaggtcacaccacaatgtctggctttcatgtgagcactgggcttctgaacccaggtcctagctctggcctgatgggttctgtactaatggagcccatctccctggcctggttttgccttctttttgtttttcaaaaacctcttaaaatcttcctctattttcatctctgttcattttctctttccttgtggttaagaatgtttgtaaatatttcactacttgctataccagatctgttgtgtaaagagacaagtatctgatagcctgggcaactcatccttttctttccactaacacattttgtattcttttaaaacaataaaagcctacctggtttaaatgctcagatcctgaatttggggttagataaacccgttttaaattctagggttgttattttacgagtatgtgattttctgcctgtcactcaactgtcctgccaagtctagcagtcacctaaaaatgcattgattgaaaagcatctattgaattggataattagaaggtcattggtgaccttcactgggtgccttccatagagtgatgagggcagaagccaggcttcactgggactcattcattaattgtgtttctgccactggattgcatgcctgtctcctccagcagtccccagcagagctgagagttacctgaaccttgtggtctctgcttattttgccagatgctttagtatttccatgtgctgccaggttgtaagcatgcttttccttcaaggctcatatcagccagctgttgcaacaagcttcaaatgctccctgcaaactgacgggagtctgaaagccctcagaggtctgaagggagcaggaaagcaaaagagcagcaaagcaaaaggttgcttagggaggcagtgtggaagcatgaacaggggtggagaatatcttgacaataatatcgacaaaaagaagggaaaccttgaaggaaaaatattccagcaagaaaagggaggagggaaaagccattctcagaattctccacctggccctctctggtttgccaaaccccctgtaattagcaggaccttccaatataacccttgcccaaagcagagaagctgatggctaaagacgtgccatgatggaaggcagacgtgaatcggatagttcactttgtatcacttgcagttcttcctgggcaggagctgcctggagatcgtcctgctagggctcacttgcaggaggcttaggttaccctttgatggaaatttatttcaaggctctaagttctagtcagcactttcgaccctcacaggagatcgtcctgctagggctcacttgcaggaggcttaggtcaccctttgatggaaatttatttcaaggctctaagttctagtcagcactttgtttcctcaatcctaaaggactgtttgtttgttttctggttttactacacaatccattttcataaactattgcccagctgcacacgttgctagaaaactagcagaaacaaaatgtccttatttgttcagctcagaaataaatttaaaattctctagacttgggaacagtaaatgaaaggctgaaaaaatactttttagtacagagattcaatgccaacttagggatctttgtacctgagaaataattcttatgaatcccttttttattaaaaaaaggactcatatataaattgatataattggagtttattctagtactttctaaaaaatcataatattgcttataaaattctccatgaaagtcctcatcttaatcatcagtcagcattttattatattatcatccttaattgattgacgtttaatcacagtctttgtattttactatcccttgtctcataagaggcaattttctctttactgtagtttaacagctgatgaaaaagatttaaggaaacctataaacttaagattggttaatggtcccttataaaagaatattatacttctaggatccattgcacagatgtgatgctcaattgtagaaatgtgcatggggtttattaaattacagcacaaatcttcagtcttctgagttattgtccatgttgggattgttaggcaaatggggagacacattattgcttccagttgttcgcattactgtggtgcgagacagctggcgcattgctgtaggcaagtgtggcacttcagcagctgctgagaactgggcccaagtgaaggtccagctccgctgagtcagtgttgaccacttcatcaaggctttccagaacatgggaaataaatgaaccaagctggctgtcagagagcggggggacagcagtgaggaagagggctgacaaccgtgggggtgggggagtgggaattaccttggatgcatagagctccttgttacactggcattacttcctgggagccctgccttcctgtgcagagctgattatttacaaacagcctttagactttagttggttggttttggttttgagacaggatctcattctgtatctctctttggctggaactcatcatcttgcccaagtggccttcaaactcttggcaagtcccacttccgaagtcagacccttaagtactagaattctgtgattgattgattgagcctttgcctttggacattttcatgaggaagcactttaactctgtgtgctgatactttgtgttaaaaagttgctgttgtgttttcctttgctttggctttaacactgtagtacctccagatctcaaaataagggaagataacaagacaaacagaagtgcttttggttttggaatctgaacaacaacaacaaaaggccctgggtgaaatatccccattgatattgataatggggtgattgctcctaaaaccccatttttctcatttgcagatgagctatgtaccctatgagggtggcatgtcacagctgtgagcccctagcatgctgcctgggattccacatgtaagcagtgaccaccagttctttcactattgtagtcactgtcacttaatctttttatttgtttttatgtgtgagctgtatgtgcatgtgttcatgtgtgtgcccatagcatgagtgctcacgggtgtacctgatgcacatctggaggccagaggccaactctgtgtgcctttatcactgtctaccttattttttgagactaaatctcccactgaaccaaggtctattggttcactagactgcctggacagtgagcctgagccatctggtgctcagccttctccatgttgggattgcagatgtgtccaccacccactctcagtatttcatgtgggtgctggggacccaaactcaggttctcatgcttgtgtgtagcaagcactttaccaaccaagccataccctctccccattgttgacactgtgatttgagagaataaaaccaaagttcctaaaagttagagtgggacttggttatacccccacacacactaaattatttaaaagtatctacaaagtctcactcaaaggcagaaaaatgtcataacaaagaaagagcccaattttaattcacaaataagtctctacctatatgatgcctagaaagtaactctctacaggctttactgtctcattcctcccacagaatgggaacaataataatgctacttgcctactgtgattgttctggaaattaaagttcctgtatgtgtgcacaccatttatcatggtgtcaataaaataaagagcatctagcaaatggtatctacttaacgtaagtcctaactcttggattgtattctccagttattataattttcttactttattatccgagactgagttatgtttaaaatcctgtttctgcgtgtcctttgcttaggttattcctagtgtgaccagaaatttttagcaaaatttaggacaaaggtaatgtaaagatcattgtctggcaaacactcagtcacccaatactaactgaaagactatttattgtactcgcaggaagttccaggggaagatagggggaaaacacacctgggaggaaggaaaaacaggggtcaaagtaaacacaatcaacatcatataaaattctcaaagaattaataatttattaataattagtaaaatatattaaaaacatctaaattttttgaaatactactctactccagaaactgtgttgagttctcagaacacaaaaatgagttacagaacgtcggtgtggtcaggctaaataattgtccagataaatttagtcctgaaaacaatgctgttgctctgaaagctgctaacgcaggaggtttcagagtccccaaaaatgcagctcaaacctacagccgagggttattaaatgtctattgtgcattttcttcgctgtctctccactggcctgtattcccactctcctgtggggattgtctctcaggaaggtctccggtgtgctttccactgaccaagctagcaaacaaagcagcgtggatagtgcattttttggtgtgactttccaaggtccgaagcagatccaaaaggagctgtcctttcttcttgtcgcgaatcctttctagaatattctaatctaaagggcaacctccctcagtttcctcggaagtggcttccacctggaccccacctctaaatgactgacccaagcacatgaccatggaaactgctggttccattgtttatttgctgtttcctccctttgcacctgtgcctaaaataactgctgaccacgcaagtacttaataaatatggatcaaatttgggcaaggactcactattagggagtcagttacagctattacaaataataattgcataaagctgcaaatcctcagagaagtatttgctgaagacttgaaatcagtggtaactagagcttgagttgtggagccttgaaagaggagccagacctacggggcacaggagagaaaaaccaggctgtctcaggagggtaagcaccacaggaagctgagagctatgggcaaatgagtcacacaacttcttgttccaagtcttaatttactttcctaataccaccccgccccgccctggatttatccctagtgatgtccattgatgctatcaaggtccattgatgccacgtctctagtcaatggaccaatctttggagcggtctgaacggagcgtgaacatgtccagccacattctgccctgctcttgatttccccttcgcatcttccagccagtgcaaaggccttgggggtgtccagttcctctattgtgtctcccaaccaccatttcacctttaaactaccacctgtctttggttatagaaaaggaaactaagataaaagaggggggggagaaacttggctaatttagtcattttgtttgaaagatcaatcagttccctaggaaagatttttctggcaggagaatcggagtacctgggatccaaaagcagcgtctccggccctggcactccgttagctgtcagcagtaatcacacttacatcctcgttccgggcctccagctaggaggggatgcctttacactctccctgccggcttgcaaagctctccccgacacatgcacacacagacacagctgagtggagctgggaacaagtgcctggcaccaagatccctccagcaggtgtataccaactcgcccattctgtgcttggcacagaccatcaagacccaggatgggctccagggtgaggaatttgtgtacagctggataaatcgactgcaagttcaggagtaaagaccactgctagaacctgaggaggctccacattaaccaagcacgggtgtctcccatttccgtttgcagtggggtggcctcgccgtaacagacctctgccttgacttggacttttccaggaacgtgctagcttgaaaaacgcaccaacccgcgcacacaaggttacagtctggtgccttttgcccctcacctctaaatatttcagtgacctagcacagacttcattcataatgagtcccctgaaggaagccaggcagagctcagaacatgttgggttaacttttctccctgggcgtctgctttatggaatacagctcagctctgcattttcatagcagagtgtctgtgcctttgcactgagcccggagcaggagcgccttattaaaaaggacttctaggtacccttgggctggaggagagcctcaggccagggtaattaaaatgtagccttgaacaacatgaccatatgatgtgtgacctatgatgagagattatcaaatgattttaattgcagggagaaaagaaaaaggcatacacgtccacaacagtaaactgcctccacggccgcactttggtaaatgaataactgttagaggtgaattctcacacacagaaaaactcctatacactccgaaatacccccttcctactagtatttaagtgttgctgagtcatgtcaggttttgccacttaattcatttttattcctattaagttttgtttataagttttctgtgattatcaagcataaaatagaaatactctctctgtctctccatacccactgtccatttttgaaggagttaacacttggtccttgcttcttctcgcctttgatttcagcataaaatgaagagcagtttcttccacaaatggagcgtcctgagtggaacgcccactgaggacaggaagggatggatggggactgagcgttctgagtggaatgtccactgaggacaggaagggatggatggggactgtggaaaactatatgactgaacaaaagaaacagcagttgccaccatcaaccagttgtcgctatgttcagatgcgcagtccatgattttcaagaaaagccagagacaaagatgaaaagtcaaaatggagttcaaaacttgtctgaactattcatccctgattactgcatgaatcaaagaaagtcagtcttcatactcaatttgacatctttgctgcctgtatcgggtctaattttcaaagaaatccatgcaccacatccactcttcgtgtttacttcataagcagcatcatgcaacagagagaaagagagagagagagagagagagagagagagagagaggacctgggaacagtgccctgctatagtgggaaattaccaatacggagtcaggtagaaatataagggcatttaatagggaaaagccttacttacagagcaacctagccagccggtgggtcagcagcctgtaaggcaagaagcaaagagaaaccgaaagtgcaaacgcagtcacactcactctgaccacgccctcacaagcgtggtcaggcacacctgtagccagcccctaagtaggcgtggctacagctttccctacaccctgcacttcagcacttcagtccccactggccattatctttcttgtgatgggtgtgaacttctctaccttcctcactttgcgcaaaagagagtagaggaaattttatttgaccttctacgtatgctgcaaggtcccaatgtccaagacacttaagctcttctcctctgtgtccttttatcactttgtctgggtctacattttagcctgttgaccagctgaaagtattgattcacatcagtatcaaagacctcttcacaccagggtcacctggaggactccttcaaacagacttctgagatccgcccctgcaattccacaatcaataggcctgaggtggcccccaaaatctgcattcagctgccagatgctggtggtctggagaccacacattgctctgctcagggccgtggtggtttatgaacagctctccagtgctggcacggtgaataccccctccatttacagcatgaatggcagccactttggcttccttgtattcgtgatctgtccatgtcagttagaaagtagtggatgatccagagatgcccttgcagagaattctcatatctcaaatgcatgtagaatcaagaatcttggaaattctttcattgccacgatcacataattcaatgaaagcattttataaatggagaaacacgttgtagcaattggatcatcagtataagagccaagaccctccagcatctttttcttctaattggctaaaaagcatagttttcttctaattggctaaaacctatgataacaattaggaacttatttctggactatataaagtagattaaaatgctgggaatgaagcaaatacattctcaaaatatgctggacatccaacagagcaaaatattctgcaagtccactctcatgattggcatttttcttctgttactaattccacatgcctaggaaccatgacaagacaaaaaaaaaaaaaaagcaaaatatacctacttaagatgtttgtgtttccctttaaataacagagctttctttgcaggactggagagaataattattgtatttgcaaactatagtaatgagttacattaattttcaactcaagaatagataaattctataaagtaaaagaaaactgttaaaatattatatggcaatccttgcccaaacagtctttttcctttgttcagctcattgaaggccattgccacctcattcccactccttccacgactcgagaggatttcatctttcatggatttgaccagtgtctgttattagccgagccctgttttctgtgtcatgaatctagtagtcaatcaaggagttttaacatctgaccttgagaagtttctggctttgtgtgtactacagcagttttaaacaagcaaagagtgcagttgtagaccattgcaagctctgtaaaacaaaaacagagggtaaatgatagcaatgaggggagggtcctttaatagagagccaaagagtggcatttgatctgcctgagatggagacatgccagggtccagccttggctcgggttcaggtcctgagatgaggaagggatgtcacctcagggaaaaattctgatcatccggtggatgcactcaagggaccctgaataactcaagctctcttaattatacttgaaccgagttttttttctaccaggattacatgaacagctttattattgactacttttcacttttaagaactacatcataattattataaaagcaccattattcccctttatgcttccccaaatacaccttcccaccccctgaataacctcactgtagacatagagttcaggatttttgcaggccttaactgagtattgagccagacacatcctgcccttgcagcacttatgtcagctggcagctacttgtggttacaaagttaaaaagtaatagacataggtacaatgctttaaggacaacagtattcaaagccaaccaattctttcacatctgcaagatatgcttttatgcagttcccatttctacaggagggtcccatgactcagtctctctgtaaaaggcagacttggacaagcactcttttcccatctcattataccatgcttctttcaccaatacaagctactgtattggtgggaaggatctacccttcccatattttacattgcatttccccattgaatcttactagatcctattattaattctatatgcttggtgtacagggtacttaactctcaacagttggcactatgtgtattcctgaagctttttccctattctctgtatgcatgccttactctcctttccagaactgacagacatggctaatgttccaagtgttgttttctcatatgtacctaactgtctctatttagagtcagaaaggctcccaggattaggagttgtagttagtaattccagatgagaaatttgagaagcattagccccctgctgattctaaggggaaagcatttgagaaagaacagaatgtccagagaaaattacatctgttgcctatgtgacttacaaaataaaactaaaaactgacaaaaaatcagcaatataatgagagagaaaagagttgcatgaatttagcagagtcctgtgctaccctgcagtctactggtctttgccaagtgagagacggtcttccatgggtcttgcctcatggagaccaattggacaggcattctttggctgctccaatactaggctgcatggatcccaacagaaagagagggaaacctggacagaggactgtgagaaccagggcctggggtagaaatgggcatgccatttttagaagatgatgaaaaggccagtgtagatgaggagtgggaggagaggaggtttttatgtgttgctgtgataaataccacaaccaaaaacaaactagggaggaacaggtttatgtcagcttacgcttccatgtaacagtccatcactgggggatgtcagggcaggaagtgaagcagaaaccatgggaatagtgacaactatggtcaacattttcctgaggattttagtacacacaacataagactgaaaatatctagattccaatcactgctatccagtctttaaggaacttgaaaagtgtgactacttctaaacagaaacactgtcaaaatgtctcagccttgagctaactcagctattagaagtatcagacagtggctgtgaaacagctcttttactccataaggtaaagctaagagctctataaataagtgagaatggaagttcttgccaatgattatcaagtataagttaacttttaaaaaatacatgtaaatgtattatttattttaataaaaaatattttgacattaaaatttaattatatcattttcccaatccctttcctctttctgacccttcccaggtatccctttctctatatatggaattacatgcacacacatgtattcatatatatcccttagtatataaattctgtctgcctatgatttcagggtgtgacatatttggataatccttccacacttctactgtgcaactctttaacacagtccaatcagtctttttctgtcttagtaactgtttttacttcctctactcttcacttcttcccctccttatcccccttttttctacatatgctcaatttattttactattagtatttattttgtttcagtcaccatccattctttagtctattgttttcaagactttacatttaaaaatgtatggaaataagtcctatgtaggtggccagtgaaattccttcttgctaagtgcaatgacagtatcacccacactgttctgtgaatgtgtctttatggattacaatgccagtgaaagaagatggtcacctttccatgcctgtcatagtattatcacaatagcaaggaaatggagctaggctagatacccatcgacagaagaacagatactaaaaaagtatgtgcatagatatataacaggattttactttattacttagaaagatgaaattataactttgtatggacctgaaaaggaatacaggagatgatcagtctcagaaaaactagacatcttgctcatatgcagagattggatgagtagggttgtttggaaattacatgtaacacgctttggctagagtttaaactgtgaggcaggaaatgaccataaataagtctggtgaatctggcagataggaaataacatagccttgggggttatttctcacataagttcagctgtatgattttttaaaataaatattttattttacttttaatgtgtgcatgcgtgtgcaattttccttcatccaatctccacaaataccggcccttacaactgatgcttgttaaacatctgaatgcatctcagatgtcccttgctctcaatatctcattgcatttattcctcagaagtaccttgagacagatattatagagctgctgtaaccatcattttaatgatccaaagcaaagaaacaagagggggttaagtgattggcatgagaagatgaaggatgaagaatctaaatgcagggattttaatccccaaaacgtttcattgtgctcaaagaatttctttccacctatgcacactcagcttggacatcacctctggagcactgagcgccatcatcttctaagattggttagaaacctctggggggtctccctactcacttgcacctctcttataatagggatgatttggcagaataattatgttgatgtacaaccacaaatatagctcctaggtagtatagattctgtttatagaacttgatatctaaagcaccttgcaaagtgcttcccacagtagtcaccctgtaagtacttgttttgctaggcgtaaacagctttctttatgaaacatctgtgcttaaataacactgttaatccgtattcaagtctcctgtcagtactcaagtgtgtcttaaataaaaagaaacttgtacagtccccctcctatttcccaagattatgcttaatgctgtgatccctttcttgatcaaagtctgtccaattaaccaaacctaaaatctagggatcatccactatttgtctctcgtgatcaataactgattaatcagacaccaaatactgtcaaatacatctttgggtcttttgaacctttcttcttccctgtaaacccactctgcctgtgtttccatccattccagcaatattacaaggcattgtgatcacttacacatgttatcatttcctcttcttgccactgagctgcagtattcttgagaaaaaagtggatattgctttacccctgtatccctacatcaaggctttttgagtaataacttggggcatggaccaaatgatccaccttcacattctaatgactattagctcaaactttgtagtgacctaaggagaaaagttctctcagcaggaactatgcgtttgatacatgttacagatgttcagaaacatcccgtctattctctcctgctaggtgttttctaggattgcatttccttgcccagttgaaagttatgtgagcatgacttgacctcagtcaatgaaataaagttagataaaggctaaagagaagttttaggagacaatatgtgcattcacacacatggtcctctaacttcagtaatcatgatcagggaagtgtgtgagaatgaaattctagtcacatgaaatgtaaattagaaacataaactcatgttgaaaccccaatgggttttaggattggcagtgcaatgtgccttagcctgtcatacccagtgtaatatccttaagtgctggtgttgttgtttttttttcttttttggagtccccatgtttaggtgagaatttgtgtttgcccctttcctgtcccacagatgttcttatccatgtgaattaaaagaagtcttgaattggtactcaagttccaatctggcaatatacagtttaagaatcatacatagaagttgggtgtggtggcacacacctttaatcccatcactcaggaggcagaagtaggaggatctctgtgagtttgaggccagcctggtctacaaagctagtttccaggacaactagggctgttaatagagaaatcctgtctcaaacaaacagtatgcacaatgaaaatgtcaaccatattgacttgaaggataattatggctgttggtatgtaagaaagaagagtgggatggctctttggtttatgtcagcctttaccgtcttctgacttgaagcatgtatccagagaagaatgacaaatgttagatctgggttatttgattattacaacttcaagtgggaagcataatagcataactacacctgttaagcatttataatttgtactgatggcaacttgtctcagaagaagctacataggagccagtatttctcatcaccaggtcctccttgctagaagtaagacattaatcacaatttctactcaaagtatcccagaggtcttaattttttaattaaaacataattgtatataattttccctggcccgtttctccctccaacatctaccatctaccaacttgcttcctctcaaattcttgacttcttttcaattgttattgccatacacacaccacacacacaaaccacacgtccttcttagtccagtgttacttgtatgtataggatttcagggctgaccattttatattgaataaccaatgagaaggctcattcctgggaaaactgtttctcccagtcttagcattccttagttgcttgtcaatctttgtctaggggtgtggcctgtgaggttcccccttccgtgttagcagtctgctggtgtccttcttccgggcttgtttagcagccaaactgttgcggtgccgtgggtgcagctcccctgtgatttgtgggagcaggaactcatagtgtgcttcccagttcttgactctgggcatctttcccccattcgctttcttgatgctccctgcactgtaggtgtaggaattgtgctgtagatgggtcaactgggcctgggcacctcacgatcagttgctctctgcattttggatgggttgtggtcttctctaatggtctctgttgcaaagagaagttcattggtaagtggtgagagatttacttatcctgtatctatcttaactgtatatctatcttaaactgtatattgccagagtatgaagataagtatttaaattgcagttaagaattgtgctggtttagcaaagttatggtagtaggttgtcctccaagatgtataactctgtagccctgatagtcgggctaggcttgcagcaccagacctgacttccctcctggtggctttgaattcagttagatttccgttggttaccaccaagatacaagtgccactctcacaaccctagggaaatcttgccatggtgagcattgttacgatttataggcattactgccaggtaggacatactgtcactgagttttaaggcagtaataaaaattatagtgaatacactttgcatttttctaagtttccacttatgtgctcagtagccctactatatacagatgataaatcccatgagaaagaaatcagggaaacatcacccttcacaatatccacaagcaacataaaatatcttggggtaacactaaccaaaaaagtgaaagacctgtacagtaagaactttgagactttaaagaaagaaattaaagaagataccagaaaatgtttcctagagtttctaatccttttctatttcattttcattcttattttcctgcttatggtggtctgcttctgttctttatatgcttgccttttctttgatgtaacagaaccaaatagctggcaggaagcaacctaagggcagaagtgtttattccatgcaacgatttaaggggatccaatcgatcatgtcgagaagacacagcaccagccaggtgaggcagctggtaacactgcacttgcagtcaggatgcaggaatgacaggtgctggtgtccagcctgctttctccattttattcagactaggacctctgcccagagattagtgccatccacattcagggtgggtgatcccaccttacagacctaatctcaaaatttcctcacagatctacctagaggcttgtttcctccaggactggagttcctgccaggttggcagtcaatataaaccaccgcactcactttctgcctgcactcacagaaggtcggacagctcttctcctctgtgaaataggtcattggtcagaagaggcttgccattgtacttcagttcaaacaaccactccttgaaggaatacaagccaagctccacatagcactttttgttgggttgtgtgtagcagacgtaccctgtcaacaccaactccattaactcttggttccctcagacaaaactatgcctatgttaaaacattttgttcatcttccatggtaataccattctgctttgcctgacttgccttcttgaaaatatttctttctcatactccagacacagacttccctaaggacacttgttgttttatttttatttatttatttgtctgtttatttatttatttatttatttatttatggtttttgagacagagtttctctgtgttgctttggagcctgtcctagcactcactctgtaaaccaggctggcctcaaactcacagagatctgcctgcctctgcctcccaaatgctggggattaaaggcgtgcaccaccatcgcctggctgacttcgtgttttatttgtctttgtgcttctgcttgctcagagcctaatacaccactttcagattagaatgcatgaagtcacactagacactatggaacagaaacagtatgaaatcccatcacctgcatttaacttcaaagaaactgaaaagtttcgtcttaaaaacaattgggcaccaattgtatgtcaagaagagaatccataattcaaagattaactatcttgtatctattggagccagatggagaggaagaacacttcttaaagttttctaaagcaatcaatgctatattctgcaggaagggaaaatcatctccactttgttctcacagaagccagcagtcttcaccagccattggatggcactagggggctctaattcatgattcatatgccaggatgaattagtgaaattaatggaaattcttgaaacacttccagggtggaccacctattttcagccatgtataaactggacttcgatcctcagaggatttctttggattcagctctgacccttgagaccatcaccacatagaagcctggctggggtacctgaagcccagtatgcccctgggtaacatgcaggcttgtggccatatggtgtccccagagcctgctgtcctctgatctatgccagaataggcatatgctgggatatttcaggaccctgaggggagagtgaaatgtcatagcgtgaggatgatgaggtgaggcttccatttctcttgtttatggcaggagtagaaattcaaggaggagaagtaaaagacactgctcttgattctaaagcttgcatagttcagcttaggaaacacaagacagaacttatgggttccctggggaacaaccgttttatttattttaaataagcttaaattttaaaaaatgacagcagaatccagttttgaattttagtcactgggcctctctcaggtcttgatgtattcatgctatgaacaaataaatacgtggaatatagtttactggtgatgactttttccttttgctgtttgtttggtggggacttaggtcaggggaagagatgcctgaggaatggattcattacttcaggagtttgttgtggctaaaaagcatagactttttaccattttcctctcaagttccttatgaacaagtgactgttccattcagttgctttgagatgctctgaggcttgtgtatggggctaaagaagcccggtccaagggggtcacccttcccgacaagcattctgacagacaatgaaggtggggggaaaccacagcttggggagtctgtcagatggtgaggaagaaagcttataacgaaacccatttcttgagaagatatgagcatggacacatagaggatcactggggagagagctacacaggggagcatcaaaaagcaggcgctgtgtttgcacctgaatgagtgagaaacaaatgcaagaaagtacagcacagaagttgattttattcctaactgaaggttgcctgattctagaaggttcccttcactgcttcagaagagatggtcccatttgcgagcgttcacaagctgtgactgcacattgatcatttgtctaaacactgtttagtgtggctaacaaagcccgtgatgcatgctaaacccagtttcatacagtgaaatggtgggctttccttctcgggatgaaaaaaacaaaacaaaaactacttttagattcatgtccttttcattttggtacagtgaagcattatataaatccaatttttgccacatctgaaacgttggctgtcattttaaaataatacacatgtacattttgttaattgaccaaataaacaaacaaagacagaacccaaaataaatgaactcttctagtgactggatataaaagtatggtcttcttcatatgatggttacaaatcagacagagcaaaattcagagcacaaggctctgtgtaggctctgttagccaacagtttcttgcaggaagataattagggcctcactagaatctttctaaagcataaagcaaaataagggttaagggtacatatatacatagtaaaggacttgcctgacaggagcagggtcctgggttacatccataactccacaaaaacaaaaggattttactttattttttgtttgttttttaattttttaattttaattagaaagaagattattttacatgtcattcccaggtcactcttctccctcctctcctccccctccccccaattaacaccctacctatcccataccctttctgctccccagggagggtgaggccttccgtagggggtcttcagagtctgtcatatcctttgggatagggcctaggcccacccccttgtgtctaggctcagggagtatccctccatctgggatgagctcccaaattccattcctatgctagggataagtactcatccactacaaggggccccatagatttccgaggtctcctcactgacacccacattcagggggtttggtcaatcatgctggtttcccagttatcaatctgggaaccaagagctctttcttgttcaggtcagctgttgttgtgggtttcaccagcctggtctggacccctatgctcatctgtcctccttctctgcaactggaatccacactgccagagaagctagtaaacaaggaggattttaaaatagtagaatttcatcttacccatacatcaaatgactcgcgccgttattctagcattcaggaggggtggcatgaggattgccatgattggaggccagtctggtttccggaattagttaccagacaatccaagttgcagtgtgagaacttgtctcaaaaaaaaaaaaaaaaaatcccaaatcaaataagagtatgacatagatgtgtgtgtgtttaaaaagagagataataaaaaaataaaacaagtagttttctatttctagatatgtaaaagagattgtgttatgtagttgtgaacagacgcaaaagcataaattaatatacacagtccaagaagcagttatctttataaataaatccgttaggattcaacattgacgctgacagtccttggtcaatgttaagaccgcgccaccttctggtcgccacgtgtatgacagctgcatgtttacagactagcatttttgctttatgtaaaacttatattgaaggaaaacaacaaacagtcgacttgtgcggtttcttctcccccggggatgcagtgggatacgaacacaattcctaaatgtactccagtggctgctgtacttgaaaacccgagacttgctttcgagcttactccactgtaatggttcacaacagaccacacacaaccagacagggctgcgattttaagagctagagggtttggttgcctgtcttttccctggttgtcagtctctgaacttcttacagtctgagaaacggcacttcaacaagggaagtcgagcctttgccaggcagggaaagcagatgcggacgatgccatgtctctccaaagcaaaacaataaaaaacatgtaggctattttctgaacaactgttaggacataattgtggacaaatgacgacttggggaattatactctgcttaaattcctccatagttacagttagataagtagtgttgccacggccttcgacgacccagctgtaaaacaaggagggaatgacatacctttgctaacaagcttagcggacctatgacctgcaattttgagcatgcttctcccataatttgcatatgaaaactagtgcttgaaaaggcaatcacagccaggcagtgatgtcacatgtctttaggcctagcactcaggaggcagaggcaagcagatctcagtgagtttgaggtcagcctggtctaaatagcgagttccaggacagttacacagagaaaccctgtctcaagcaactgaagaaaagaaggaaggaaggaaggaaggaaggaaggaaggaaggaaggaaggaaggaaggaaggaaaagaaatgactatcacaaaggcaaggtatttccccatgtgcaccccatgtgtattctttaggatttgtatatcttaatcagaaatagtatcagaaaccttgaaatcttatattcataaatatgtatgaagaggcaaatacattgacaggagaacagtaaacttaattcactgttttgtgactttcccctagtaaattgcttgagatttcttgggtaagtggccctgtcattctgcctgctgcccgcttcagtttgtcacccctaaaaacaaaccagaaagttgatactaaagaacagaaaacactgtgattttactgtaaccaccaagatcttttccttaactttccatttcacattaacctgtagacgaaactttagctttcctaaagaaaacccacttatgaatctacaagtaaaagaatgtaggagtgtttggggaaaggagggtacaggcttaatcaaaactgcaaagtcattggctttcactggtgttgggatttgcttcatataagatttaattatggctgggtggtggtgaggcacgcctttaatcccagcactcgggaggcagaggcaggaggatctctgtgagttcgagaccagcctggactacatagtgagttccaggacagcctccaaagccacagagaaaccctgtctcgaaacccctcaaaaaaagatttaattatgaagagtaaatatttcaaagggaagtttcaaaagaacaccccatggctaccaagatggctccgtgtgtgaaggtatctgcccctaacctggtaaccctggaacttacatggtggaaggagacaaccaaatccttcaaggtctcttttgacctccacacactcacacactaaacaaataaataaaatgtaaaaagagtaccttaatttttaattactcgtctgatggcattctatgctgaaggacgcacaggagtgctttataccacagaactaaatgacccaagtgtgagactgacagggatgaatgcaccaggtaaatacaacctcttaacatacaccaaacacgggtgcaatgtagaagccaagtgaaggaactcccaccatttgagaatcaaggttaccgatgatagaaacagtcttcattagtcttcagcagaatttcacaggttcttggcaatgtgaatatatcaacaaacaagggacgggaaatttttcctctagttagaaaggcaaccgataaatgtgaaggaagttaggaatttccatttggaaactgtcagaaaaactggttcagagatgagtgattaccaggccctacaaccaataggccaaggtttgctggtatgcaacacaggaaggtgaagtgaagaaacatagtaagttcccctggcagtcaccaaagcctcagcagcaggctgccttcacatctctttcttcctaataccaacagagctttctaaatccacggactacatgaggtacattctatgaaacagttggcttatgctaaaaactaccaagtcagcatcacaaagtgcaaatgaaaacctaaagtctgtcccagatttaaaaagactacagagacctaacaggcaagtatagccaggaccactggtttcttcctcaggacattaagttaatttggaaaatctgtcccaattttactctcctggctttattaactaagctatggtttcataaaaattactatttttgtaatatacaagctaaaatatttagaagtaaatgagcttcctctttataatcagttgaaaacaaaacaaaaagccagagcaaatattgatgttaatggaattatgtttaagagaattcttccaggcaaatggatagaactagaaaaatgccatcctgagtgaggtaactcaaatccagaaagacgaacatatgtattcacttataaatgagtattagctgtaaagtaaaggatgaccatgctaaaaatccacagtcccaaagaggctgggtaacaaggagggcccaagggggacatctgaatctccctgggaaagggaaatagagaagatttcatgggtgatctgggtgcgggtggcaacgggaacatgagggagcaggtgggggtgggttttgggaggagagtactggaaaagtccactagaaagggggggcgggcatttcagagtcagggagaaaactggtacaagggaaactccaggaatctacaaggatgaccccagccaagatatgtagcctgaactggtcatctcctgagaccaggcaagactcaagtgggattgggacatgacacaaccacataaacttcaacatacagtctgtcctgcctacgggatgtactggggtcagggtaacacagagactgtggaaatagccagtcattgactggtccaggagtgaacccactcctgacactgcctggagccccaggacacagagcctgggtggccagagacctaggaaagacgaaacaacgggaggaaaaagtgtcaatgtaactatgcctaataatatcctgctgtgatcatagattggagcccagtccaacagtcatcagagaggcttcatccaacaactggtggaaacagatgcagcaacccacagccaaacattagacaagacttggggaatcttgctgaagagagggaagaaggattgtaggagccaaggggtcaaggacatcacaagaaaacccacagaatcaacctgggctcatagggactcacagagaccgaaacaacagtcagggaacctgcatgggactgacctaggccctctgtacatatgtgacagttgcctagcttggtcttctggcaggactcataacagtgggggcagtggttgtctgtgactctttggctggcttttgaaaccctattcctcatactggattaccttgtccgactttaacataaggtgaggtgctgagtcttactataacttgatatgccatgttttgttgatatccaaggaaggcctgatcttttctgaatagaaatgaggaggagtggatcagaggggtagaggggaggtaagggggaaggactgggaggagaggagggaggagaaactgtgactgggatggaaaataaattcattaaaaacaaataaataaagctacactgataatatttctttcaaaaaagaattcttcagattttttctagcaatctttctacaagtctaagactttcaaaggataagtttagtaaaaaaaaaaaaaaaagtgataaaatgaccttgctttcactgatgagtaaaggtggcacacacctttaatcccagcacttgggaggcagaggcaggtggatctctgtgagtttgagaccagactggtctacagagtgagtttcaggacagcaggactacacagagaaaccgtgtctcaaaaaaaaaaaaatcaagacaaaataaaaatatactttactttttatttgtttaggtaaaactctgacaactagaaatccatctttaattcaaaagatgtgttattttagtctcgcatagaccgaacttcaaacagttaggtgaaattggaaagcatgtccatgtctttttgaagcaactttccacgcccagctgtgtcagtgcttcatcatgtatttcattcaaaaatcctttggatgtcccatttgcaaccagccagtgagtcagactcggttcccctgcctaagacacacacagctacttctggagagtctatgtaagtgtaaccaaagtggaaacaccaatgggaaaaaatagtcggtgatgttaaggagtctggaaacaacatcctgaaggcacaagttagggaactgaagtagctagagggatagcaggtgtgtgctttgtgctgggttctccccaaaacctgttattgtcaatgtgcttggtccaagggactgatgagaattgcaaagcatgctgggtatggaccagaacctgttcttcactgtaaatctgaccctgttggttggtagtgaggagcccctgaaggttccaagcaggacaggatcctgccaggtgtgtatatcatggtgcttactgctccgccttccacgttggttctttcactcacttatcaactacttccttatcaaatgaccctttaagatgagctgctacaccatggaacacatgacaaaaacaaagtatgacttccttttcaacattattgcccatcctagaatctctgtgcatgtttttcctgtaggacaaattacttatgtttaaatgcctctgtacattgtactttaatctgttttaatgagtgtgtatctctgtgtatgcctttgagtttgtgtgtgtgtatgtgtgtgtgcacatgtatgtatgcacgtctctgtgtgtatgcatttgtgtttgtgtgtgtgtgtttgtgtgtgtgtgtgtgtgtgtgtgtgttaacgtctttttgaaactctgaaacttgctgtctttattaagctgatagaaggagaaagcacttgaagctaactatggggcatgtaaggcaaaatgtattttccctagccagccttgaggcagccaatttaaattttacagagcacttacactcagtgccagcaggtgatgttggaagtatagatttccttaaagcatcttttcagttcattgacttaacaacattcctgtcacttacgtatataacataaagtaattgtttcatttatataactttgaaatataattagctaatatttaattatttatcacaatgtggcacaatcatttatatttccttcttaatatactaattatgttaacagcctctaagttctaagtactgtagcgttctgttttatggtgtttgaaagatagcaatgtacagaacataaatttcactatgtgaattcacatattgtcgttattttcaaaatatgatctttattgcaagggtcagcagaggggaaattactcagtttagatttctccatcaaagattccattgtatataaaatgtttgcttggcaagagcagtaaatgtaaggatgtgagcatgcagagggtggccccagggagatgggttgggtgctcaggaaaacagcacaggcttctctaactgacaacatacataagggaggtttgtttgtttgcttgtctgttttgaagctgagttggaaatctgttaatgacagaacattattccagaaaagcataaaagtatgcgtattccagataataaatgttggtgtttcaaagaaattctagtgcattaaaaaccattttaatgtccatgcattttgactttatatttgaatctttgttctatttctatcagacaatccagacaactgctcagccacctgtggcccagcttccttgtatataaaatgcaaagcagagtggtccatccttggctgtctatcttcttgtctcttgacacctgtcttgggaaaatggggattaaaaggctgttgagaagaacacactcattgctgcaactcacagtctggacttttgcctcgtcttttaaccctctggctggaatcatctagtcttgaaatcctacttcaaattttaggtattctagctcactttcaaatgacttttgatagcatcaaatttctgccttaaattgtaggcatataaaataatgttaatagttgtgactagtatgtcatgaattgacaaatacaccatgatttttgaagtccatagtttttttggctctgtcaagatagcacaaggagtttttttttttcatttggccccatctgacttcttcttcattcccaattatgggctctcatgtacaaagaggaaacaaacggattgactaaagattaatcatcagcagaaagtatggcaagggataacagtatctcatgtgctatgaacacaatggcagatgtcaggcccaggactcatatctctcttgctatggttgcaagttatttcccaggctctgaggaaagggcctccttgaatttcatgaagaacacagagggtcttgcatcttgtccatgccaattcaatgtatctgagatcctggaagtctattggcactttattgtgttatgggtaaattggtataagccaatttaagactccccattccagtttccttgccatggtcctcaccttggtgaatttaggcctctatatcagaggtgtcacagcataagtcacagttttcagtaatttcaagctcagagaagaaactgttgtctgtggtccaagctgacagctaatacctggtggaggaagcatcaaggcccaggcccctctctgttcctctctttccccactgtgtgtggaaagttacctggcctctctgaactgtggtagttgttattcatcatttgtcatttggagatggcaaaaccaactttaatgtcattgtgagagttttcatgaccatcttttcctggcaatctggcaaaaaataataatctcttcactaagtctcagttaccactcttcggttgctttaatgctttgtcagtttgaaccctcctaattgtgcacttcaaagatgagattgagtgtctttgttaaatcttaaaaataagtgacactcctatacaccactacgtatgcgaacattgatttttcaaggtaatcctttccctgggataataggaatggagcggaaagtgccgtttgttactctcagagggccgcgacacttccaactgagaggaaagcattttgattccccaccaaacattttcttctccctaataaagatacattttgcatatttaaggttttcatttttcccagtaaagatactgagggtctctaatatctcaggtgtgagggtgtcagaccctcagctcccacccaggacaggttctcaacctgttgggcatcataacatgtcatatcacagcatatcatatcataccatatcaggccatgcccattattattgtatttcaatatgagttcctgcagggtgtggccatacctgagggcagaggataaatttaatgacctcttgatgtctattccaactgaatgattccctactaagtagtgatagtgtcatggtactgtgaattttggaggccattcccaggtccacgtgctaacagggaaaagataactagataaaacaattgttgtgcactatttgctcaagtggttactgaggctaagatttcctttcttttaaaagatagttactccttaatgacatggaaaatggcataatctccataggctgtatttttctctacttgaaaccacgatcattaattcctacccatttacataaaagaaacacagacttagtactgaaaaaaaagagtttcctctgatatttgtatatttgtataccctccctgttggaaacaggagttcggtccgggttgtaggctgagtctcagggacctaaaggcactgccacctccacaggcatgctctgaagccggcactccagccttctctgtgtctgacaaaacccgagccctttccaagctgtttaactcacgattatttctcttgttgccttttctttgaaaattaatttcagatgtgaaatggccatgtttaaataattcattaaaaaaataaatccagaggaacgtggcaaaggtagggagaaacccagcgaagtacaaagcaggggtcgagttggatgtggctgtctgagagaatttcttactccagagtgtttaattaggcctgcctgtctgtttggccctgggttggttttgttctttcaagagagctgttgacctaatactgcagtaaaacacacggagaggtagcttctcatggttcaggaaaacatttgtaaatgctgtgattttggcattgaaggaaaaaaaaaagacagaaaagtgcgcctctaaccgagggaaattcatacatttataattgcattttttaatagtataggcagcttttcagctttacccattatacaaaccagtcagacaacattgttaaatgtaagcaactaaatgcccagaagaaccttaactataaagccaagcgcttctgcaacttttccagaatcttccagccagacaattaattgaactaacgcagtgaagtttatggcttctggcactgttgccatgcttacagaagcattttaaatgttacattcttaaaccttctagatcaattagtttgtgatagaagccaatctccaggtctaacattacttttttgtgctgatgtatcattttccataataagcattttttaaaagaactaattagtacctacttgccctagagaaagtgacatattgattagacattcacccccacgttgtgaggagactccaactaccatcttcatcccctagctcaagtttgggtgggcatctagaatagtacaagggaggggggactcaaccctgttgttgggaaagaaatcagagggtctgttgtctgataaactagctatacgctctactgtttttacaatcaaagctgcccaaagacacaccacctcaagtactcaataagtccattttaatttcccttccaggaaaacaccatggtgtttctccttttgcataatacaaatatgtttctgtctaatgctctgttactgaaaacacagtcttcaaagttactgttcaaaatatccatctggctggataagtgctctgctgtcttgttttgttttcccaagtctctgatgaggagatgtttgtcatttaattgctgctaaggatcacagatgatggtttataggtttaggcaaattgtggacagcactttgttcacaaacacaagagcatgccggtacaccataattatcctatagagctcaattggctcttaacagcacccgcccggccagcttcagggagtcttgtttccacacaaaggctccttcttgttaattaacctgtgtatgctcattacaaatgaaacctatttgttgccagttaatatatttgctgctacttgatatattcatttattcttatccttgttaagtggaggttggaggggaaacatcatttgggtgactcagatccctgggcttgaaaagagcagcaaatagactgacatatcagttggattgccctgtgctcagtgggcccccaaatctgcttaagaatgatgagtatctgtctctcaaccatgaaaacaaaacaggggcaattgagaagcaaggcatccatgacagaaaccagagacttttcattaggggagattcttctaagcaattcatgtgacgcttgacttcatttctctgtctgcctcctgactattatgtacgcacgtgcagaaaagattggatgtgggcaaatggtttggactctccttacggctggcctcagccaagagaaatcacatgtttgctcttggtgatgtagtaagcaaaggtagtctgaggctgacgagggcttcagaatagcatatgtcatgaggatagcaattgaaaatcaaagagagacaatatctatccctttcttagcagattttatataaaacccagatgtaaagtagctaattatcactcaaaattttatactcttagaatctacatttttccactgcttatttttaaaatagtcttagggttttggcgatttgaaattgtttttacatgttggttactcttcttccaaatttattttgggtatattcttgccatccatctttttcgaggtaaagaaataaactattttacaaattatcttaaatgataaagacttttcgcaagtggaaggaagaggctcctattcctaccaatatgaagtactaaaaatacaaaactttgagcattgctgtccagaatattctttatgctttgttgcgtcaaaagattgtgcttatgtgacttcaagtaagtgtgcttaactgcatacagtgttcaaaacacacttaaatattgatggacaaacattcccacagccaccaatcaattactttgattcttggattttagaattggtctgataatgcattttagaataggtcaatactgccttctacatagagtaatatgtctaatttgtttctattcatcatgatcatgtagttaagaacgatatgctttaaagccccaatttgtcactgagaagatgactatggaaaattgacaaaaattacaggcatcattttgtcaaaagacaacatgttctcatggatatgtgtatcccatgtgatacttgggatagagtatttcatttatattttttaaaaatattttattatttatttgtgtgtgtgtgtgtgtgtgtgtgtgtgtgtgtgcatgcctgtgtttgcatgtatgcatgcctttgtgtatgtgtgcctgtgtgtgccttctgtgcatgtgtgactgtgtgtgtgcctttgtatgtttgtctgtgtatatgtctgtgtgcctgtgtgtgtgtctgtgtgtgtgtgtgtgtgtgtgtgtgtgtgtgtatgtctatgtgtgtacctgtgtgtgtgaggccagaagagggcatcaaaccctctggatctagaggtacagatggttatcaagatctagtatgggtgttagaaacagacctctggcactcttaagcactgagtcatttctttcaccctcacacctaatacccaacacaaaagaaaccagggctatctttctgtgcatagactgaagcaccatttaaagaagctcatgattagaggagatgctgtgactcggaccttcggagatcccataccttctgaacacaagttcttccttagcagtgccaggtgtttactgtggacctgcatgggaagtgtttttgtccagaaactctgtatgacatctgttatcattgtactattgttactttggctactaccactttgggactgttagcataaaaggagcccccaaaaagggagcatggaggttcatcctgcctctttttaaaaagcctcagtcactaaagaagtcagagtcactatgtaacctgcgaaatgtgctgagttttgaatctgaatgtctctctgttttccttgtgataacagcaatctttgtatcttggttgaatatttttgttttgtcatgtcgtgattttccttagcagagctgtggggaaaggaggaaaactgaactcacttgactcctggtacacatacatatgtggtaaagttataactcttttataaaattggtgctgaatttacttcaccgtaataagcataaaattttattctcctacaaaatccatacttacaagagtgttcttatatcttttaggatttctttagtacatagaaagatacttaaaattcatctagacctatcacttatatgaacctttacatcacccactcaccacaccgttctgaggagaccatatgctgcctcaaacacctatgtacaactgcacctacttatgtaacacacaatgtaggcattttatctatgcagacgttttgtcacctattaatagcagtagactatataaatctagccctcaaatgtaaatctaacaatcacgtagtattagtaagaagaaaattttaacactcaattgtattcctgtaactggtccaggcttagctcttagctgaatactcataactgctatggtttctagacacacacacacacacacacacacacacacacacctcaataagcaagtatcagggcaggcagagcatgttgcaccatctaggtagaaaacaccaagaggtggtatagcaaacaaccacaggaggcgctcaacttgagccagactctgtaagaagttcagagggtagcagcatggagtgtagtagggaggcattccaagcagggagctgacaaaacttcagagatggaaatgccttaggcaagctctcatggtttggaagtgcacttttctttactcacatcatcaaagttcgaacaacattttcaacataaggagcattatcatcaaattatcggtgtcttagcagccatattgccacaattaatctattctaataggccactcaggcatgaagattggagattttctgtttttataggcaatttgatttttcagctagaatattttatgacctacttcctacaatatgaagtgccatgagaacactactctcatgttgctgcttaaatagcaaggtcatgacagttttctcccgtctaccatgtagtcattcactaatgcatgcagacattcggtcagcaacccagatcaaacacctactatgtgtcatgtctacactgagccataagcagtttggacaattcggaagaacacctctcaccatctctaccagcagtggctatgaagatactgacgggattaggcaattgtccaaatgaccagcccaaagaatttcagatggtggcagtaatggtatgagatagcaaagggcagtaactagccaggaaatattcatgactgaggtcctcgtgctgcaaaaatttagatgatttcctattggtgactgggaagattagaactgctttgtatcctatccaaacagacaacttctacaaagtagggttgtttgggaatatcacactgattttgaagcaggcttgtgtgtttagagtaaagaccagctgtcatctgtctccatatagtattgactctcatcttgcaaggttattggggcaatcagtaagggacaccagccctgctgtctgtaccagcagaaagcttagcttctaggctttggggtaatttactaaaatcctaaatggggttttccaggtatgtagttattaataatgacatctaattttcttctgtgacatacaaaaattacacagtcacattaacactcactgaattctgctaatttggtcaacaaaggctgacagctgatatgtcagagaaatggatcgccatggcctggtagtcaaaagggaaggctagagcccaggccttcaagttcacctccctcatctgtaaagtatgtgacaagaacaagtgtctcatgccctctctagggcttcaatgaggacttatgaattattatgtgtgaaatggctagaatggtgattgccatattgtccattgtatcacgaggaggtcactgcagcataaagtagaagccacggattaactgtacctttaattgagcaatctaaagacctttcagtaggatagaggatttttggtagtctataaaaattgtatattgttatttaactaaaatgttgatgcatatattataataaaaatttggtgacaaaaacactgatgtatcctgtgtgtttgtttacttaacacatcaaccacagaagaattgtttcttacactcccatctttatgacttttaaggaataaaagattccaatgtattaataaggtaaagtatcttaattgtttcttgtcttttcatactacgctattctaaaactgcctttgaacataagtccactctgtttctctccaactatgtgtaaaagataacaaagatatgttgtatttggctgtgccacagggttggataaaattccatatacacagtagtgacaatgaatgtataacttgaaaaactgctgctgaataataggacacattaatttgataagatttgactgttggcacttgtgctgggcattgagatctcaggaagctccctgaagtaaataccttgatagaaggatcaccatggactttagaaattaaatacaaaagattatgttaatgcggcataagtgggaacatgagaaaatatcaaagttgaagttttagttggaaaatgaatttgaaatgatcgcttatgcatatgcaactttttaattcatgctctctgaggtacatttacactcgcatttagaagtctaattagtaataaaaagggaaacgttcctaatgatggcaccctgctcttagggtccccattatagattctgaaaacaaactcattaatatcttaatctacacgatgccattttctgtacttaaatacttcagcctagaagacataagctttacgtttttatttgcatttagtctcaaagtcagaggcccatggattctatgtcttttaaaaccaaacttttgacatattttccccacaaaataaaacattcaaaaagagaagtagccacgatgttttggaatgtgtgtctttttctaatttttcctgagaaagctaacaggcatttgaactgggagtcatcagaaacatcacttctaaggcttctcttacagtctgttgctggtagactgactgctccttacccttgaggcagctcaacaattgagttaaggaggtattcatgtatctgttctgcctgtcttatggttggcttaacttcaggatatactttgccactgaaggttcatttccttcaatatgttaagtgcttaattataaaggttcacaaaagaattgacacaagcgagaggggctgtctactaccagcctccccaagagacctgtacaagtgtcatctgtagaagcagggcacaaattaaacaatggccgttaacaggctgcctatagctcagggtataatgaaaatagagtttttgcaaaagaacaaagccagctgtaaatgtgacttttctttctctctttttcttattttcattgacatctagatcctatagtatgtcatgcctttaagtttctgttggaaaatttattttaaacccaaactgtaacactgagtaaaatcataatttgtacctatgccgggacttagaatttcattgtactttttgtgatcagttagaaatgcctgtaaagttttaaaaagctggaattgtttcctgaataatcacatattctaaattaaagtaattcaaaacaatgagcaaaatatgagtattctgtgaagtaagtgtactatgagtccatgttttcgtcagacagcaccaggtgtcctgtttttagcagtgacaggtattctaagcaacagcctttctagcatttgaaaagcatgaacaacaaagagaacttcccttcctagggtctgagtgaggtaatggaacagactggaaatggctgcattgtttctactgctcatcaaaacatctctgtgcatagtagtcacgtcattatgtaagacatttgcaaatatgtataatgctttagcctatgggaaaactctcctgctctaatgtattcctgaaagatgaatgaacatttctttaggtatgataaaaagattcagagggctggatacagccatgatattaaaaccacaagctcatcatttaatttttttaatgccaaccgctaacatcataggtctatgttttactttcacttttttttctctgcaaattcaccacttctcttccagttcccattctgattcaagctcagcaccatcctgtttgcttgaggctgcctgctttgatacttcagcggggattctgtgaagtcagaagtattctttggcttcagatctctgatcagggtttctgcttgatctccggattttctgttgcctctgaaacagcttcgaaatttggccacgagcagatacccaccccattgtgttgtttacctgatgaacttagtatcagggcaagagctgtgctttttaggacaaatgttctactcagaaattgtgaaataatgcaaagttttcatttggcttctgaaagatagcaaggagaggcgatgggaggctaactcagctatacaagcatgaggacctgaatttcatctcagaacccatgttaaaaaaaaaaaaagctgagtgtcatggcacacacctaaaatctcatcgatagagagatggagatacataaatccctgggacactggcctatcctatgcagtgagtaccatgccaatgagactgtctcacaaacaaagccgatgactcatgaggaccagcactggcagctgtcctctccacacacttgttcatgggtttactgaagagatagtgatggatttagcacagtgaaagaaactgagatataaatgttggcagagatgtggttacagcacaggtaaactaaattgtcccataattcccagagaagtttgaggaaatagcaaatatctgatagatagaaagccaagtagataggttagagtgaaagaacagcaacagccactgaatatattatctcccggggagattataggatttcatttggtttggggtatgcattgtacgtgtgtgtgtgtgtgtgtgtgtgtgtgtgtgtgtgtgtgtgtaagggtatatatgtatgtatgtatgtgtatatggatatgtgtgtgtgtgtgtataagggtgtatatgtgtgtgtgtttgtgtgtgtgtgtgtgtgtgtgtgtgtgtgtgtgtgtgtaggggtatatatgtatgtatgtatgtgtatatggatatgtgtgtgtgtatgtttgagtgtgtgtgtgcgcatgatgtgcttggggcttgttttgttctgttctgttttgcttcgggaaaaagtgaacagagtctgcttctcacagcctcatctgtggcactcaccgatagcatggaatcaccaggcatttgtgaaaatacttcactatgtaacatataaaataatcacgtaagcaaaggaacccagagaagactgacaaggcagaaacataagcaagcattggcgagttaagagattgcacctatgaagcacaaattggatgctgtgagaaggaacagagaacactagcgttagagcaatgataacccttgagtggacagggaagttgagaccagctgcagtttagaatgagctttcttaggagaggcagcctcagtaacagtcagtcatggtcagaccttgagacgagaaagcttttagaaaccttatgaggaggaagagcaagaagaggaggaggaggaggaggaggaggaggaggaggaggaggaggaagatgaggaggaggagacaagccttcagagaattctcctcaacagagtgtgtcctgacttttacgggtttgatgaaactgcacttgcttccccggcctcctcgtcccccagaagggacgtgtgtgttcccagtccaggccctggttctttgtgtcatagtcaaactgcagagtctatagcctgatttcacagatgggcactacagcatctgcgatttaacaattataaaattaaaataaaacaaaataataggaataagacacattaattttccaaagtgtgtcagaaagacaaaacagtagatgagtgaaaaataaattaatcaaagcaagtacatgttttggttttctgtttgtgctttgatttttattaaatgtgttttgttcatattaaccactcaccccctaattcaccccagagctgctttccttccctattcacccaactttacatctttaaaaaagaaaaaccttcaagactaatttgtgctgcacaaatattcttggatgtggtcttctactggagaaggggtctgctaacttaaaggggtgacaatcttaaaagaaactgtctttctttctatcagcagctaataactgccaataattccatacctagggggaggttttgtgtgcccaactcctctttccatgctgggatttggtctcgctcaggctttgtagatgctgtcttaactactgtgagcgcatatgtgcaggtttcctgtggtgtccggaagataatgttttttgcagtcatccccagcctagtcatccatttcaatcacttcttccacaaggattccacagtctttcgaaagggctgtggggtgcgcattcccttcaaggctgagagagagctctacaatctctaatcttcctcaccctggccaggtgtaggccactgttcaatcaccatcttctgccaagagaaacttcttagatgtgagttaagagattcactaatctatggtgtagtagaattacctatggcttcttggtaatttcctgatatctgtgggcattccaaatgaaacacacacacacacacacacacacacacacacacacacacacacacacacacctagatatccaaagctaacatcaccagatgagagaaaacatgtggcatttatcttaaagagataatgtaagaactagcaaaagaaaagcattcacaactgaaggatatttgtgttcaagttataaaccctaaatccaggggggagtacaaaccaaagaaaatcacattattataaatgtttaggatatcaaagaaactcttaaatattttaagaaaaataataaaagagatgaatagagaagcaaaagacagaccattgcataccaaaaaactcaagaccagaacagtattacagttctcaaaaccagcactagaatgtagaaattgaaaaactgctttcaaaattctaaaacaaaatgactatgctgcctaaattttatgttattgatattctcaactggaattgagaatagaatagatacttatttaaatagaacaggactccaaaaatgctattacattagtttttatggacaatggaagttataattcagaaaaagtgaagtgacataaatataagtcatgaagatgttaccattaaagtaaaaaagattttggggttatttggctggtggatcttattttagctttgctggtttgaaacagctgttagtagcacctcttttattctcacaacaagattcaacgtttaaacgatagaaacccaatctcatattttatgacatttaagacttaaaatttctccatttttggttctgtgtgaaaaatgtaatgaaaccagtagatcaaattatatatgttctgcaacgtatcagaacagaaacacaattatcttgaggctatgaaataattatgttgtgataaacctctcattaataagtgcaattttcctggagtaaagacagtaactaaatgaaataagaacacatgaaactatgttttcagcactcaaactttatgttctatcactcacggaggtcaatagaaaatgtcagtcccaagattcccctcagaacagaagatttaaaagtatgcttgcactatgagcttaatcccaatagtgtacttaagttctttaatgttgttcttagctacctctgcagaagttaagattctcttctgaaaaaaaaaatatattgtaaatgtacacctttttttcaaaggtagtctgggaatggagagatatctcaatggtactgctcttacttaggacttgaggtcagttcccaggacccacctccagacttccacagacacctgcactctcatgcacattcccacagagacagacacacatatacagacaaaaaaaataaatctttaaaaaacagtaacctacacagagctttattagttcagagatttgatgcatacaacctccctaggctcaggacttagtgttttccattcaacaggagggatggttacatttatcagctccacagtatctggctgacagtgattcagtacatggttctgcctcttattagctatgaggtaaagaaacttacaaaaaaaaaaaagcccttctatgctacagtttttgttatatggctgtttctccagtacaggatataactaagcccttcctggaattatcctcataatattagtgggttagtttatttttctccaaaaattggaggaaacaacatatacagttaaaatgttactttcagttgtagcattatattcaacagaaattagcatagaaagaaagataatgtctccatccccctgtgccttgaattttcaatgacttccaatgacatgccttgctaaagctcagtcaccagctactgggaggtaagaaactagagagcggggctggtggagggaagtagagtccttgggagcatgtccttgaagagaactttaggacctttggccatgcatgcctctccatctgggtttctctgcttcctgactacttccaaagcaagcaactttcttctaccatgtgagctgtcatgctgtcctgccatgtcaaagtcccaaacaaccatgggctacaatccctgaatccatgagcccagataaatattttctcctcttcattggttgtctcaattgctacaacactagcaattttgactaactataaataatttttccaagacttcacaaggctgctagaagaatccttggatatgaacctatttttacctctgcaaaataatatagccactaagagactagaaaatgaaaggagaacaaaaagataccctggcaggcacaatacgattctagctggtactcattgtttggggggcctattgtaagaagttccgtgtccgtgttttataaccagatagtaggattatgctagcaagttcttttataaagatgaaacagtcactaaatgggtactcatcagcatctacagaatgcccaaccactcttgtcatttcctttaagatcttagagtttgctttctgttttatttatctttctggttttttccttttatttatttatttttttgttcgtgaaacaagagatgattaaagaattgaagttttctggtgaatgaaacagccagaccacttttcatgacaaagttggtaattagaaggccaatttaatggtgaatcaggcagaaatattcaaaccatgacaaatgactttaataatgcagcttgcaattcttgaactgaaataaatttcacttcctcaaactcttgccttttgctgcctgcctggaagatagaactgtccaggaggtattttgtaccctttattcagtaaagcttttactaggttttaagcgaccaaatagcttgcaaatgcaaaacatcactcaacttcttatgatttttttttcctgaaggtacaccgtgttctgaattctgagaagtcaggatttatttttcttctgttctgcttagccctgcaatcgtgttttattgttgccactttgacttgaagtattaaagggagctacattggcctcaaaattgaaagctaattttggtgtttgtcataagtttgttaagaccacatgcattccacagtttgaaaaatttcattattctgtccatgctggggcttcgtaattggatagtaaggatgttcaaagactaatttagtgaattgcacaatattttaaatggaattatgcaggtttatgggtccttaggggattcgactaggagcctctcgagaaaatctgtttatcagtaaatgatattagcagctttcacctagcttttgtcttcattaaattgctgctctcccaattgagggtcacatctgaggcctgctttgataatttgtcattattgtcttgtttattggagcataaagttgatacaggctgggctgcgctctttctacatgatgtgcaaagaagtttttattaacaattctaccaatgctaaatcaaggtggaattttccagggtttaagaaaaagaatcatttgtagccttctcatttcctccaaaattccctcagtagtttctgtatagccacctctgtacagataattttaagtgcaatcttatcagtaaaactaaagtggaaatttgaacatctgtctatagtattgacctaaaagataaagacaaatttaccctcccttaaacataacatgtccgtgtaattaccattaacactttatcttaaggccctttagattgtagttgggatatgaaaattatgacaaagcatattaattgttgcagcacagtcaagggtactttacatggcactcggatcctctacatagacagggagggattcccttaagagctgacacacagccctgctgaaagtaatattgaggttggctaagtctgctcctgactgctttttatattaatccacatggttcttcatctctcagggatgatgtgggatctaaaacatggaaacaggatagctacactatcctccatcaaacctgtagttcttgcacttttggggtaacctgcacattccgggactgctcttctccatagagactcatctgatggctatcgctttctcactgcatgtaagttggggttgtgctactcacttttaggttcagatgtgtcaccattttcattgctatcttccaagcctccaccctccattctcattccttattgcccctcgaggggaaaaaaatgtggactcttctcagagagacttggcccagggacagggaaacaagaatgtcagcagcagaggtagaccacgcttttgtagaccacaagatagaagaaatagagcaaggactctgtagtaccactaagggggattcaatttctcctttggagtttgccctggataacctgtttagccatccccaggatggaggttaggatgggcagaggtcacttgaggacctcactaggcaatgtgcataggtttggtcaagatgccagaaaagaaagtgccaatccttcaagtgtcacgacaaatagaaagtgttcattgcactctctgggggctcaggatgatggctaggcattccttatgaaagttctcaggccaggaactgagccaactcatttttatacactattacctagcacattcacagcgttcaaagatttatggttcttattgccatctacttacccacataatcaccagcctttcactttaaaatggttaaaaattgtttcatagattgcaggtcattaatgtaaattagactatttctatatttgatttcttaatttttaaaaggaaaagaatagctctcatacacacatactccctctccctttccacttgaaatttttaaatggccctctagacacctctttcaataattcttaccctccaaagctgggctgccttttaatttcactttaaaatagctacattgggaccataatatgattagaactaatgaatattgtggagagaagcaaaaaaaattttatttaaaatctttaaaaagtataaatacttcatgtgcataaggacctgtggtttatcgcagcccagtcaagagctcagcttggattctgggactaaatcatcagagcccatcaggcctcaccttccacgtctccacaaagaggtcacggctcctgaggcttctgtacagaacagtaggaagcaacgatacgaaaataaccttccatgccaataagagcaacagtaacaacagaaataatgaaaactgtcactgccctaagatgcataaaactacttgtattttgaaggccgcatctaatacagtcttccttctctttaccctggggggggggtctggacacaggaaatctgaccacaatggaatcagatagaaattgtacaaataattacagttggactttctttgggccatcatcacacaaataatgacatggagatttattattaattatgaaagcttggccttagcgcagggcttccttggctttcagaaaatttatttattcttcactggtttcttctttttaaactaatatatcaaatttattctcaactgtctggaattttctagtgaatcaagtttacttccctctatctgttactgacctgctactctgacacttatggtagttttaccagaaagagctggaggtaaagaatgtggcattctttaggaaattttctttggaattcactgtcaaccctaagacagttctacctttataaggcctttgtatatcacaactactctcccatccacttttttgctgtagacatcttactcttacatctttgacccagctccaagttcctaaactatgagaaaacagtgaatactatgctttccttctactacccatgcacccaccgtctcaagagcaattttaccacaaaacgttttaatccttgaattaagtattctgcatgaagaaaacaagagccttctgaaaatcatgggcttattgttacatcttgtagggttttgcagctatccctgtgacgacccctaacatggctattaccctagatgccaggaactgaaatgcaattttgattatgtaatgatgagcaagtgtgcttgcactagtccagtttcctctaccatggaatgacagagcactttttgcccttgtgttttccctgtggcaaagagcacctcagatgttcacagagaaaaggaaccagtatttgccccgttgctcacattggagggtgctttgtaacagatcagcggcggagggcagagttgcccatgacagcagtaggaagcaccaagtactgcaggatgccctagcctaaagagaagttctcaatcagctgatataagaggagcttccttcccgtttcgtctagtgtcagtgttcttattttctgcttagcagtgagcttacttaattctgcaatggaattttaacagctaggcacctctttggcagttctaccatttagtaagaacggatgaagacacaaaatgtgtctggctttcaacattagatattccgaaaaagcaatatataggtaaataaaatcctgaatttgttacaaaagtaggtttaaaagttctatttcttaacctataaaactgggaaagagatattctctttttttttttgcaagatgtacttctaattttcttgtatagaaatgtctcagggagacattcagaaccttagtataatccttttgttaaattcaatttttttaattttttgagactctcatatatttgtagtgtatttacatcatttccactcctctcccaacccctctcatttcctccactacctctcaattcatgacctcatcatactattgcatatatatatgaacatatatacatatatatactgtgtatacatgaatgtatatagtgtatatatataatacatatatataatagtgtattgtagtatatgtgtattgatatctgaatatataaatgtattatgtatattatatataatatgtattttatgttatatattttctgtgtatatatgtgtatatatattcacacagtctcctgagttcacttagtgttgctcatatgtcaaccatgtgatctaaacaaaaccatataatgatgacctgccagcatgggtagaaaaaattcacatctggatcatttccctgacagctgtgaactttgtagggacctctgtacacaccccaggctttgaggtataaaaatgcaagcaaatcaatgagaccaaatattattttcatgaccaatcaagtccctctagccaaaaagacttatctagtgaatgatttctaaacagccacatcttcaaggcaccatgtacccagcagtacaacaatgtaagagttccagtcctcattaccctgaagagaacacaacttttatattctgtgggactgaattttgtttcttttttcaaggctaccttgcttagagaaattggacaatttatcactcggtggcctggagcaaatttagtatatgcaagtgattagtttgtctcttccccaagcagcgttgatatgattggtaagagaggctgcaggaagggaaggtcgcttataacacacatcctctggggaactgctaatgagctattgacccttccccactgtaggctgatgtgtcatatcccattcgattctggctcctgagatgtaatttctaagtggtgatatttgaagtctatgtgagatgtgttagtctatcaagacttttttaaagcccagtgttattcacaccaagaatggcaggtgtcagttgatttaactggacataatttcaccatttccagctctcctccaaggtgaagagaaagtaggtcagttgtaataaatggacataatttcaccatttccagctctcctccaaggtgaagagaaagtacagtattgacaacattagttaaattagtaaccacatataaatcatatcttcatcctgtacttaactatttctatggctcccctcaccttgcccatttgcatggggtcagagaaaccaagtcaacattttttggcgtgtcacttgctatattatttaagacatactttatagctctcttgcctgccaccaaatggtttttagtgcactgctgtcaaaagctctgtgaaagataaaaagaccatttcagatgaaatgtgaggctcagtcagcaatccacagactgaagaggcctagagccaatcacccaaactgtcaaatcggccaatttgtctccttgcttaattttaagtggtaattgtttgtcccttgttaatttagtttatacttgtatactccaaaaagaaaaagtaaacttggtagacatttttaattaccttcaaatcaaggtaattaaattgcccaggtagatcattcccctaagaatagaggagaaaatgaagagcattctgggaggtttgagggagccagggcatcaatgaaatacgtctcttcagttcactgtatgctaataattatgaaattggctggggagggctctttgctgtataacagtgtataacagtgtaggttgtagggcgaagaaataccacaggaataagacgaagtcggtaaaggagagtccttacagtgcaaaaggtgtgccatcgcttcttattgcccacactagtacatgccacggagctcacaaaatgagtaaattctcctcacactcacaatgtgaacctcagagccagggaagaataacatacagacagcagggcaggaagtagaaaaccagccacaggcattgaaaatgaaacatctccttatcgtcacaacccaaaggccatggcagtaaacacagaagcggatatatgatacgtctttccccctttttaacatgaaatttatttcgaaacaatcagtttagaaattcaaggttttagtttttccaagacctactaaattaatgaaccagaccaatttatgatcttctatgtgttgctgaaagaaaaaaaaattctccctgcaggtaaactgtctatctggagccagagatattagaagcaatttcatgagcaggatcattaattatgacccatgaaattttaatagttgccttcttcagagctcttctaggagctgagatcaaagtggctgcaaagcaccgatcctaactcggttatcagggagtctggagagcttgggagggtttaggatctccatgtgtatctttatgccttgtgatggtgatgtgtggaagatatcatgtacacagcacaaatatacaaacacacatacctgggagccggtacctaggagctaggtacccaattcatttacccaattctgatgattatgtcacacctgctgatctttatataactatatggctaagggtgctacttttctttcttaattataatttagagaaggcatggtgtagttgaaagataaatcaatgtgaactgacctacatttatcccaggtctgtactataagagaagcatgccctggggcaacaaacttaagtggtctggaccttggagtcttattcatgtgaaatgctggtgtggtgtgagggctaattggaaaacagggctacacctttgctaacacactttcatatttaaagttctgtggagaaatatttccttaaaaatgaagatgttcatagtgcctaccccttaagattgttgtaaagacagaataggataatccttgcaaagaaaagtttctaggacatattacatgtatattcctctgtcattattcttgatatttctggtagtaaatagggtccaggggaatgaagggaagggcgggaaggaagtattactaaattcctgtctcaggattctgccaaaattcattgacagaacataagagagaaatcgaaaccatagaactgatatgaccagttcattatgtaaccagcaggttcatcaaaaaaccagcgaacagacttttgagataatacatgtgatcagaaatgatgtcactgtccatgctgctcccgagtctcctttggaaatggcacatcttctattgtgtattgtagacagaagtttctgtcctgccagtcctgaatccattcagtcccaaataaacacacagaggcttatattaattataaactgtgtagcccgttgctcaggattattactattaagctcttgcaacttaaattaacccataattcttatctatgtttagccatgtggcttggtacttttctcagtaaggaattctcatcttgcttcctctatgtctggctagcaattgctttctgcctttcctcttcccagagttctcgtagtctggtagccccgcctatacttcctgcctgactgctggccaatcagcattgtattaaaccaatatgagtgacaaatctttacagtgaacaagagcattaccccactatgtccagtgtacccaggacaatttttctgtttttgaactctgctagatgtctttaaatgtcatcacatgtctttttatgtctttgaacttctgtaagtttctgtcagaatcctctgtttcattaaaatcactcccattattttttattaactacgttttcattcactctgagaattcatactttcatccactgcaatttggtcatatccaccccccccacacacacacttcttcctgcaacactgcccacatccgtccacgcctccctatcctttctcaacttcgtcttttttaatattcatatcaattccttgagaatcctgtacaatgtgtctaatcattttcactctcccatccacttcccagtccacccttcccttcccttccaacttcagatcctattttttttttcacatcaagaccaatgtatactttccaaatacttgcgaaggtgtagtcttccattggagcatggttgattatcatactcttccagaaaactgacccttctcccagcagctgagaattgctaacatctcctccaattggagtagaccttcatgtccaagtcccctctccatgctgtggtttgtcatagcccagagcttctgtcgctattattccttggcctggctccattctccatagtttctcccacaggcaggtttcctgccttgcttctcgccacagctctggaagcagctagaataagactctgctcttaatccctgagctacttagattagtgtccatatctaggctaacaacttggctctgccggacagtaaacttatcgacacctgatgttacctccctggataagtttccaacctgggtctgcacatgtgacccctcagctactggccacgttcagggacaccataccagtatctttgggcctttggataagacctactccctgaaaccagtttccttactccaaactcctttcttaccctgtctatgctcttcttaccaccaagtgggatgtcacaacacagtatgctaaaggagagtttagaatctttcgccccttctccacatcatctaattcatcaccgccaagccttaggtttccgccctgtaatgctaacataacacttcaaattctcttttatctatttctcctctctgcaacttctcttgatggatgttaccacacctcattcaccacagattccttcctctactgatgcttttctatggccttcctccatcttcgtgttttggacatgaactccacagaaaatgggatattaaataaatgaaaaataataccattttctaatttcttggatgattggattaatggatatgcatgggtgtcatttcatagtgatgtaaattttggtgaaaaagcattgtctttgaattgcacaatctattgagtgactcgcactaaattatgtacataaaactgcttgtttatattcatgcaataaatattcagtgtgattgcacaacatccattcattactaattttagtttctaatttagtttctaattcttatttacacagcttttgtgataggcacattttctggaatttggacatactgaagaaaaagagaggagagagagagagagagagagagagagagagagagaggttgtgtcatgactttaatctcagaatttgggagccagaggcaagaagatcacagatttcagctatcctggtttacatataagatcctcccagctccagctaagtgaaaccaattctaaagagctaaggtgagtccatttctaaaggactcagtggcagaacactttcctggcatgcacaaggccttgtctttgatctacagaatcagcaagcaagggcatggggagacatgatttctctagtccaaccccatgtctgctttgacccccattctatctggtggcaaagtgctttattttctgaaatgcccacagttcattccttcaggatctagggaattatcattcaggctcatgggagagaaggcaagagagcaattttgtagttgaaactgacgttagacctgttgccaccctactggtacccaagttcttctcagcgtacagctatggtcagggcacctttgccccatgaacattgtttccttatttggattgacttatagaaataacattgtgctctacaagagattataaaacctgcagtcttaggtattgaatattggtacttctgtctacactggtactccatgttggcgtttttatcaccccactgctccacatttttgaagcaaactggttacaatctgagtcattatctccataacccaaggggcatggttgtggttttgtttggttcactagttggtaggttttcttttctttctctatagtgtatggaggtatagcaagggctggtagtgtgcatagaggagcatgcaagcatgtcattgcacgtgtatagattttgaggacaactttgtgaaattggttctctccttccatttccatgtgggtttcaggggatcaaactcaagtcatcaattttgtacaacaatgcctttacccaccaagccatatcaccagcacgtgatttgttatttcttttttcaaactaaaggaggaaaagatttctgttctactatttggataacggaagcttgaaggcccatttaccaatgcccaagctctatagctgaaaattctgctctgaagtcaatgctcactattaaaaaccacttcagtagtttataactcaccaactgttactgttcttgaaatgggcactgtgtccgctgcatttgctaccttcagtgagggaatggatctgaagccaaaatgttctacatatagtttgcattagaggttacaaaaggacaaatatttataaaccccatttatctatgtacttgacatatatgcactttacatacaaatttatcttaaacatgttcaaaacacacacccagagaggagggagagggggagggagggagagaatattgcgattaaaataatatcctgttcaacttgtcaaatccactttccttctttctggataagcaagttctaactgcattataaacactggactgcaccttttccaagttagaactattttcccttctagaatcttctagttcttgatttttttaagagggggaagatttactttcttgtggtcagaggattcagtgtgttgtggcagcaatggcagaacagtgccaggaagctgagaaaggaagctgccagggctctaattcctttggtttttttttaatgtgttctttgtcattttcaagaacagatatggtcattctggtcacactcatctccataacttttcttttttatttttacaaaattataattttacatgtcaatcccttctccctttcccccaacccttaaccacccccctcctccctctccccttcccccttcactccccatatagggtagggccctccacgggggatccccaaattccacaacatcatcctgggctgggcctgggccctcccccatgtgtccagggcaagagtgcatcccttcacgtgggatgggctcccaaagtcccttctcacaccagggaaaaatcctgatccactacgaggggcaccctagggtgcagaggcctcctcattgacatccatgttcaggggtctggatcagtccagtgatggcctccaagacagcagcctggggtccatgtgctcccccttgttcaggtcagctgtttctgtggattcacaagcctggtcctgacccccatgatcttcatttctccctctctgcaactgggttccagagttcagttcagtgtatatctgtgggtgtctgcctctgcttccatcagccactggatgagggctctagcatgccataaaaagtagtcatcaatctcattaaggggaagggcatttaggttatcctctccaccattgcctagattgtcagttggtgtcatccttatagatctctggaaatctctgtagtgccagatctctcctcggacctataatggctccctctgttatgatatctctcattctgctctcctctattcttcccccaactcaacctttctgctcctccatttcctcctctctcctcctcttctcctcctctcattctgacagctccctctcccctgccctcatgctccgaattagcttaggagatgctggcccttcccattctccagggaccatgcatttttctcttagtgtccttcttgcttcctagttcctttggtgaagaggattgtaggctggtaatcctttcttaaccacttttatcataccaatcacctcctctagcaagttcaaatcctgtaggatctttttgttctgtttgctgtgtaaagcactaagtttaatcaaggagagctatgcactggagcatagctaacgcaccagtggcaacatcactgaagacaatgacttccttggcccatagctccccgaactgggtgagacaccgtgatgcgctctgattcttgatttgaaatgttagtgctaaatcaccttccatttcattgttatttctttcccacaacttagagatttgattggtttatgttagctactttctgctctatggaatacatgttgcgtagtttcttacataggcatttgtgctgagctgggtgaataatagtatactctggagactactgaaatattctaaatgcaataattcaggtctttggactggagaggaaaatgattagacagtagggtccccctgcacaacccacacagcatcagtgctcagtctcctatggtaatggccattcttcatgttaataacttttttcccaataaaatttatgcaagctactctcatgttttctaaataatttttgacttcaaatagctactcaagacatgcaaaacaagatgaaataaataaaacgggcctatttggggcttggtagagatgaggtgttcaatatccatttgtgttttctacagaaaagcttaggtcttacatcttttttaattctacaattttgcattgagaaaaataggtcaaaatgttataactgaaaatattcttttcccttttctgcatgtgattttttgagttcttagtgcataactattctgtgtaagttggggaagatcactgtaaaagaaatcactgaacctcattttctagctttttgttctcttacctcctttgcaatggcactggttgccagtatcagctttcagggagttggagagaattggggaatgtaggaaatagataaaaccagaaagacttgagcggtcaagttgtcaaaattgactttaaaaatgctaacacagagccaggcagtggtggcacatgcctttaatcaatcccagcactgggaaggcagaggcaggcacatctctttgagtttggtgccagcctggtctgaaaaagcttttcaggacaggttccaaagctacacagagaaaccctgtctcaacaccccccaaaaaatgctaacacaacatgtaaaatgaagattatcactaaatcatttactaaacagccaaatgggcattatacttacttctactggaagacatttttgatactaaacaacttttcagtatgtgtcattggtgattcagagtccccagtgaatcccagaggctatttgaggcttatgaagtatatgtagacttgtcattgatacataaagtagtatttcttttacaattttcaactcaaaaatcacactttagaattgagaggtgatgaattgaatgattcccatttaatttaaactatccccagggaaaaattgactcacaaaatgcaatatattgttacgagtaactatagggaaaaatgtttgtatctgatgctacattgagactctaggtcgattggaattaactagagaaaaatcctcatatgttcagtatttattttcagccttatgtataattatgtgaaaatagggttaagattgtgaacccggtagtgttctattcatgataagcttggtgatcaaaagagttgcaacagtctatttgtccatataaaatgagaatttatctgtatcagaaacacgttgtaattttgaaagaatgatgaaatattttccaagtagttttcaactattctcaacttctcaactcaagatcgaggctgtagccgagttaactagcaggctagccttatacctaatctgtacagttatatttcagagatgagaagtcatcattgaattttgtattgtatttatgaaaacacagatgaaatagtcaacacaccataaatcacaatcctccctcttttataatatattagatgcccaactttcaaagcaacatatttgatgggatgggccctagaagttgttttcatcttaaaattctcaagattgagaaaaaaatttaaaagcttccaactcattaaaattaatttcaagtcacataaaaaacagtgctctgataagttcaaatatacctagaaatattataatccattgccccatctatcattattagcatgtatttcttctgtgtgagatttcattgtaagacatgcatactatggctttcctcattgaagatctgtgatacccacagtctcattcggggacatatattttttaaatgaaaaaccataaggtttgatagccaaggacactctgaacacagaacttttagaagaaagaagaaatgaaaactgactgactagctgaaccacatgatcacaatgttcctttcggataagctggaattgtttattctggggtattctcaaagaaacctaaacagaaattggttaggctatacctggccagtacagtatcaagaagctcctgcaaagaaacacatattggaaaagcccatttaaactttccacacactagtgggtctgatgggctctaaattagctcgcacttctcaccaagaaagacctaggcatcattatgaacagctcaattaagatgtctgtgcggtggggtagcaccaggccaaaaagcaaatagactgttcggatggattaataaaggaagagataatatggaaattgatgagtatgatcttgtgtcaatacatctttcctaaatttagacaaataaattgtttttttttccccatcctgaatgatttgattgttttccaaaacaagtctctgggcgtagcttccctgaaacccgggtgcagtaggcaggtggcttttaacagttgattcatcacgctcgctcgccacatctgctcagctgctggtgcctttgaatgggatctgttcaactgtttccttttgactcactccatcaggccttctgcctatctgtagaatgaaagtgggggagaggaaaatgtgagggcgcacagaagcctcgcctcccaggagcagcgtacttataaacctttcatggatttataatcctgtcctggagatgtgttcaaaaagctttcagatgcatcaaattttccccatttaataaaaaatatatttcccacagtaaaatataaaaaacgcatttcatttaagtcatgtgttggctctccaacagccctcgcctcacagcagagggaaaaggacacagtggtgtctgaggcagcgctatcaggactccctaagctacttcctatgagagaaaagttgcttccctttccaagacaaacctaaactgaattaagagaaagcaggtcagcattcaaacatgagctgaaccgagaggacaccaataaacatagtgaactgtatgtgggggaggggggaagcccacaagtcctcaacccaaagaactgcaggcaactgagcaaaactgggagtgggagaggtggccctccccagggaagagcaccagacggttcacatcagcaaaccatcagccctgaaaacatacatccaagtaacactgcatgaactcaatgggttatattttaggaatatacacgtatatgtatatttatgcaatagcaattaataaaaaaggagagccgaaaggggcacctgggaggattttgagggagtaaggggaagggagaaatgttctaattaaaatatcatcttggatttttaagtagttctcacaagggtcgcacatggttttgacagctgcacatactctctgtgtgtccgggtacactcttagttttgtgttgtctgttggtgatgacttcttccgacacagcagttaagaaatcactttctggaggacagaaaggttgagacaggggaagaatagaagataacaagaatggagataccattatagagggagacattttaggtttacagagaaatctggcactaaggaaatgtctggagatctgcaaagatgacaccagctaactatctcagcaacggaggagaggctgccttcaatgccctcccctgataaagagattgatcactgacttatatgccaccctagagccttcatccagcagctgatggaagtagaagcagacacccaaaactaatcaccgaactgaactagaatccagttgcagagaaggacgagtgatgagcaaaggggtccagaccaggctggtgaaacccacagaaacagctgacctgaacaagggggagctcttgctccccagactgatatctgggataccagcaaggaactgatccagaccccaggaacatgggtttcagtgaggaatccttggaaatctaccggacctcctatagtacttcagttcttatccctagcataggtgtggactttgggagcccattccacatagaggaatactccctgagccaagacacatgggggtaggcctcggccctatcccaaaggatacattagacactgatgaccccctatggaaggcctcaccatccaggggggggcagaaaggatatatgataggtagggttttagtttgggggggtggtaggggaggatgggagggggaagggaactgggattgtcatgtaaaacaatcttgtttctaattcaaataaaaaaagaaattattttctacagaaaatgttgaaagtaatgcattgcagttgcatcaactaaccctgttacacatttccccatcagtttatatgctgtgtttggaacactatgaattcagagcttcaagaaccccaaggaacttaaaacccaaaacaaaacaagccatggccagagaatcttagaaaagttacaggatctaacagattcctttgcactttttcggcatctgagaagagtttccgagctgttcaatcatggtttagtccattagaccagtcctattcaaattgtctcgtcctgactagcacagaatacagtgtctcatgccttttttagagatttgttattgcgtgactaccaaaagaattgttcagtattttgctaaagtccactctgtgatagatcagagattaaaaacaaataaatacagaacataccctccaccataggctccctggatgctgagattccaaggtacccaaggtcccccgaaagagctaattagcattgcagtcagggtctcctgcaccttgcttcagcctcagaagctccgggttagggagaaaacaaacaaacccatgtgaaatccaaacacaaccacatggggaactctgggattcgcctttctgtacttcaacacagtccaatgtttcaactgcctgtttctctccagcagtcatcatttcgtaagactgagaagagagcctgggagaacaaagggcaaaagcccaaatccaccagggggctgtcttccactcaagttggagataaaatgtttgaattctgtttggtgttcctgtttgatctggttttatttctgtttgctttttaacttgtagggttatctgtcacatttaactatcttcagtaaaacgttacgattgaaagactctgtaatatgacatatatgcatatctacatttgtgttagttatttaagatttacaaatactccatatgcacagaaagagaaagaaataataaactatcatagagatttgggaaacaaagaaagatacacatagctatttcacttcaaaagcggatacttggctgactattggcagatgtcaaacagttcacctttgctttttggatcagggcttgccaaaaatgtgaatgcagacttggtcttaagtgtggtcctccaagcactgtcaataaaggaaatgcaaaacagcattgatttcactgctgccaaagtgcccaggcttcgatctgtgaccatatcgaccccacccctagaacaaaatgtagcaaaatttacacaacaacatcaaatagcttcactcatacagactataatcatcaaagagaagttgatggtgcagattgtgtgaatccattacttctatttagaagactacacttcctgtaaaaataaataaataacactgggagaaaacagtacagatacactgacaatcagtttttctttttcttgggtaaaagtgtaaagcatatcctcctaccataggtacactgagattttgacagttcttggtggtggaaatagagaagggatgtgatgttgagctcaatgataattcctacattcatatttagtaatgcagaaatattcttaaatggttagttggaagctagtgaaaaatagcacacatgttgtgaattgtatatgaattggaaaagcaggcttaaggaatatgtagtccaaatttcaaagaacaccattttcttataggtagggttatcatttttctttctattctgttttcttactctatcatgtgtatggatttttggggtttttttaaggggaataaaattaaattctttgtaatgagagattctttgttagctggtcccacagctcttgggctccaaataaacacagagacgctatactggttatagtcctgttagccggtggtttgggcttcttatttggctagctttgtcttaattattagcccatttttgttaatccaagtatttccacgtggtattatcttactggagaagtgtccagacctctaactcctttggcactcacatggcgactgttccggcaggccctctctgcctatcttccccagaattctccttgtctctcagtcctgcctatcttcctgcctcattggccgaacagtgttttattcattaaccagtaggaaaaacatatatacagaaggacaaccgccatcaatacgttcatgtgtctctgggatggtggtatgatctacatgacctgctgtcaacatgacctgcctcaaaattgtgtcattatgtcataaataaaggaagctaaaaaaatcacgcacactttcctaccacttcaggttacagaacctccccatgtgccagaagaagcattaacagtattcattaatcaaatcactacaaaaacaggaaacaaaatctgggcttttaatccaagctactcaaaggctgagaaacaagaggatgataagatcaaggctaggctaggctacacagtgagctcaaggccagcctaggctacacggtgagctcaaggctagtcggagcaacttactcagtgacagacacaatgtcctaaaataaaaggtggaaagagggctagatacatagcccaatgtataaactcgagtaatttgcttggttaacatacatgagtgactatgttcagtccacagggagaataaaagtagaaaagcatgtgaatgtgcttagaattgcctcagaagtagatacagagaatgctctattgtgtgttttaagatttattttctttcacttgcacttatttgggtgtgattctgtatgtatataccacatgtgtatgatgctcacagaggccataagtggaaggcagatcccctggcaagttggatttacagttatgagccacctgacttgggtaatgggaactgaacttgggtcctctggaagagcagtaagttaactgttgagccaagtctgcagccctgaaaaccccaatttttagaatcaatgaaaatgtagtgtgcttgaaagcacatggttagtggctggagagcagagccacaggtttaggaactaggcagaccttgattagattccatgaccaatgcttagcagcaggattttttttatgcctctgagtccctgttgaaggtcaataacaacagaagcatggggtttttagaagggaagacagcgtctgtgttgagggtttcctatcctgtggggtgagacgtgagtctgcttgtgtgagcacaggtgtgcgtgtggaggcatgaaactgacgtggagagtcttcctcatttatctattgacaaagtggttatttttagcttgccccagtgagcccttgactccactaggattgcagagagtcactgtacctgcccagcttttacctggatcctgggaatctgtactttggtcctcactcttgaggagcaagcaactgcccactgagccatctctctagcctctgtgctgaaagaatcatatgacataatgacacacatgttaaatgctcaacaattagttggcataaaagtaaacataccacttaaaggacaaagaaaactataaagcagcatacaattaatgtgaaatggagggtggtggggtgggtaaaagaggttatgaagacagtgttgtgatcagagaacaatatatacatatctcaaatcagtgaaacccactaatacatacaattaatatgagctgccaattgtaattaaaatataatcactgttttagagtggcccttggctgttggctttcgcagtctcatcaggaccaaatgctatgctcttcccttggtcttcttccttcttggggccacatgagcatgtttgtccctgcaccacggtatctgcacacagaagggaagtcatcgctctccttttactagcatttcctttgggggaaattcaagacaacacactctgccttcatcaaaacaaaatgtcactgcatctagtgcacccagaggaaagaaataacacaatgtttgaatttttaaagcaagtatgttatcagtgttaatcaaagatggtaggatgatccacacaacactctgtgtaagaattactgaagaagtagaaaatcctccaaaaaacaggaaaaaatttaaatgtcactttacagagcttgcaagcatgttacagattttaatttagccaatttggccacaaatatttcttatgttgctttgttcagtaagattggctctgaaacaatctgaggtcagtgaaaggactctacttctatttttacattgcacaactttacaactaacaaaacatgcccaaacatttattaaataatcattcatcctaagtaatcctcaaaatacttcataaagtgcattttgtgaattcggggttcctttaggcaattttgagatatggtaatattgtgtaacctaatttctatcacctaatatttggaaccaggaaagcactaatccttttaagccaattgctcagctcagaatagccagtgaataaaggtagtggctacaggcaagattgcagtctcactatttgttcataggtgggaaggaaggagggtgggacctgcttcaattttcttatacttcaacttcacagagagaagccacctctgaccttacctaaccaaactacaaggtgttcactcctcccccaacaaaccatgtgtggcattcattatataaaataatatcttatgttaggtggaattgggatagtttattatactgctgtctctagaatgtgacctgcctgtaaaggtatatattaactagccatgcagagaacaatccactgtctctatactgaagcattataggttattatatcagtgctttgtagtaaaaggaaatctaacacagttgaattaattagagtttggttctcctgagcactgtgtatatgagtccagcttggcaaggaagtgacaaaaagaaaagcaagcattttggtatccacattccacattcagtggccttggctcattaatctagagatggttatcattgaatcatccgtcaattgtctccagactcttgctaaatgtcctttgtatctggatcattttccagaatctgatttgtcatttggccagaattctcacttcttttacatcatgacaggtaaagctgtttggaaatatattgtataactagtaatatccaacccgttttcttggggataagggggtggtgtctttcatcttgatccaagaagccttttagagcggaggctatctcctaaacatcaaaactgccgccttcatattttgcaccagcaaagattagttttatagtgaatcgactccatctatgtcagtaaagtagaaccagtgggcatctctccacttccttctatgtgagaactggtagatctgcttctaattctgcctgcgtgttatcatttgcaaggatgttgtattacaagaagatccatagtctgtaaggttaagatatctttatttagataaacaccagccaaacgcaagccagagcgtgccaggggcagcaaggcaggcaggccagagagaagggctcccatgtgccttacagccccttaaaaacatatcacaaatcatcctgacctcaccttgaccacgccctgacaggcgtggtcaggcacacctgtggccagcttctagcaggcgtgccttacactgtcccctacaatgttgaaatgatgaagagcagttattagaatgtacccactgccttccgaccatattgtcgactgagcctacagcatagtataaagaagactactgggctcagctataacttggtctgctacttattgaccactggtttcctaactgctttggagatatgctgtttaatccctttgaggaggttttgcttatccttattctataaatgagatggcaagtcatgaaggaaagccacatgccagccccaagcctcaacacagtcctctctactacacatggatgctctgttcacgacttcggtcaatgtcaggcccagacgctttcttcacactcagcctcaggttcaggaaatcaagagggaatgggtgatattgcctaaagactaagatattattaaatccccctttgttttggttccatgcttacctcattaaattatttcataaaattccaatttccttgtgtcatcaaataaataaaaattaacgtatcaaaaactcagcatgtgacctgtccaaagtgtagatatctttgttagtcccttccacagaggttttcttctgtctctatgttatccccaattccactggattttaaagatctacgtagcaacccccattaaatattcctctttaaagccatttaacaagtgtgtaattttaagaaaaactacttcccaacttagaaataatatacagatggagacttttctcataacattttggtaaaaactgtatctgggtgcagacatactttgtagccagaagcttgaaacactcaccaacttcttctaaaacacattatatacctgcaaatgaaaagactgagtaatagtattttaccctaaggagtgtaaacttggataaattctcaaggtacggcagtatagacacattataacacagctaagtgaacaagactaattgcaaaggctcaatactaaaatactgaacagcagctatagtaattctaagtattttatttctaataaaattcaataaattacctatttagagagataaaatcttacatgcagaaaagtctacgtgagaatgttcaacccactagaatttgaatattccctctttaggcaataaaaggcatagatgacctattttgttgtttatctgcatattctaggtatttacattaacatgggattccattatacacaaagtaaagggaatttgacattaaaagaaagattggttacgcaaagttgagtatgtggctctattgctctagaccgttgtgaaatacattgtttttctgtataagagacttctagcatgaggggtgtgcaaagggattttcctaaacagaagtcttttcgaggacataaaaggacctgcttagaggccctggcctgctgaaggttgggtgtgtccacacctacctccttgtgtttggaagctctgacaaagaaatttctatttacaactctgcagcagtgtggccagcttcctagtttgcaccctgtaatacacaacatattctttccttacctgcagacgctcagcagcaacccctctagactacaaaggaactgtaaaaggacaaacagtgtggccaggagtgtgctggtcactttagggagacttccccagttatgtgaaccagagtctacaggcaaactccatgtgagcacacatttgtgttctgctcagactgcacagactgcccaccttctctgtccaggcttcctatcttgtcttcaaaacccaatttaaatatctctttttcagcctcacagggcccacagggcagactcagaattaatttctttcttctgtgcacagccacagcactgttttcatgccgctaatccagagtgaatcataatgcatgatgatagatagcttgccggggcactcttccttgccccatcaggagagcaggagaagaagaatatgacaccaatatttattcagcctctagtgttcattaagcaccatctgtaattgatgcttttaacaacttgcattattctcaaatgcatgtactattgtcttcgcctcacaataaaggaagtgaacattcagcaaagttacacttggtcacaggagttgtgcaccaaaccgtttcctcccaaaatctttatgttgaacccccaatgtcgctatttagagatagggttcttgggagataattaggtttggaagatatcatgggggtgcaaatccttattatgaaattaatgtcctttattataaaaaaaagagagaaacttcttccccacccatgcaagacacattaagaaaacagttaactatgtactgcagttcacatataatactatcactttggaggaaagagggtcagaaattcatgctcgaccttggttacttagcaagtctgaggctagcttgacctatggaagatcagtctcaatattatagcagcaaccaatagttttctgattgaatttaaaacccactccacaagacataatgcttgtctagttctgttaagtgagtcaaaagctcatagctgactaggctctatgccataggagagaatgtagtaccattactctgttaggaggacatattgttaaactgccccataagttcttatctttatgaacatagattattgcattcttaactctaatcagaaagagcttcattttgcagtaggtggtgactaatacctacaattatgaatacacagagaataagactatagagtgctaagctctagatggtaatctatacctatacaacaaccgacaacccctggtaccatcaaggaagaaggggtggaaatacagtaagatcgccgggtgttggtggcacacgcttttaatcccagcactcgggaggcagaggcaggcagatctctgtgagttcgaggccagcctgctctccagaccgagtgccaggataggctacaaagctacacagagaaaccctgtcttgaaaaacagaaagaaagaaagaaagaaagaaagaaagaaagaaagaaagaaagaaagaaagaaagaaagaaagagagaaaggaaagaaatacaataagatccagaagcagcagacctctgcagtaaaacagtacttatttgctagacataacacagctgtcacacacatgaacccacagcagctgtccctgcacacacaaggcctgcataagaaagcagtcaaaatcccagcatggaccagagggtactcatgaagtaagttttccttagggatgtggctcctgggaggctacccaggctgcatttgatgacttacatccatgaacatattggtagcactaagtagattcagtgagtttaaaacaaaacaaacaaacaaaaaaccccaggaagttgggatgaaaagcagtggagaaataagggaggtttggaggggagggaatgagagggagatttgatcaaaatacattatattcatacatgaaattttcaaacaataaaatgttaataaggaaggagaagaaagagaagcaagaggaaaggaaagaaggggaaatgaaaaggggagaaaatgaaggggaaagggaggagaaaagggggaggagacggatgtctggatggtgtcatggatatttgtgctttctattttgcttaagcaaaaacatttggaaagttcaacatatactagccttttgagattagttggtggtgtaaacagactttgataatatagacaaaggagatacaggtcatacacaattaggctaaattaagcaatcagttttagaacagtaactatcataaattgtacttcagtaattgtgctcacagcctgtactggctggttttatgtgtcaacttggcacaagctagagtcatcagaaagataagatcctcaactgaggaaatacctccctaagatccagctataaggcattttcttaattagtgatgaattagagagggtccagcccttgatggatggtgccatacctggactggtggtcctgggttcttgttaggggccatagcaatagtaaccttggacctgtaagagaagtttgggaggttctgtaagaaagcaggctggacagctaaacactgagctgaactctggaatctagttgcagagagggaggagtgatgagcaaaggggtcaagaccaagctggagaaacccacagaaacagctgacctgaacaagggggagttcatgtaccccagactgatagctgggaaaccagcataggactgttccagaacccctaaatgaggatgtcagtttggaggtctggttaatctatggagcctctggtagtggaacagtatttattcctagtacacgaatggattttgggagcccattccacatagagggatactctctcagcctagacacacaggggagggtctaggccctgctccaattgatatgacagactttgaagatcccccatggaaggggattgatcccctggggagcagacaggggctaggacagggggccattgggggggcaggggaggagggaagggaaagggaactgggattgacatgtaaaacaagcgtgtttctaatttaaatttttaaaaaaggaaaaaaaagaaagcaggccgatcaagccatgaagagcaagtcagtaagcagcatcccaccatggcctctgcatctgctcctgcatgacttccttctatgatgaacagcaatattgccaaataaaccctttcctcctcaactgtgttttggtcatggtgtttcataacaataatagaaaccctaactaagacaaagcccaactggcatctcaatgagatgaccttcaaaaatatcatggttctatataccgaatcatcttctttacaaatacatttttatttatgtgtatgagcgttttgactgtacgcaacgtgtgtgtgccttatgcccacagaggccagaagagggcactgaattccctgaaaatggagttacaggtggtggtaaatgccctgtagttgctaaaaccaaacctgatctctctgcaagagcagcaagtgtgtttaactgctgaacctggtcttcagccctaaatagtgtgcttttgtgactgcaatggcaaacacaagtttcttaggactttgatcatgggttcaagcagggaagtgaagcacaggtattcatatatccttgatgcaaaaatagtctttctctactggaagggtgtaaatggaacttcctgaaaagaaggagacacctgtccagccatctatctagtcaacaatattgactagtgggggacagatagatggaccttacattcaacatgtttcttctattttcattatagcacagctttaaatttatatagaaatataaaaattgggagtatgcagactcaacgctctttcatcaaccaaaggcaaagcaaagatcaagtcaggatggtcctcagggtaaggagtgatgagaagagaacaggtcagttgggttctttagagctgtcaaacccagggattcaactctgtgtttataacagtcaaagtgagaagaggagatacaatctcaccctctgagcccacgaaatcctaccctgccttcaaaccccaatacaagcagtttccttcaactctcacatcctcttgtcatgtctctcaatcctgtctcctgagaagagttctcagtaccctcagcatgcacagtacttttttcagttgctggtatggaatgaatcagaatatgctgggactggcattgggtagcatttgatccctggctccctccatgctgagaagtgctaggaaattaccagaggcaacttcttgctagctttaacagctttaacagaggtagcaactagccctcggtatgcttgcaaactagaaattatcaaatatggttaattaaaaattaagatacccagaactcgtcttttattttgcatgtctctgtgtgtgtgtgtctgtgtgtgtctctgtctctgtctccatctctctctccctgtgtgtatgtgtgtgtgtaaaatcacaaagctgacacaatgtcttcctttatcactctccacttactttggcagagtctctcaagaacccagtgttctctaattcagcaagtgtagatagccagcttgtcctggtgtgatgttctgaaagaaaatggtccccatagggagtggcactattaggaagtgttggagtaggtacagccttgttggaagaaatgtgtcactgtgggtatgggctttgagatctcctatgctcaagctatgcccagtgatacagttcacttcctgttgcctgcagatcaagatgtgtaactctcaactttttctccagaccatgtctgcctgcatgtcgccatatcctgccatgatgatactgaactgaacctctgaaactgtaagccaccccagttaaatgttttcccttttttagagtttccctggtcatggtgtctcttcacagcaatagaaacgctaagacacctgggtacaccctgtctatgttcctgaaggctgggattataggcagtggcctaacctgcctgcctattttttttttcagtctgtttttgctttttgtttctttaagagttcagcatttaaaataaataaaatttgaaagcttcccatgcttgactataacatgcatcatgtttcttccctttttagagaaactgatatgctgtggtttgttttgcaattgcatcaaatcatgtttgaacagtgactttggttctgtcacgttacttccagttcctattatacataaacattataggagccagttttccaaatctccttgatgccatgcattagcgctagtctttaaagaagtgctctcaaagaacagttcaggatgagaatttcagtgggctatgagctctcctgtctccttcatagtttgcagtccgagagcagtccctagctcagactttaagacagatgttatcagagaaactgactgcctacgacagtggaaagagacaaatcaggcctcatctatgtactcttcatcctgctaaagtgtcacttccttttatgtgtgttcatcaaattctagctcccaaaataattgtgtttccctctagtaacatacacagctaactagctcaacctttttcttaattcttgaaatatgtcactgtacatgaatgtacttgaaatctactctactacccaacttgtttctaacgatgtaaatgaggggattttttaaaaaaaaatagataagaatcatatacagaagccattaaatagggacactgctgaaagattaaaggtaaatatatattatgagacacactaataaggtggtcagacactcttgaaattgagttgaaatgtaatatacagagatgaaaggaaattaaatatgaaaccctgcgatacttattaagccgtcagtgggaatctagatgatgatgtcacaaccagaagaggagagacaacccatgcaaagttggacgagatccagttcctgctgtagatttatgcagttaatttcgtcccttgactgcattcagatgagcgtttctccccgacatacaccaagaaaattgctgcattatagctgtgttaatggttatcagcatgctaatgagcgtcagaaggtcgttacagcgaagagaggttcaaagatgtataacctacaggaaacaagagcgtaattcttcagggactgtgagtgtcttgtttgtaggtcatagattatttgttttggtcactgcagtgcacagggactttaatttaagctgggaaaaaaatgaagccttttgaattgtgggagcagccctgcttaattaagcaaagtaataccagatagctttaaatttgtggttttaaaaaattatatataaaattccaggatagtattaaaggatgctttccagtgtggaattagtcttctgtggttaggcagaatgggaggtgcttatttgtttttattttttaaggcagaaagtgcttcatggctttctgtcaagaatggggtcaaagtatcagaggtgaaaagggggcaatatccagaaattaagtcacatcataggcaaataatctcagagtcttggcctttgggggggggggataaaaagatatttcattatttacttcaagtgtgtgtttggcttcgaaaggttaagtgtgtattgatactgagaacagaaggtattcaatcagaaatgctgtggttcttgtttatgaaaaggctctaggacacaaacgctgtgcagtccctagactaagctaggaagctctagaacgtcccccagaagcttcctctcaaacaaagatttgtacattttaatggtagaaaaaaatcttaatgctgctcggcttgattatgcagattttgtttgaatgtcctgtttggctagtatgctccttgggtgggctctataagctaagaagacaccttaggggtgagcagtgacaacctgcatttccctcgtctgttggcagtgggatttgccagtgtattttaactaaatattttcccatcccacaaagaataaataagatggctcctcacatacacctacacatgcagaacacacgcacacaaatgtgtaactcacagaagtgatgatagaaataacgaccttctgtgatggctgccctgacaattctcagggtgggggaggcctgaactttccttgtttatcagtcttcccagattaaccacctttctgtgtgaatcagaaacctttgttccatggtcacaagagtaagcagagagacatctagctcctaaagcttcctgcctgtacagaaaagcattcttgaactttaatctgtatgtaaaggctatcctctttcctcaggacagccatgacacacatttgctcacacagtctcccacctgtccctcaggaactattttcctggggaaaagtaagtttgtatgacaattaaaaaaaaaagccaaaaggggaatgagggaaggagggaagaaaggaaggaaggaaggaaggaagggagggagggagggaaggagggagggaggaagaaaatatagcaatgcaggaatataacgttaataagagttaataatttaccaatataacaatatagtgtcataaaaatataattaaaaagcaaatacttcttccacatagaaaatctcccacaatgctgtcaaaacagacactggtatttttgtttggaaactggcaaagtaagtaagaatcacaaccctttctatgtagctatgaacagacaacccatgccatagatgtcaccaagatgaagcaatcacggatcaagcaggtacacttgatggtcccctcagtcacaatgatccttctagtgtctgaagctcacactcctaaacatacctggtgcttggggtccctagctaagttagcaacatgccttcatctagaggaaacattagtgactatctctacagcagatgctcttacagcttgagaaatctcacctaaggtatccccccagcctcccacagaagctggaggggggcctggcactctttaggacagcattcaaagacatagatgacaagtccttgagaaaagagtcccaggtcatgaagctgccacaagacctgtctggtcttctaaaggactgaaaggaaagaaggagaataatcttgcccctcttttttagtaatgagaattaagcctctcggtgaaattttgtatttatcctcatttaacccaaaataactcccctgggctacataggtttgggagcaggaggtgcaattgcagcctttttgcttgaagaatcccgagctcgcaatgcacggtgaccctctgaggccctgagaatccagcttagcagctctgtagcttcagtatgcacaggaatcacctggggtcctcacaacatgcagattacaatttcaactctggggtggggccccccatctctagtcagctctcaatatacttagaagctgtacgtctaagccccaggtgaaggtgggggtgctgtcacaggccgcactcaaagctgcttctgtgcagtggattgtcccaggtctcagcagtagacatcccgaggtcactaggtgcctacccttgaattaatcccccaggcgcttttttatttttaatttgaggaaccccacaaatcaacaatactaaggaaagattctgtctcagaatagtataaagttagagccttaggagggtaagagggcacattaatccccaaggaggggggctgacaaccagggtttcatctctggggtcaacactgtagaaaaagaaaaaggaatcctgcacgttgtcttctgatctccacacattcgctgtggtacctgcacatctgtacacacatatgcacacacacacacacacacacacacacacacacacacgttgctcatgccccttaggtggagacacaatccatcttctgcattgttggcccattggccctgtttatgccatctagaactagagaacacaataaaaatggggagtgctaacatctccacaaaacctttagaacttccaggcaattttctgacctcagattttatcaacacaaccctttacatattcaaatccaactatctgtttgttaccactcatgttaggactcacctattttagaagaaactccctatagagctccagcctctctgtacttctatttccttccctgattaatatagtttctagtgcctgctatttaattgagcacaaatttaattaatggcaataaaggagttagtccttatctcagaaaaatgttgagtaaagacttcctgagcacaaacactttcatttgcttagcttatcggctacattagccataagtagggatttctgagcaggaattaaacaaaaagcatatccttatagggcatagtagcaatggtgtaaataagctgtgcacccagcaggcctgctggaaatatttacgtctagcagtcagctcttactacaagacctaagacattaatgaggaagaaacatttatgatagcctacaccttaggagtctattacaggtcacaagcaatgcttatatggaaggcagtacttagtctattctggatgctataacaaaacaaccataccctggataatgtatagacaacagaagtttactcttcactgttctggtccaagatcaaggtgccgttaggtttggggtctggtgagcccaacttcctggttcccagacagctgtcctttcattagaacctggatacaaagaaagagcaccagagtttttctttcacctttaaaaaacaaaactaataatgacactcattacatccctgaggcttgtcctgtgactgggtaacttccaaaatacttctcctatctgtagtttcaattttgaagctgggaatccagcatacaaacactgaggggacagagacattctgaccatagatatggtaacttatacttcatctcagctggtgcaactctcagaaaacaaatgcttcccttgcttctaccccaaatctagcttccaaatataaagaggaagagagtgtgggactgggggagaccagctctatctaataggctcctcttcaacctgccctgtctgtgctgccagtgactcacagcacgcaaactccaccttcgctgagaagtcctgagtctggaaatcttgcaggtagagaattttgagttattgccaggctttctggggaaatccgaagtacaatgttcactataagtttgtctcatgggtcattcagttctctgttttatggcctccaagatgggtccgtcatatagcaatgagaatgctacactgcaggaaaatagagaaagcttcaacagtagcaggtgggtctttgttctcagtgactccacttctgtcccttcaaagtgagggtctagagcatttgttctcaacctgagggtcatgaccccaggggttcccatatcagacagcctgcctatcacatatttacattacaattcataacagcagcaaaatcacagtgatgaagcagcaacaaaataattttataattttatgcttgggggtcaccacaacatgaggaactgtattaaaggtttatagcattgggaagggtcacggcgttagaaggtagaaagccgctcttctaaatctcaatgtcctggcagaattccaaatgggggcagtggcctatgggcactgagctctcactgttccccgacacccatcgccacttcctcacaccaaacccaggatgggaaaacagaatggcacacatgttcttctctcctcattcccttggaaccaaaggtgatgtcatctcctacatccttaaccagcctgaacctgctttacagacaactctcccccattggccctgcctcacagacagtagaggagtgaacaaaggggcacatgtaacatgccaggaagaaacctagacacatgtgaggcaggtaacactgaggatggtaaaactgagagagcgaagaaatattcctggataaggccatcgagctactaattaacccaggtgtagcggggactgactttgatttcagtgtaaatcgataaacttgcctctctgtcccagctgtttctatttggggtctttaagtctccaaacaaatgtgctatccttctgaaatattcctaatgtccagcaagacagatgaatagtctggtgaatctggccaagatgttaaaagaactattgatgttaatactcttgggatgacaagtacaaaagcccccagttaccttcttctccatgtcctttctcatagcaatttgggataactgcttagcctgcctccatgccagctggtacctcctcccctgccaattatcgggtcttgtactaaagcaaaaactacatgtgattcgttactgaaaacttgttaactcaacctacttttcatggttgacaaagttcataacctggtcttcctgtttcttcagcttctgcccatctttgactgacatcctgtgtctcagtcagccctggttgagagtcccaggattcactgtgtcattcttacctttgagcttttctggtccttccttgggaacaatttcccaacactaaagtgtaacaaacactcattcttcattctttacctgatgaactcactttaccagaaaatatctcccacatgtatctttattttatttcattcatgtctgcatacgtgcacatagatacgcacaagttcccatgtagactagacaggcatgggatgcctgggcactggagttaaaggcatttgtgagctgccagataagggttctgggatccaaaccccaggcctctgatagagtagcaagcagtctcaaccactgtactgagccgtctttccatctctagaagtatacattaagaatgagcttctgaaagcttctgtttcagctcctgctagatgctggggtggtatgaggatcccatgaacatgcaggagggttaaaagttattaaacagagagttgatttcatgtcacatcatagcacagtcatggaagactcctacccgcatcagaaaacagtcataggaattgtcatcataagaagccacttagcctgaccggtccagttcctgtgggaaagggagacaaattcagccttctccacctacttacttcccagggcaggtgtgagagtggcttcaggaagcctggcctggtgaggcctgactaaaacaccaatacagaggctaagtcagaaggactcaaagtgagttccaagccagtctgagctatgtggtaggaccttgtctcacaagaaaaagcagggaaaaatgaagggagagaggggggtagggaagtggataaatcagagcacacgggtgtttctaggggcttgctaatttcaccatcaaatttcctctccaaactccttagcatcggcttgaccttcagaagtatgcccgtgttacaggcctcacatgagcatagtgcatgcatgcacacgtgttcaagcatgtccacatatgtgtggatgcctgacatgtctgtctactctccatactgtacttcaaatcctaagaattcaagttacttattatattcctagcaggagcaaaataaaagcattttctctaatggcaatcaggcagagaggagtaaaattagcttcaaatgagcatgaaagagcataatggttcagattgcaggaaaacagtacatcccgcagccttttccttccttctcattctttgtggtgaagcagagaatcatgcccttaggttttccacacaatatgtgtagatgggagcagaaaggagcagcaggggtgtggatgcaaagacggtgcaattaaaaggacaaaggatgatttgtttgtctttaacacgctgcatcttcccttcaaagtcaccacgaagccaccgtcgtcacgtaatgtaattccaaaaaaaatattattttaggcaaaagaaaattctatagacggacacatattggatgaagtattgcttgtggtgtaattttaattctgaaagatcttgctaagagggcttatttaaataggctttccctgagatgaatatttaggagaaaaattcctacaggatgatttatagcaaaattatatgaacagaatgaaggacagaagaattttattagaaaagggtctcatttccacaaaatataaattataccttttagaaaatatattgaattttattaatattctgtagacagcctgaagtgttaatctccacccctacctataagagtttcattatgatgtacaaggtgtatttaccctttaaccaaatcattttttgagcaactcagtggagtctccagtttacataccctacaaaatatttttattgcatttacaaaatgtatatttttgtattgttggcaacttgtaatggtctatgtgtgggagctatctttttatataaatattcatgcttttgtcattaccatgccagcacacatattaaagatgaacttctgtctttgatagccaaagaagaatatttgttcaataactcctgtcaatgttattatcatattaacttccttttaatagggatacaatttgggctttttaatgctgttattaaaaattttccttttatcatgttaaagtttatagtcagaagaattacttggagtatacaagtgatcaccatatttattcctggcatttgaaaatgacctcatttagaccttcgtagctaatatttttgatgaggaaattgacttattgtgatgtaaaggacttggccataaatccctttccagtctctatcagtcttgaaaattgagctccttaggttgatgactttgttgtaaggaattataggctaactttcatagatgaagtgcaggcttcagcaaggacaagttcaagtttagactccacaccatttgcagtttggctccttccacagaaattccactttggctttgtttgtttatgtatttatttatcatcaccatattccaaaagttatttgagatgactcagaagctagctacccatgttgtcgagttttagcatgtgtcggtcagagctcatattggaataagaccacaggacagtttaaccggaggtcatgcatgccgacatctcctggagacccatcactacttcatgctccaaggtctggacaaagcaggaatggtggttaatgcctataatcccagcactcagaaaacagaggataaagaatttaaggtgagtctgagctacatagagaggctgagtctcaaacaaaacaaatcaaaacagatttgtccaaaataaaatggacctgtgaagtcacaggttactaatataatggagtttcttacccaaataatcaaaactgcctcccttaggttgcatacatctccttagaagtgacccaaatgatagagctgtgattattcattcctaatgttaactcttgtgagttacccagctaactcagcatccttgagtaactttgaacctccactgtgaccccttccattgaaactctttctctgcctggttaagattgcattgcttaccttcattacggcaagctactgttgtgaaaatatgtaataacaaaggaaaagaagaaaacagaaactattctctttggcagcatttggggacttgaaaattaaaacctccccattcttcctgctatacgacgacctcaaagcagcacatccctggcatcctctcagatggccccaactgtaccctccctttctttgatttatccctctgctggccctgcaggagagcatcattttcccgcctgccctctgtcctctatatttcattccaggtgtctatcgaggcaacagaagataaagctctctgctttcccttgtacaaaagttctagatggaatcagttcacctgtctgtcactcctcattaaattcttaccctcttcattcacatcctgatctttgcaaatgaacatttgcttaataaatgttcccaagactaacagtgccgagtgaaaatcccacacagcagtaaattattaactcagtcacagagggagtgccatatatgacttttcagaatgagttattatgtggatcatcgtgtaattatgaatttttcaagccatgatagaggaaaattgaatatttaatattttatggacatattctacactgaggacatctttcaaaattttatgataatttttagagtgagcgaagagcagaacaaaagttacaaaataattgcaaacttgaatatttaatcactagggacattgttggttatttctcaaattatataacgtaaccaaggctgtgaacttttaatcatagtgaattcaagtgggggaaaagtacattaaaaccaagtgacaaatatgttttaagttgtttaagaaatcagaatacaggggttagggttgtcaaattcaggtcttagagtataaatactccatttctgtgagaggtaatctttagtgttttgttctaagtgagctattgttgaagcaaacaagtttgttaaataaacacttttaaaatgttcaaaaccaatactaagatacaaactccaaaatcattgaaacgctttgtaagtaaataaaactggcatctgcaaaagaaaagccgattttcagctttgatttaaaacaaaggaaaaagttaagcagcgcatgtgcaatagtgcacagcagcctcagcttctgaattctgagtagggtctgggactcctgtgtcccctactgccgactcctgcaccccgtcatgatgtgacacttggctcctcactttttaacttgaaaaactggaacgtttgctgatttcaattttctcctgtaggttttcctggttgctgaagagatccatttcttgggtgctactgcaggaagctttgtggggtatttaaaagccgagggcctcagccctgagctaaataaataacacatgtattctgctcaccccggtcccagattccaaactgattagtgaaatgatgctgggcatagactttttttttaagctcaggacatttccattttcatccagggtttaaaatcactacaacctacaattcttcctgcagaattacccattctggtgaaatgaattgactggacagtatccctgagtcatggactctcaagaaaccatttacggtcaacaacggcttttcctcttttgtgtctacaaaagtccatggctagtaattttctaactgttatggcttagaacgggcttcttaaaaatctagctcccactcagatattctagagaagccatgcttttgcaggcctatgtttttattctgtttgcagactctgccagaattcctggttctcacatgtcagttacctcagaaagattttcagaaatgtctatgaccaacaagtccatggggaatatacgtgggcagattcctcacactgctgagggcagccacatgtcttaggagctccggttgaggggacatgcaaagtgtaccaagggacactgagaaggacgcactagcagagctctgtgagacaggtggaatttccctggagcacagaggcaagggagagcctttaccacagagctgatggcaaatccagtcgtggaagcagagcgcgaaatgtgtgtctggcccactttagtaatagtcaggaatccagacagtgggtctcccatcctctttgacttacagaactatgaaagaacagtgcaccagacattctcttcaagtggccaagaaggctagtcaagactcttgcaacagaagaaatattaaactccattcacctgaatctaaaggcatgggattttattttcttatttgttttaaccttgacctgagtgaatggcaacttggagttcccagttagtgaagtttgtcaaggagttgtttacattactttgccaaattaggctcctcccttcccaaagaggatagggcaggggagacaggggagctgagtccttccttgattacacttcaaagtgatagctctgaagttgctaacattttcaagtgggagaaaatttgcatctcaaaagagcaaagaatgaatttacaattgtcctttctctaaagtaaaagtctccccccaaaaagtgatgcagagattgaagccagagggacagtttgaaaccgttatgctcactgccacagcccatactgacccaactgtttttagattattcgctagtctgcttatacctaagatccttctggcaatgcaataaaacaaaagtgctattagctgatgtggtatttggcagcctcccaccctcttgatgagaatggtcatttactattgcctcagcaaacgtgagctagaaaatgtaaattgcctacaatggcctccctctccttcctgtccaagttgtgtctattcacccctttattcagcaaatgccaggccttgtgctgggcaagagagtatgcttactccaatcaaagtacatacgcttagtgcattatgcttactaaatacacaaactctaggtatcataggtggttatgatattatcttagcttggttccttttgctgtgataaatatcacaaccacaagcaacttggagacaaaaaggtttatctccacatacactttataatccatcactgaaggaagtcagggggcagaaaccttaagcagagaccagggaggaatactgcctactggcttgctctccacggctggggggggcaccttttttttttaaaacagggctacagactgtgggctggaatctcccacatcaattgttaatgaagaaaatgatccatggacttgcctgtaggataactaatggaggcagttgatgaccctacagaagggagacatggtactaaggaatgtagatcagcaagagattatcaaggtaatagtttgcctttggaaaatgccttgaggggccactcaaaagcccctaggccgaattcaactcagtcttttcttgtcactgtagaagctactttccagagcgattaaagaacctaatacttattggaaaaaacacactgatctggatgacagaacagctttaggagacaaaaacaaaaatatcaggtgaaactgtaaatcaaaactgataaaggaacctccccaaagttagggctggggaaaggttttggttttttttcttttcaggaaattaaaaagaagcatcttgaagaatttaaagacctttggacaaataagcatccaaagaagaagtgacaattacccaaaaaaaaaaaaaaaaaattaccaagaaaccatctgacctccaaaaacaagattgaatctaaactgggtggaggtcatatatgtctttaatcacaccacttgggaagcagagtcaagcagatcccagtgagtttgaggccagccttgtctacaaaatgaatttcagggcagacagggctgttaacatggagaaaccctgtcttgaaaaacaaaatggaataaaagaaaaggaaaggaaagaaaaaaaaaagaaattggaaccccacatcaatttcaccagaactataacaacaaaattaagctgaacaactccaactaaagatcagctctggactacaaactgctgctctgaacagttttgaggtgaccgactgagacgatccagcctcacagactactctagccaggacttgagacaagccctgcactttccccttatgcagagcctggacaaaaatgatacagcttgacagttaacctaaaatttttcttttcaggatcccgtaaagatgctgtcacccccagacagcaggaagtaactttaagaacatgatgccaacattcccaagacatggggtgggtggttttttggtcactcattaggttatggatatttgtcattgtttaggggtattagtttacaaaatgttgatggttactgtcaggaagaaagttaaacaaaggggattagattcaaggttcttgttttggaaaaaaaagggaagacagatataggataaaaggaatcttattgaatcttctttttaaaagcaactactagttttaaatattttacattggattggacttttgtatattgtttataaatattgtgtagtgatacaaatttgagattaattttgtcaaaacatactgtatatacatttctaatcttgttcaagatattgtaccaaaaagctcatttaacaatgcaatacaaatttctagtctttgaaagttattattaccaactatataaagtaatgaggaactgtaggttagtaactagtcaactattacaatcaaacttgtaatcatattaggtatgttttcaaagtcaaacagagatatattttaggtagacaagtcatcttcaaacacttaagagatctacagaatatgacatttaaaatgttttaataacataggtcaatgtttttgacaatgagacatgtctgctcctggcagcatcaatctacttcagagaagataatggtcattgaagaaactcacatggaatttattttctttgtggaaaatgtaagcccctggacaagaaaatgaccttgtcttgattgatgacagtatgctgtccaaattggacaaacaggacacaaaaaaagagtgactgcagaccgtgccaagacaaggcggggcagtcattcaaaaatcctgcttcacaaataagtctgtcagatatgctaggtctacaagccaaagatagatgccctaatgttgtagaggaaccttgggtgactatctaggcagccagctgtttttatcatttctcacaatatttggaagttgcttgttcacgatttctgcttactcagttaatattatttccttctcgagtctctgagggagttgaagactagatagtatggttacagtttttattgcttgccagactcagaaaagaaattcactaaagatatgtagagtatataaggttgagagacataaaaagataatttgacaatgcaaattaaaatagaaagtaaattaagtacaagactttggactcaccaagaaaggttatatataaagtatatttctgaatttgtcaaatgcaaatgggttagatactttctctgaatttgtcaaatgatgaacttgtcacctgtatatattgtatatacttattatacttattgtatatagttttcttatattagatgtaattttcctttttgtattagacaaaaaaggggaattgtggtgatatattgtttatgatttattaaaggcactggagatcaaaatagcaaagtagccatacttgtcagtcaaagaagccaagcacacacatttaaccccagtactcaggagacaaaggcagatggatctctctgagatcaaggccatctggagctacaggagattgaattagtctaaaagagtaacagagtttgtgcctttaatcccagcactagagagatataaaagagacttttatagtcttcagtagtcagtctcaggattattcttcagccatgatgaggagaagttacagtctgaggatggtgagagctcgttgagacaggatcagcccttacagcctgagttggaactaagagctagtaggccggctgctttgctattttgatctccagtggatttattaaatcatacacaatatactaccatatcctactttctgtcaagttacaaaaactaaccagcatggatatggctagaaaaactataagtgtttggtaaatgtttgtaataagtcctgtggaagttctttctgtcgtttacattattatcagtgtttcttatcattctatctgtgcccattattgtcctgcaggttcaatgtatctttattatcaaatggctgctctgcacatgaggaggctaagtaccagggcagggaaataatcttccaaggtcacgtgactattaacaggagattgggattctgacctacatctgtgtgactctagggtgatagtgatagcaagttggacaatacatagaacatcacagatgtctgtagatcatcacaaatgtagaccatcacagatgtccatagaccatcacagatgtagaccatcacagatgtccaaagactatcacaggtgtctgtagagcatcatagatgtccataacccatgacacagcatatgaattcagaatctgtgttggtggtaaccctcaagacaacagcagtacaccaagcattttcagcacctagcagggcatacagacatcttattgaaacaaagaatgctggacacctggagcagagtcaagcacctaatgaagtctttctgtcctgtgtctccaaatacagaccatattcacaagctttgctatactcttatagcacttgacctatataatttgttcaaatatttataacgaacacccactatacatcaccacagagaatggaaggaagaaagccaaaatcagccactgctattaactgaaataagggtaacaccatcacagtgtaaatatgtatatctgtgttacctacattcgccttaaatacctcactcgtctttggtttccccttccctgtcctactctagacttcattccaattttttccagatgcagctgtttctctgtgaagatgttctacatcttggctgttctgcactttcattctaccaggcactccactaaacccatcagtgagtggtctgggtaccctgactcagggcaactcactgaacagcctgatacaatgacttttcaagaaggtgttcatagatcaatggctatcagtcactagaaaagagcagtgagccaagaactggataagggcttgcatggaacatcttgtcaaccctcacaatgttctgatgaagaagacactagtcctatttgaaggcagatgctcaagaatctacctacgacatcacagttaacaattttcaggtgtgtatacctccaaagtctgtaaatcctagagcggttatttcctatagcacaatgactgggggccaatgttttcagctacgctgtatctcatagcagactgccctcccatctcatcctcccccactcttagtaaccatccagagttcagctgccactagccttcatagatatccttctaacagaaatcaaaagcaaaaacacaagaaatctctctttctccctgtctgcatttctattgccaactaccccaaccatcacaactttctgatgggtggcttcccactgcctacagaacatagaacaaagcttacacttctcatagtagtcagcgctcttcacaatctggctgcaaccccactctcctgcattcttcctccccgtctcactgcctctctgtacaccacctagctcccagcaggacaggcttccttgctctggaacagcagccaataacaagggcatgaaaggggagcagatcaaccttcaaattccaaaagctggcaggttggttggtaatcggtgcctcctctgtaatctcaaaagtgggaaacaaattttgttcctctattctaagggttgaactagttatcacaaccagagcacaacacagtgcccagtgcttggcactgcaggcagaacctggtgggcattcaggtcctgctgctgccagccctgtgctcaggctgctaattgaaaatacctcctctgcccagggaagagcctgttctttcagctgtcacctcttagagggagtctatctgagtgtcttccgtaaactcccatctctccttcccctcacttcgtcagcactcagctttggcctctattgtaacactttaaggtagatttcaatgtctagcttaaattcttaatttcaatctctgttacttgcttctctcttaaattaaaccacgagtctgctagagcccttccctatgtctactaaacacaagactttgtacctagtgagtttgcaaatgcttgttgactaacttaatgtttttctctgtttactagattattactagtgctccaacaatattttagtgtgaaagcagggccaatggcgagtggaggaggagatttctttcctaaattccaaagcacatccattttccatgcaaaagtcattttggctccagaatctttgtctgcaaattgtattggtcttcctttagaagcatgagggaatttttatgacaggaaaagctaatgcttacaaaaccttttcattgtaaacgttgattatttatgaactcttacaggaaggagaccctctggacgctggcacatgggagaagccatcccccccccaatttataatgaatgaatgttggagtaaatctcttcattagccagatagagaaaggaacttaccctccaaagtaatcactcatctcttcaaccacaaatgcccccatagactccactctctggtttctctcatgggacagacctctttctgacctgctgagtgcaaagattctggtggcaggtagactccccaaagctagcttctgggagcaaatgcggccacagttctggaaacccatgggtggtcttggctggcaaaatgcagtcctttaagcaactgagtcaggagcccattaaaggtgttaattttacatgatgtggcacaacaagcctataaataaataaacaatgatcccccccagttcctcccgctgcatttcttgtacctgctgcagcctcagccacagcgggaagctcctgacatataccaggattgccctaaaaaacacaaaaaggaaggaaggaggcatttctgtcaccaagataaccaagctacaaggacctctgatgtcttcagcaccggattcagccacctttaggaaattcccatcaacctgccttctgtggctggatatgttcaatttaagatcatcattctgaactgcaagaacaaaacacagatgttaggattttagaaaaatgtactgttgagggccattagaaaaaaatactgtttaaaatatataacatatgtaactattaaatacataaaaatctcatgtaccaagaggcaaaacatgatggaagttgctgaatattttaagtacctatattgctgcgtaaaatggttttgtgccatagaattttctattgcagcagatttatgaaactttgtcaacatggtagatcatgctgaagtcaggggaaatactagcgcactttaggttgctttctatttttaattaagtttgaggctgcatctttgctcttgtgagtgtgcatgtaaataaatacatgtaagcgctggtgtgattaacacccatgcagatctgtgcaaatgcccggatgtacttgtaaactgacccctccaactgcacagattacttgtggggtgggtctgtttaatggttatacttggtcgaataacaaaactccacttgcttggtcagccccactcattctgggaagaaagccccagcaagtccttcctgggttctcgctcaccaacgtaaatcaggtagactaaggtttttgagactagccatgtttacccatgtacttaaagatggaagcagattgagttttcgtaactaactaaaatccacctgatgctaattctagggtcttgctcaaaaacactcttgagaattaaattattcaggatacaaaatactaagcaaacataaactaatcaaaacaaaaacaactgataaccaacagctcagatacacataactgagggcctaaggtgaagaaagaaagagaaaccaagaaccgagaattcccaaaggacacaactcaaattctttctgtccataagctgccctgctgcctacctccatgcttcagtataaactcccaaccttgcatacttgcacacatagtaacacatactatgtaatttggcatggaattgtgtacttttctatcttgggcagatgctttctgtgtttgcttccatccaaacataaccggaccactctggaggtcatcaactccatctcacacatctgtgtttctctggggtctagtagagagtgagacacattagaagttctgtggatgagcagttggtgagttgttgggggttctctagcaatccccctcggcatttcctcatcccactgcatttgcaccgtcagctgaggatgcaaatactcatacctgaggagtaggtttctatttactatttaccttattctttacccttttaacacaaaattacatgtatgtctaatactaacataaaattccactgtgaagtcctgtcacaatgtatttggttccttccctattggtgaaggaatatgctaaccatttcctagaatgccataatggtattacacacaataaacatctatgtgtacttttgttctagtgtctctatttcttcagactctaggagtgggacagaggtaatggtcattttgaattttttcacattattagtgatattaacaatttagtttcctgaaatgtttcaaagtcaggcacacacaatattgagtgtttttttttttcaccacacacttgacagtacttgctaccttcaatatttttacaatttagcctcataaatgaaagggctaggttaaaaaagaaagaaaataggaaggaagaaaataaaggagttatcttgttttgttttcagttcctctgactgctagtaaaattaactgttttcattattcatcagtacatgttcttttaaaaactgagttttcttttgactttttatctttaatgtaaaggcaatcatagtactttagggatgtctttcacttgtaaatgacatacatatcattgctccagataaatcttacaccttgtaaacttcatgaggacaatcactgcatcttagagtttgtcttacaagcccaggcttagcatattttttgtaattttttttagttcatattaggaacaagcttgtttaacatgccaatcccttctccctctcccccccacccccaacctcacacccaggagacatgggatgggctgtcaaagtcccttcttacatcagggaaaagtaccaaaccactaccagggaccccctagagtgcagaggcctcctcattgacatccatgttcaggggtctggatcagtcctgtgctggcctcccagacagcagtctggggttgatctgctcacccttgttcaggtcatctgtttctgtgggtttcaccagcctgctatcgacccctttgatcttcattcctccctctgcaactaggttccagagttcagttcagtgcatatctgtgggtgtctgcctctcttctatcagctctagggtggaataaaaagtcatcatcagtctcatcataggggaaggacatttaggcgatcctttccaccattgcctaaattgtcagtttttgtcatccttgtagatctccggaaatctccctagtgccagatctctcctcgaacctataatggttccctctgagatggtatctctcatcctgctctcctctttccccaaatcaacatttctgctacatttcctcctctcccctcctcttctcctcctctcattctggcagctccctctcccctactctcatgctcccaatttgctcaggagatcctgccccttcccattctcaggggtccatgcatttttccctaaaattcctggttgtttcctagtttctttggtgaagaggataataggctggtaatcctttgctctattctaaaattcatatatgagtgagtacataccatgtttgtctttttgtgactgggttacaaacatcactcaggatgttttcttctagttccatccatttgcccacaaatttcaagattccatttttttttctgctgagtagtactccattgtataaatgtaccacattttctctattctttcttcagttgagagtcatctaggttgcttccaggttgtggctattacaaacaatgctgctatgaacatggttgaacatatgtccttgttgtatgaacttgcattatttgggtatatacccaagagaggaattggagaatcttgaggtagactgattcccttttttctgagcaaccgccatactggtttccaaagtagtcttccaagtttgcactcccaccagcaatggaggagtgttcctttttctccacatcctctccagcatagattgtcattggtgtttttgattttaaccattctggacagtgtaagatggtatctcagagttgttttgagttgcatttctctgatggccaaggattttgagcactttcttaagtgtctttcagccatttcagattcctctgttgagaattctctatttagttctgcaacccactttttaatttcattgtttggtgtttcggtggctagcttcttgagttccttgtatattttggacatcagtcctctgtcggatgtggtgttggtgaagattttttcccattctgtgggctggcattttgtcttgctgactgtgtcctttgcttacagtagcttctcagtttcaggaggtcccatttattaattatagatctcaatgtctgtgctacgggtgtaacgttcaggaagcagtctcttgtgccaattcgttcaaggttatctcccactttctcttctagaagattcagtgtggctggatttatggtgagatatttgatccatttgcacttaagttttgtgcatggtgacaggtatgtagattacttttggcaagattgccatttttactatgttgattctgcctatccaagagcatgggagatctttccattttctggtatgttctttaacttctttctttaaagactcaaagttcttactgtacaggtctttcactttttggttagtgttaccccaagatattttatgttgcttgtggatattgtgaagggtgatgtttctctgatttctttctcattgcatttatcatctatctgtatatagtagggctactgattttttttgagttaattttgtatcctgctgctttgctgaaggtgtttattagctgtaggagttccctggtagagtttttcaggtcacttatgtagatgatcatattacctgaaaatagtgaaagtttgacttcttcctttccaatttgtattcctttgatctccttttcttgtcttattgctctagctagaacttcaaatataatattgaagagatatggagagagtggacagcttgtcatgttcctgattttagaggaatcactttgagtttctctccatttagtttgatgttggctgttggtttggtgtatattgcttttatcatatttaggtatgttcctgttattcctgttctgtccaagatctttatcatgatgggatgttggattttgtcaaaggatttttcagcatctagtgagatgatcatgtggtttttcttttgcagtttgtttatatggtggattacattgatggatttttgtctgttgaaccatcgttgcatagctgagatgaagcctacttgatcatagtgaatgatttttctgatgtgttcttggatttgattggccaatattttgttgagaatttttgcatcaatgttcatgagggatattggtctgtagttctcttttttagttgtgtctttgtgtgtcttgggtatcaaagtgattatagcctcgtaaaaagagtttggtaatatcccttctgcttctattgtgtggaacaatttgaagagtactggaattagctcttgtttgaatttctggtagaattctgcagtgaagccatctggccctgggcttttttttgttgggaggcttttggagactgcttctatttcattagaggttataggtcaatttaaattacttatctgttcttggcttaattttggtaagtgatatctatctagaaaattgtccatttcctttagatttttgaattttgtggagtacaggttttcaaagtatgacctgatgattctctggatttcctcagtgtgtgttgttatatcccccttttcatttctgattttgctaattagtgtgctctctctctgccttttggttagtttggatagaggtttgtctatcttgttgatcttctcaaagaaccaactctttctttcattgattctttgtaatgttttcttagtttctactttattgatttcagccttcagtttgattatttcctagcatctactcctccatggtgagtttgcttctttttgctctaaaccttcaattgttctgtcaattctctagtgggactcttctccagtttcttcatgtgggcacttagtgctatgacttccctcttagcactgctttcagagtgtcccaaaagtttgagtatgttgtgtctacattctcattaaattctaggaagtctttaatttctttttttattcctttctcaacccaggaatggtgcaattgggtgttattcattttccacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgccaactatgtggtcaattttagagaaggttccatgtggcactgagaagaaggtatattcttttgtgtttgaatggaatgttctatagatatctattaaacccagttgggccataacttctgttagatcctttgattcttttttaagtttctgcctggtggtcctgtctagtggtgaaagcagggtgttgaagtctcctactataagtgtgtgtggttttatgtgtggtttaagctttagtaatgtttcttttacaaatgtgggcacctttgtattgggggcatagatgtttaggattgagacttcatcttgatggacttttcctgtgatgagtaggaaatgcccttcttcatctcttttgattgattttagtttgaagtctaatttgttagatgttaggattgctacaccggcttgtttcttggacccatttgattggaaaatctttcccaagcctttattctgaggtatcacctgtctttgaagttgaagtgtgtttcttgtgtacagcagaaggatggtttctgtcttcatatccattctattagactgtatctttttataggcaggttaagaccattgacattgagggatattaatgtccattgattgttcgttattgtttgttttggatttattgttggtagtgtcactgtgtgtgtatttcaccctcctgtttcttttcgtgtttggtaaaattggattatctattgcctatgtttttgtgagtgtagttatctttgttgggttggagttttcctttcagaactttctgtagtgctggatttgtggatatgtattgttgaagtctggttttgtcatggaatatcttgctttctccatctatagtgattgaaagttttgctgggtacagtagtctgggttggcatccatgctcccttagtgnnnnnnnnnnnnnnnnnnnggatatctatctcaggagtgattctgcctttatatgttacttggcctttttcctttgctgctcttaatattttctttttattctctaggtttggtgttttgattattatgtgtcgagggcacttctttttgtggtccagtatgtttggtgttctgtaagcttcttgtactttcataggcatatacttctgtaggttggggacgttttcttctatgattttgttgaatatgttttctgtacctttgagctgtatttcctcaacatctatacctattattcttaggttgggccttttcatggtgtcccatatttcctggatattttgtgttaggaattggttgaacttgagattttctttggtctatgactgtatatcctctagagcgtcttcaacagttaatattctctcttccatctcttgaattccaatggttatactcacatctttagttcctgatcgtttatccagcctttctatttccagtatcccctcattctgtgttttctttattgtgtctatttctgctttcatgccttgaactgttttgagtgcttccttcatttgtttggttgttttttcttggctttctttagattcgttaagagatttgtttatttcttgaattttttggttcgtcttttcctccacttcatgtaattttttgcttgtttttcttctatttctttaagggatttttcttgtttcctcttaaaagctgtctatcatcttcctaagataatttttgaggtccatctcttcttcatcctttgtgttgggcttttcagatcttgctggagtggagtccctagattgggtggtgtcatattggtctttctgttgttgagtgtgttcttattcagtcttcttcccatgtcttcttccagtgggtgcaggtgggttctctctatctcatcttgtcacccggtggagtgtgtgggccaagacttcaatgtctgcagctctggatggtcttgcctttcctggtagtctcctcacttggtaagggttgggctggcagaggaaaggggaaggaagagtgaggtgttgccagactcagggagcttttccctgcctgggcgggtccactctaagcaggtgcacgcccagagagatccagtgtgaatgggaagttgggtaggaaaaggacaggagcagagggtacactcatcttggtaggggccaggccggcggaccaggcttagcttattttaatgtttccactgagggatatttaataaatccattccacaaatttaaccaatacttagcaacagtgatttaggcacattttctgagccattatttagttccatcatatgaggatggaacattcaatagcatcagtttcctgaaagatcaagtgaagtttttctttttgtaggccaaataaaatcccagttttgtgcctaacactctgttcagttccctgcaccttaggtttggaaagcagctgtctcagaatgcattagagcccaagcatagtattgaggctatagctgtaaagagcattagcagtgggtagtgacgaatggagtaaaaagtagttctgggcaattgcaaatatgggtgtgtacacacacaccaccaccaccaccaccaccaccaccaccaccatcatcaccaccatcaccatttcagattggtagtttaattagagcacacatctcccccattttatgatatagagaccagcctttgtcaatgcagaaaaacagaacacttaaaaacacacaaatgcaaataaatatgaaataaagccagtgagtgtttacactatgcataccagaagggaggttgattttatgtaatgacaaggcaagtttttaaggtcttcagcaaaatttacagtgacttcggggatttaggaaagcatttggagcaaagtagggtttggggagtttgtttaatgaaacaagaaaataatctgtgagatttaggaggcatgcgtgtagaattactgtactgtgggagtttgaataaagaaagcagtaagtatcagaaaattcaggtgatctggagcagttttgaggtttgaaacgaggcagacaaggagtcaaagtctgggacaataacatggaggcctagtcattttcatcctaatggatgtcccctgaatctctgtcactagtctccagtctgacaaaactaagccagacctgaagctaaatacagactctgaatttcatttcaacagagaacacaccatccattttacatataaaacaaaagaaaatgccacaaactgtcgagctgctgcttcagtggaactaccagtcatttttattttacacttttctgttatcttaaagatatttttaaggctggctattcttaaagcagcaaaagccaatgtttgacaaacatgctctcgtatagcctatttatagctggtgcttggttaatgctacactctgccatgttctgaagttcaggattttctaaactaattaatcagaaatcagagttcttcgtgccaaagattccactctgtcgtggtcttaactgcctgcttcagttggtggggaccaagagttcacacgtctaccattcattctccattcccaacctttatggattttctagcatatgacaaagggccagtttatgcagagaaaacaattatgaaatttgctttcacacacattttgccactatacctttgtctttatctttgagaagtttttgtttgtttgtttgtttgtttgtttgttttgttttgttttttagatttaaaaaaaaagatgttttgaaaggcatctctgctcacctatgcccccagtgctagggcttccagggattcataaagactgaagcagcgattgtggagcctgcatgggtctacatcaggtcctctgcgtatatgctatgtttgttagctttgtgcttttgtgggactcataactgtgggagtgggggtgtctctgactctttcatatgctcttggaaccctttcctcctacaaggttccctcatccagccttgttatgagggtttgtgcctagtcttattgtctatggtgggttgtgttagaggcatgctgttttctgaagggaaatgaaggagggggtgatctggggagaggggacgtgagaggagtagagggaggggaaattggggttgtgatatattcagaacaaaaagtaaattttttaagtggggagtaattggaaagacttccacagaaatagttgtaactcacaaaagtttggcctatttgattgatgaaggagataattacatccaacatatttcaaaattctcttgtatgtcttaattcactactaaattaaaaaagcaagtgaagactatctgtagaaatacacagaaggatttcatcacatggaaaatttacactgttgcaattctatgtggcttttgtggcactcactcttaatgtttagattttgggagacattttacaacagctagaggatagctgccccagaatcccctacatccaccccctgccccttccttctggttccctaagaggcagccagaattctggtggctggtttcatagctaactttattggtgttctgaaaacccaatgcctcaagaatctcagagcactcttttgagacactacagaaaaatccagagaactcccaggagcttagacatctttattactcatatgtggtatgagtggtggcagctagcaagcagggagtaggggctaagagtacctgcaaatgggtaggttgcctacgttctacacctaactccacaaatattcattcattggttggttgtcaggctatgcaacctgtaatactttaccacatttaagatttgtgaaagtaagaagtctaagtggaattgtaacttttgttgtaaatttacccaaaaatcttattgctgaaatctcaaattgcagaaaactggaaatctattcttgcttttatttgtctttgatttttacctttcatgggattcatatctgaatggggtgttagagaaaagaaaaccttagctggcagtcaggagacctggactctgtgttagttctgtctgaggataattgcttttctataggtcattcttcaggcccctcatcagaaaatgacaggtgagacaaatggtgcctgactcgatacatctgaaaataatctctgatcttcccagcaagttcggaaaacaaggagtgtctgcacacacagggatgtatctgtgtatgggcgactgtagggaggttgtctgtgtgtgtgtgtgtgtgtgtgtgtgtgtgtgtgtgtgtgtgnnnnnnnnnnnnnnnnnnnnnnnnnnnnnnnnnnnnnnnnnnnnnnnnnnnnnnnnnnnnnnnnnnnnnnnnnnngtgtgtgtgtgtgtgtgtgtctgtgtttgtgtgtgtgtgtgtgtgagtctgtgtgtatgtgtgtgtgtgggtgggagtgtctgtgtgtgtgtgtctgtctgtgtgtctgtgtgtctgtgtgtgtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgtgtgtgtgtgtgtgtgtgtgggtgtgtgtgtctgtgtatgtgggagtgtgtgtgtgtgtatgttcgtgcctatgagccctatactgtacatattgcccataatgtaaacatgtgaagtgagatattttcaggatgagaccatcagaaagacatttataaacagctggggaacctgcataagactgaaccaggccacctgaatgtgggtggcagttggggagcttgggcagtctatggggctgctggcagtggaaccagtatctatccctagtgcataaactggatttttggagcccattccctatggagggatactctctcaccctaggtacaggtggggaggggctcctcctccaccaaatgatgtgacagactttgatgattccccatgggaggcctcgccctctctgaggaatggatggggggtgggatgggggattggtgggggaatgggaggacaggagggagaggtaactgggattggtgtgtaaaataagtttgtttttaatttaaatttaaaaaacaataaaaaattatgtccagttttcttacaatgtcaaagaacctcaattgtttacagttgttaatagtattgatagaaattttttcacatacacagattcctttaacctttagtacccagagtgtatacggcatcactaaagcaaaagcagaaagacggggttcttctgaactgctaatccacagaggaggcggttattcgtgaccctaaatagcagcgggttcaaacctcaataagtctgtttgctgtgattatgcaaatgagatacatctgtgtcttttatcagttcttggaaagaatgtaattaatctctgatttaaagacaagtcctcacaacgcagtgctgtctgtctgtcttgtgtacagtatgggttccatggagattcactagctgggtatttgacagttgtagatgcttggccctgactattctgacctggttttaaattacttctctgtccacaatgctcagcactgtcatagttgaagcacagccatgaattgaatagctccacttcaaaaagacagttggcctgtgtctcaaaatcaaactacacatggaaaatgcaagatcaagtcttacactcgctctgtgagggggatgtatttgcctttaacacacctgcccttcagcgacatctctcccatcacgacagataacgttttgaaatcctccccccacataaagtgcttctgtgtatctgtataaagtcatttgacttcatagtccattcaaaatgtgcttcaaagacactcacctaatctatttcttctaaacaatgaagctcgtttgactgcagaaaaagaaaatattgaagaatctactccagtggctttgaacactgcccagggaaagggcgccttaagggaacagttgagactttgaaaaccctaaggagctttgtagctgaaatagccttgtaacctctcaacagctttttacaaacaaaatctttcaagctccaactaaaagagaggtgagcaacaatttgaagaatggggttttcctttgtgccagattatagagcttggcggttccaacctttttgttgtattatatttctgatctaaataaggaattatttattacctgaaaatggtggtattcagatcacaagtctcctcagagcactgactttgatccccaactgtacgtggaggtttggggaggacagccttccttcatatttggagactctaagagccatcctcagaagttgcctctccaggcaaaagacatgagaggctcttgtctctaacattgaacctctcttgcacgttcttgatctcagtttgtttttttaacgcttgtgtcctcagtagcttcatgctttattttattttatgttattttattttaacacagatggaagttccccccccacgagaaaaaaaggggggatatctattaaaaattttggaacaagcatggaaacacacacttaaaaatttagcaccttgtaggctaaggcagggtgatgacaagttcaaggacaaccttgattactgagtgagtctgaggcctgtgtctcaatagtaaactacacatgggaaatgcaggatcaaacctaacactcagctttgtgtgtaaggaggttgtgtttgcttttaacacaagagctacacaaagctgtctttataaaaaggcttaattccacaaattttctgctgtggttatcaaaagcttatattctgccatctatgttgcttgttggtgtgacctaggaagtcagtactcaccatagagcagaatgaagtcttctgactgtacctgttacacaactgtcatttggtaccacaggaaaattggtgccattgtaacacttagccctagagtcatttaaaactttttttcctctttttttaatttaaattagaaacaatcttgttttacatgtcaatccagttccctctcctttccctcctcccctgccccccactagcccctatcctaccccctttctgctccctagagaggttgaggccatccatggggtatcttcagagtttgtcatatcctttggaggagggcctaggggtcatccttgtagatctctgaacatttccctagtgccagacttctatttaaaacaataatggctccctctgttatggtatctcttttcttgctatcctctattcttccccccaactcttagaagagaaagtgggaggtacccttgaacaaattggtatagcagactgattcctgaacataacaccggcagtacagacactgagactgataattaataaatggaacctcctgaaactgagaagcttctgtaaggcaaaggacacagtcaacaagacaaaatggcagcccacagactgggaaaagatattcatttaaaattttaaataaagtagctgaaaaaaattataatttaaaatcaacatctcatattcactgaacactgttttgaaagcagactattccttgtgttctgggaaaccaatcaaagttccttcagttatgaaaatgaagtcaatgcacattctgtaagaggctctagaaacctgtctgaggtaagaaagagtgggtgaggatgtgacaggagtgagcaatgggcggtgggcctgagaacttgggaacataaagacatacctgtagagtcaaatgcatggcacaggcctggaagatgaatctctggcatccacatgcttggttctaacaggtgctaccatacttcatcatgccgtcatctttccaaaactcacagcagtgtacattaacaaataattgttatacacaggaactgtagtcagaagagaaggggagggggggagagaaagaaattaggcatggtagctcccagctaccatagcagtacttgggaggctgaggcagaagggtttcatggcttagaaggtagcctgggttgtgcagtggatgtcaggacattcgggcctaaacagtaagattctgtctcaaacaaaggaacaaacaaaagctaataattgtaacagtagcagaagcaacaacaacaaacaaaaaatatctgatatcaacaaggagatggcctcttgctaaccatggcagtaagaacaacctgacaagcatctaaagcccttccagtttgggttgtttaagtagatattctgtataccagaaaacgttttctgcaaaaggccagtgagtaaataattcacacctggtggtcatgtggtatccattactataacaccaaaaagagaagaagaagaaagccattgacaatacacaaaggaatatatgtctcttttccaatggtagttacttgaaaggtaaatagaaggcccttggtccaatgctactgtttggaattccctagtgtagtcaatagcatcagatactagaataacccttaaaggcagtgctgtattgaagtccagctctacagctgatgctgataggcatggtcttaattcaacaagaaatgatagtgcatgctccatgttccttcatcaatacaaaagaaaaacagtgaaaaattatgttataaaaagtatatctagaattagaaataatattagaacttagggaacaaatgtgaaagtaatcaggaaaaggtttcttataaaagaataccattctcatatgtgtgagtgactgaagattttactcataaagtaaagtatgtgtgagcatatactacatagttttggtcaagattagcacggttcaactcagtcactactatcaacataagtagttggtaaaactacagaggagcaggatagttagctctatttgcctttagtagagctaattttaaatttgaaaatagatgttacattcaatatttggaaacttttaacatatgtgtgaccaaacttcaaacttttcagtgtaactgatatatatatatatatatatatatatatatatatatatatatannnnnnnnnnnnnnnnnnnnnnnnnnnngttaagtgtacaatgcacacgaatttcaaaaccagtagaaatgaagaatggtaggtcatgttgactattttcacattgattaaatactgaagtcatagtatgttgaattaaataaaatatttgtgttggattaagtaaaatggattttcaattactcatatttctttttattttcttttaatgtgatagtttcttttaatgtgtcagtcgatcagtgacagaagtcagggcaggactcagaaatcagaggaatactgtgactggctggctctctggcctctcagatagctttcttacacagtcttggtccagctgcttagccctggtgccacccacaatgaacctaatcctcctgcgtccatcaccagtcaacacaatctctcacacatatggccacaggccagtctgatcaagtcacttctgcaatacagattgtatcaggttgaaaattaaaactaatcaaactagtcagtacactctctctgtgagaagctgggaaaggtgagaacacaagctgtttgtagcacgaatcagttggagataagtgagtaagtccacagtcctgctgtttctatggttcagcttgacttgttgaactgagatgcctttctggaaacaaatccctcttagatagctttaaatttctgtcatttagctgatgcctgtgataagaccaatagctgaaaccttcagttttggtagccaggtgaccaagccacttctcttccacaaactcaaagacaggggagttgctggatgaaaggagctcaagcaaacatgcaactctaggttgttttattttattttatttttctattacctggaggagagggtgtgtgtgtaccacagcacacatgtaaaggtcagagcccaacatttggaagttggttttctccttccaccacaagatcaaggattgaactcgggttgtggagctgacacagcaagcttgtacctgctgaaccacctctctgccccggacactcagttccttctgctgctccgagacagaaccaacttttccccaaatctcatagaaacaaaatgtctcatgacaaaacttcgccagacaaggaattccaacagcctgctctgctttaattctctctcctacatttctccagtgtaaagtgcacaaaaggaaaagtcaaaaagaaatgaagaagagcgggaatcaatttggttcactaatttgaaacttcagtaaaaaaaggggggtaaatttacaatgaaagttgtaattccaacaacacctttgtcttataataagccagaagaataatactattcaaactttagcaggttgcaaagatttgtagatctgggagaagagttagaaaaaaagacaacagaggagctgggaaccaggtcaggcaggaagagtgctggtcttgaaaccataagaagctaaatttgacccccaaaatccatgtgagggggaaaggcagggtatgtaaagacagtcaggtttccggggctctctgaccagccagcctaccctactcccctacttggcttgccgggtttaggaccagtgagagcccttgtcccaaaactatcaaaggttgacagagatgctatagctacacctgaaatgaggcagcctttgctttatattttgcatattcacagacacacacacacacacacacacacacacacacacacacacggaagaaacaaagattaggacacatttaaagagacattgtggaaacaatgctcttctgcttgcctgagaattgactgtgtgggagaaatcattttataatcatatattaatgatgtatttatgacacgtatttttctgtatgtatgttgcattctgataaaaagttgagaaatatgttttctaatcattaaaacaaattaaactcaatattctgtgaccagggataatgtttctcaagtggaagcatgacatgaggaccttgacttgattgaggtctcactaacacactagtagaagtttcattactataaagttggcccttcaggcccaatgccagtcaattgatggccagtacaaaaagaactcagcagtacttttggaattttgtttatttgtttgtttgtctcatattgctttgcttgggcttttttttttaaaccttactagtcttttgcttgtatgatatcatttccaatttttatagattttgtgtgtgtgtgtgtgtgtgtgtgtgtgtgtgtgtgtgtgtgtatgtgtgtgtgttactagtgctgcatttttgttgcttgcttgttctttttagtatttttctaatgtttagggaagaaagaaagaaagaaagaaagaaagaaagaaagaaagaaagagaggaagagaggaagagaggaagagagaaagaaggcatggaactgggtgggtgggaggcaggaagaatctgggaggagatgagggaagagaatatattataaaaaattattttcaatttaaaaaatcttgagtgaaagaaatatagacacagtttgagaatgaggaagtgctgcctccagaattattttatttttgtaaataaaattttgtaaattttatttaatttagaaacaatttcattttacagatcaatcccagttccctctccctcccatcctcccataccccacaccccatcccccatccactccccagggaggtaagaccttccatgagagatcatcaaaatctgtcaggtcatttggggcagggcctaagccctcccccgtgtgtctaggttaagagtgtccctccattggagatgggctcccgaagtctattcctgcactagggatacatcctggttccactgacagaggccccatagacggcccagtgctcctagctgacaaccacgtcaggggtcctggtttggtcctatgttggttccccagctgtcagagtggggtccatgagttcccacttgctcaggtcagctgtttctgtgggttttcccagtgtggtcttgaccccttggaattattttaagtaagagaaataaatgtctattttacttgaaagaagaatgggagaaagaaagaaagaaagaaagaaagaaagaaagaaagaaagggaaggaggggaaggaggaaggaaggaaggaaaaaaagtacattcctgcagtgtacaaatctggacaacaagtatggcttgggtgctagctcatctcagagtggaaatattcagcacaagaagtctggagtcacggtgccaccagttcatcatcatctcctgctcctatgggctagtccactttcttctcaactataaccacctgaccccaaaatcagagactgaaagcaacaccactgcaacttgctctcaaattctgtaggtcagggctttagggacaagctcattttgtgatacttctgtgtctagcactgacaaggttcactcagtgagtctcagctagaggatgggatagtctggactgtctaacaccacctcacttgcatgtgcatgtttgacactagaaactaaacagaaggctatgacagctggccagagcatggagcatgactccctgtggctcagcttctacacaacacaatggcctcaaggtaatccatcttttctcttatcaactcaagtctcagggcacaactgtttcagcgatcagagtagaagccagtgccttctatttctagacaaagtcccatcacacagattgttaggtgaagttaccattaattcacccaggttgaaaaggaagggagatatacctgagcccttaacaaaagactggtggggtcaaacaaagtgagaacatgccagagctattgtggtaccttctatggaaattatctctttcattaaagatccttctctcccccaccttctctctctctctctctctctctctctctctctctctctctctctctctgtctgtctgtctgtgtgtgtgtgtacactaaagaataaaaccaaggccatgaacatgctatgctaagcaagtgctgcactaagcaataccttcaactctggttgatccttttaaactcatgagaacataattatcttatttgaaaaaatagtaataatataagtcacttaaggattgttttaaggagtggcaataaggcaacatatgcttggtacattgtcaagttgtaggaaaactcagagcgacatgctctccttcatcccatttaagatggcagatgctgagaaaaagtagaaccaaaagatggctctgagaagatgcaggtagaatgaagcagagacaatgagagtgggggcatcccaagatggcaatgtagtatagcaatccatgttggccaatggctaaatggaagcattctcagctgctcaattttccctaggactgcccttggtattttgccaagcaagccatgggagatgacttgtttataaaagtcactttcattagaaacaacagattgtcttcattcctagggttactgagtaaaaataaaagagggaccccacttttgacacatcctgacactgtctgcaaagagtaatctttcttgagtctctaaacaaatgaacaccagcctttctgggccatgatggcaccttgggatttagcacagagatggaagtatgtaacaaactttaagtgaaataaatggatctcatccaaacaacccccaatgggcaggtggagggaatctgtatcgcaagatgctttattaatacttgatggaaagagcctaaacccctataccacttgacagttttgaaataaacctttgtataaaaccataaacataggaagctatgtaaattaatacttggcttagtcctaaagcaatattttctactgtaaagccattttaacaaacatcagttgacagccagtcaaatgatgttttgtaccatttttaattgcaaaaaatgcagaaatgcatgaaagacaagatgtttagaaaacataactgtgtgtttgctacccggatttaatgtcaattactgaatatctactagatattaaattagcattatatggagagcataatatgtcaaccaccttgtaatgaatacaaattcatgcattccaaaagtcagggtaatattacttttacataaaaggagttggatagagtcttggacttcaagcttttaatctagtgaacataaaaaagcctacaaatatgtacatattttctaatgtgggcatgggccctgataggcacagagggatatacacagttaaataagagccaattgctattgtcttgagtgctatcatcttgtggagcagacaaaagtacacatcaataactctgttatgaagctcataaagatcaaatatcacaatagagatgaaacatcattctttggggatgtttggaacagacggattcagtgtaagagttcaataaacataaaagttttcttgaagaagtggggttggaatagaaccttaaataacaggtagaaagcacattaaaaggtctaatacctgccaaataggaacatcagatgaaggaaagctctagaagcaggaggatatgaagaatattccagaaagaggcaaatgattacggtgtgagatccatgaagacagggatcccctttacacatttccagaatcctgccagaaattctagaaatttgaatgttaaattgtgaaaatttggcagtattcatttctttgtgcaaagcaatatacttatatacaacaatgcttacatacagcaaaaaaagcaatatttaatatcaatatcaaattcttccaaaattgcataaagtgataatttacacatcatcatggcattaatacttagggaaactcgtggaaatcttaacatgtcatacaaaaagccatgaaaactaaggtcctaattcatgaagcttgatataataaaagtgcaaaagagataaaaagtagagatttaaagaaattaatttcaatgtatttgtaataatgaaaatctgggaaagaatttagcacatagttactgagtaacattctacactgcttaccataacagttaagaaagctaagaggatataattactgccattcccaacttgcccaagacagaattcactgctcttatagaaaaagcaagtttcatgtaagtctcatgacaacaacaaaacagaagctacagcatttacacaaataggaaggagacaagaataaaaggttagcactatgggacatagagcatagagacaataagaaagaaatggagtaacaaaatatctaccaggacacagaaaacgcttagccaattagtaagtacatatccatcaattgcacacttaaattatatgtatgaaactatcctatcaaaagacatgaagtgactgaatgtcacttctgcttcaactatctgtggcctatgtgagacctatctgagttttaaaaccacaagttagatgaaaggaaggggttagaacagtggttctcaacctatggttcaaaaccccttcggaggttgcatatcagatatccggcatatcacatattttcattatggttcataacagcagcaaaattactgttaggaagttgcaatgaaataattttatggttggggtggtcatggcaatatgaggaactgtattaaaaggccacagcattaggaaggttgagaaccactgggttagaaggtatcccacacaacttctactcaagagaagagggtagttgacaccaagggagaaaggtagccatcaacccagctgcagagcttttgatctacagtcgtgttctgcctgtgtaatgtgctattgcaatagtgtcacaaatgttgtgggagtaaccaaccactatctaattggatttaaggcccctccatgagatggaagccttaccggacactgctcagatactcaagaacatgtaaatagataggccctttacctaggggaaaaccaaacatgactgttctgctaacggaatgtagcaatcccaataactcctgaggacatcctgctacacatttagatcagtgtcttgctcagccaccatcagcaaagattcctccagcagtagatagaaacaaatgcagatgcctacgaatgaatgatgtgcagagtgcgaaaccttggcacactcagacctaaataaaatattttcaaccaatccctccccctccgggcttcaggaactatgtggaagaggaagtagaaagattgtaagagcttgtacaaggccttgtagacacaactgaaccaacacacatatgaacaaatggagaccgtggctgcatgtgcaggccctgcacagtccaagccagacgaggtcccagcactgagaggggaaatgggcacaagcacccctccctaacctagaagctgcctccaattgacaactgtttgcaaagggaaaagtagttttctctaacagagaaaagtagttttctctaactctctaagcatacaaatcacacttaaggacagactccatacccagcagttgatagcccacacgaaatgatgaactcaatggtatttttgaggtgttttggttttttgtttgttttaccttacaggtcttttgtttatatattatggtttctaatcttgtattgtgttgagtggggtaacctaaacccagacctggaagaccaatgccacgtgttctccttcatttgtggtttctaactccaaatcttcagaatgagtaaccacaatgcctaagaaagtagaaggggatcatggggatgggtggaaggagctcttaggaggggaaatagcaggatacagatgacacgaaagggacaatgggaaagattgttcctgattgtttaggaatagatgaaaattccttaatgaaataaaggtggggaaactcatagctaatacttcaaccaatcggaaacagcccaaacttttactactaaaacacagaacaaaataggaatgcccactcttgccccttctactcaataattctggaagtataagtgtgtgtgtgtgtgtgtgtgtgtgtgtgtgtgtgtgtgtgtgtgtgtgtgtgtgtgcatatatatgtatatgttcatatcaaaaaagagaaagggttaccacagtagaaaggaagaaggaaacctgtccccattgctaatgagatgattttatgtctagaaaagtacaaggacttcactcaaaattagtagaattaatgaataaattcagttatgtcatagattgtgaaatcaacatgcaaaagacagtagagtttctccacacttatttacaatagcatacttatgagttggtgtgaccaggaaataagagacacatatacttgtaactataaaacattgttgacagaaatagcagcagaaatgaataaatgtgaagatatctatgtttacatacaagaagaactaataatactataatgttcattcttctaagagacctattgatgtagtagatcctcaattcctaatgctatcattcacagcagacaaaatgtatgtgaaccataaaaacatcataatacctaattaatgtgagcaaaagaaaatgaaacaaaaacaaacaaaagccacccaagcatcatagtatttcctttaaaacatattataaggctattgtaattaaaacaaaatggtaccagtatgaaacagatatgatgatcaatgtaacaagatccaaaactcagaagaccctggtatttattgtcaattatttttaacaacagtatcaaaaatatacattggaaaaggacaggatcttcaataaatagtattggagaaactgtatacacatgcatgcaggaaaataaaactatacctttatttcaagacataaaaacataaaaatggcttaaaatgaaaagcttaaatttaagacctgaaaacataagaatattaaaaggatagctggtaaaaaaaatctcaattatatttcataggaaatttttatataacactcaaagtatagtcaacataaaaagtaataatcaaatgagattgcaccaaactaaaacatccccatacatcaaaggaaacaacagataaaggagatagctcatgaattgggagagagtctttgataactatctgactcaaattcaagtgattcaacaacaacaacaaaatgaaagaacaacctagttaaaaaatgagtaaggacttgagcagacatgtttcaaagacagacatgtggtctaggttcagtggctcatgcctatgctctgagcacaaaggcacccgaggaagaatcatgaagacattgtattctatataccgtattctaggtcacagtttcataaaacaaaaaggagaaaagaaaagagatatataagtgatcaaaagacacaaaaaacataatcagaatcatttatcaggaaatgcaaattaaaatgactatgaggcaggaacacccccttgttagaatcagtataaacagtctttataagtactggtgaggatgggagaaaggggaaatgtaatacaaggttaggaatgcaaattagtacaggacctaaaaaaattgtactagaagttcctaagaacagcaaggatagaattcccacctggtcccatactgtcaaatgaggattactatccatatagaaagagaaaaattgaaattgatgtgttaaaaacatatctgtcctttaatgttcattttaatgttatttatctataatagaccaagttatggaagcaacctaacatttctatagaagagcaaataaataaagaatgtattatattaaaataatggaatattatctggctttggaaagaaagagatcttgccatttgccatgtagcagcaaactttaaggatgttattatgaaaagtgaaataatccatacacagaaagaaaaatcttgaatgctatcatttgtacaaggaactgtttttcacaaaaagtcaaatgcaggaggctggagagatggctcttgttgctcttgcagaagacctgaattgtattcccagcactcatatctgaggggttcacaacatccagttattcatgaaataaaaaactaatctgaaactttgcatctctcccacccccttttctccatcatctctggttcattctcctgctcactctctctctttcccacctcctcattttgccctttataattatccccttaaaaaagtctttttttttctgtattgtataggattccctgtgagcttccctgctttctctgctgtaattctcaagttgttttcaatatgtgtgatattaactaatcctaattggctgagtaacaggagccagcagcctatacagtattaagccacttctacaccacctattttctgtatgcaaatcagacagaaacaaatgtttggccccagctgggcaaaacgtcccatttagaattcttttcctcttctttgttctttgatgttctgcaaatgagctttagaactccactcttcacacaattcaattttacagacccattatctgagatataatgtggaggttaaatatatcagggcagccattatgtgaaaataattaacagtaatgaataatgcactaatcccactgatgagagatggttatatgtgtaatgaagtgttggggcagccctgacaaatgaaattaaaatatttaaacactgttttatgatattactttgctcatataatttcctttacctacgatgagccacttggattatcgtcattatcttgacagctctgaaggatgagatactgcgggttaatgtgacagcgattagtcagaggggaaatccatcacccctggcagaacaggctgaggcagaaaaaggcccctgcactgtcctgtttccaagcgagaagaatgatactatcaacatcacttcaatattaaatggatagaattatcttgtcattcagttacagcctctgaagaactacctatttgtacctgcaaaggaaaggtcagcctttcttaatcacccataaaaatacgttgatggatccctcgtatcaataatagtgacaggaacagagacagcgaaggcacatgacaatttaaaagcaagaagttcctccctgaactctttaaaaattcccccttccctgtaatttctgattacattaaaacagaattcgaaggttccatctgaagaggaattcgctaactcactcggcttattctgtgatcacttcatcagactccacgtatgaaagcaggttctgctctgttgaactttatgaatattattcttaaaataattactcctccctcccaagatgccacatgtgtaagtcttaagggtctgatgatgcaataatctagctgtctattagagctgatacaaaatgaactctaaaatatatgatggagaataattcattgataacttgaacagaagtgattacatcaccgatatccattcacatgaccctattctagtttatacactggcaggagagttatcatttccagaaattttctggaaaggcacaaaatatattttcaactagcttaaaactccagttttaagaaattcttattttgctttaaaataagaatttgtgagtgaagaagccaaagttaaaacaagttcccagagaattttgacccaatattttctctgcttctgatgaccagatggctctccacaatttgcttctgagaaagtgagacaatggagatgctgatctgagagttaggccaaaggtcagctccaccttcccttaactaattgcaacatcttgggaatcttcctaccaaacaaggaatcctcatttagactgtagaacacagcatgttttgtctggtaatattgatagctgagtttaaaaatcttttttatttagaatcaaaatccagttgcagaatagcaaaaatatcagctttgtaggcaaaactttctgaccctgtcctgctagccttgggatctaacagcacgtcagcctatcacatagtaacaaatactttaatgtatgaaacacaaagcttagtgtctcttctactgtatggatatagcaagtgtgtgatcactcctaacatcaatgagagaagtacaaagatatcaggaagtcaggcctagagacagaaacagtcattattgtgagggcagacagggtgtttggagaacaaagcacgatataaatatataatataaatatataaataaaccctttggtagcaatggtactggagaatgagttaacactaagagcaagcactggcttcatgacatgaatgtactcataactgaatctgttgttcaaaatagcaatagccactttgtaagaggcagcgttggtgttgatagatttatatgaacatataattggacttgcaacactatttttgagttctacttcattgtcacttatgcagatagagctgaaaaattaaatacacactttaaattatcctcatttacaaatgtttagagtttatgatgtgagttatctgtctctctcagcagcaaagaatccttgaaaaaatcatagaaccctgcctgtgcttcttgtatctgaaaaaaaaaaattacaatttacttcaattacctgacaatgaagtgccttggcaataaatctaacattaaaaaatcatttccagcaaattactccaataaaatcaatgaaggtcaggctcagctgtagcaacaaataaatgacatgctattgacaggctagtggacttcattgtcatttataaaggttaaggggataaataatctaacagaaagcagatgtttactaaacaaaaaatggaagcaagtgagataaatccagagggtaagttaggcatgaagaggctttggcatgtgctggcctagtcccatgacaaaattactagttgttcgaatacttggcagcacgcatgtttgactgggtcaatatttatctgctctgggctacttcgtgatctttctaccttttatatattgaagtcatgaaacagattttctcttaatagaaaatgaagaattgataaaattgaataacagtagtcaggttaaaagcagtttgacccatttcaaaattccagtaacagcatctttgagaataacaaacattaaggtagaaaggttgtcatttctccactatgaaaagcaaatctctaattgtggctttttaaaaccagatataaacctagatttcaaacattggtatttggtttaaaacttctgtttgcacacaaactctgtgaaacagaccagaccaaatcagcaaggccattcccaggtaatgaattccctcttgcacatgtcagtaatgtgtgcagtgtgtaaaccaaattgtattatctgtccagattcctcacaatttgccttacctggtaaggcctaaggttctatgaatcaaaatgggctctcaaatataaaaggaataataacatttggaagagattcagtctttccaaaaaccatggcttcatagaattttcaaaagtgcaaagactcacggatcattggatctgacctctttgttttaaggagaaggaaaaagaaccagaaggagtctttgcctaaggaatctcagacataactaggtcagaacttgccccaagtcacctgattcccaggacaatgatctaaccacacagtctcttgatctgaaatattaatggggaagaaatggcagtatctatttcctacatacaaaataagaatcacctcttacattaaactataggatctggtatcctcaaatgtgctcacgattatccgatctcttggctcaaagagctagggtcaagctactcaaatgaaaatcttcctcttcttcacagaatacactggtgacttgaaagcatcttgtcctgctttatacatgttcccagacatatccatgccctaaaatagtgtttgtggagcatttgctggagggatggctcagcatttaagggcatgcattgccttttcagagaacccaagttcagtttccaagcaacaatcacatcaaactccagcttccaggaatcttgtgccctcttctggattctatatgtaattgcacacacacgcacacacacacacgcgcnnnnnnnnnnnnnacacacacagagagagagagagagagagagagagagagagagagagagagagagaacgagaggaacactttaaccttattttaaatatcttgtaaaaggggaaagggagaaaaggagtttgtatttcctcatgctgaatctttgttagcttggctggcttggaaattgctgtagctaaataagacttcccacaatgaaatacagtaggtgtgagttttatgtgtgtgttgtcaataccttaaaattattcactttttcttaggaaaatgttttaattgggtaattcctaaaagaaataactatatcagaaaagatatattaagattccagaaaatgacttaatttatttgggacaacataaacctaatattatgtattcttctaccggctcttctcatgttgaaaatttaaaatcgtggacactctctcaatggctaataagaaaagtgttcataattcaagtattagttcccaatccattgccttttgcttttggatcccatatgatacgctatttcatttataaccacagtttaaaagtaacaatatttttatgcattgaaggcacagtttgtaatagtcattgctgattaaggattcaatgttacattcagggacaactgaggaaaatttcactgaagcaaatacttgttaatagaattgccctaggaatactcctaaagagcacttcccagagacagcctaagtggcagggagcactcccatagacagcctaaatgagagggagcactttcccacagtctaagtggcctagggaatttgctcttttaaacatatatttttatttcattattcattttacatgccaaccacaggtacctctccctcccctccttcctctcctccccacccaaccctctccattcctcagaaagggttagggcacctatggggagtcaacaaagcctggcacattcagttgaggcatgaccaagcccctccaccatctggggaatttgtttttaaaatgggcatttcattataaaatttttataccccagaagtaatacatcaaccatgcatgtggaggaaagtaaagccttgggggagtggataaaatctcactttgagtagccttgttaattccttctataggtggaaatgaaaattatttttctcttctttgtattccatttggattttatgtagatttagcactaccagcatattggtgccaaacggtaccgaaagttctagacaacgtcctgaaatcatcataaatggttagttgctcccactgaacccctcagagcctacttccaatattgcctccacacacatggatttataccgcactacttcacaaagaaatagtgtcccaagaaagcggcctccagtattctctccattgactcagtctgtcttgtacatgtccacaaggcacaagcttcaagctgaagatcagaaaaacaaagcagtcagccgctagctctcactctacctcagactgaaaggctattctagcttgaccaaacctcagactttgtgtctcctcagcgtggctggagaattctgagacttcaatgttgtcctattctcaatgtggctggagaatgaatgccagctctgagaccctgttcctgtcttaaatctctctcatgagtcctgggattaaaggtatatgatcccaagtgctgagttcatctttgtgtgagctgtttctcttaggagtgatctatatttcgtgtagctcagtgtggccttgaaataacaaggatctatgtctacctcttaattctgagtcctgggattaaaggtgtgtgcctggcttctgtggctcatggctgactttgctttctgaatcctcaggcaagctttaataaatcataaataatatgtcaccacatagaactggacatccgcctaccctgcttccgaacttaggaaatgctttcttgttatttccctacagaatctgtgttttatatcacttgccttttctatacttcgggactttcacagtttcccaacacatacctaccaccccctggtcagtagtcaactcccataatagagaacaacagagcacatcttcccagttttgggatgatccctcccctggtgtgccaaaaccctacctatccttcaaaactattggaatggctctctctgttctctacgtgcaataacgtttgcacttgtccagtgttgactttgtaagtatctattatgtgaatgataccaggtcaggtactatcagaaaaagtaaataaatgtctctgtgaagcaggtgaattatatctctgaagatctttctagtatttctggcataagtaagaaacaccatcagaaaagagctgctctgatggaagtagaagcagacacccacagctaaacactgaactgaactggaatccagttgcagagaaggaggagtgatgagcaagagggtcgagaccaggctggtgaaacccacagaaacagctgacttgaacaaggggggctcttggcccccagactgatcactgggaaaccaacatggaactgatccagaccccatgaatgtgggtgtcagtgaggaggcctgggaggtatatggggcctcttgtagtagatcagaactgattcctagcgtaggaatggactctgggggccaattccacatagagggatactccctctacctagacacacagggaagggcctaggccctatcccaaaggacatggcagactctgaagaccccatggaaggcctcatcctccctggggagcagaaatggtatgggataggttgggtgttagtggaggggcaggggacaaggggagggagagggaactgggattgacatgtaaaacaatcttgtttctaatttaaattaaaaatattaaaaataaataaatcaaacaaaaaagaaaagagctggtaaaagccatggaggctgcaaggaaacagaaagtctgttggatggagaaagtggtgcaacttggaagtcaacagcaaacattgttgtttgaatatcaagctaacaccaaagatgcagaaaatgatgctgcactcaaatagccttggttgtcaggggaacagctcttataaatcagcctaattatgataactttctgaagaaggggtactgcttgacaactgtggtgtggagaccagaaagaactgcacagggcaggagtgaaggggtgtgccaaggcgcagtgctggaattcacttcatagttatatgggtgtgggaagactctacccacggacatggtgccattatgaagaggtcattcttattctcatcattttcagatccagacttctttaccaaactctgacctcaggtgggcaatttgagacagaccagcacaactcctcatctctataaccaggtttctgtagggggagaaatttttccacatagatttaaatgaggaagcttacccctcaaaggcaaactgctgctggctgctttctaccaacagcatcattcgattggacattgtgcctgcaaaaagactgagagaaagaataaagaagtaaggaggtgaaatagagagagaaagagaaggagagagagaaagaaagggagggagagagggaggaatgaaaggggagagagagagggagagacgtaaacaaggggggggatttaaagaataaattcaccttcgattgcaatttttttaaaaaaaaatcagccaaatcattttatccgtggttcatggtgtattattgaagctcttcgggaggttatgttaccagattaagaatctgtgacataaagtcactcgtccagtgaataagggagtcagagttcattcttccaagtgaatcagaattgctaagcagattctccatgacttatacagattcaaaggcaagtaggaaagtgagcacaaaagaaaaaataatgatgaattcaaaaggtaaagaatacacacagaaatgtagcccgtagggaaattctgatctcttactaaaactctttgtaaaggttcatttgccctgaacattgcaccagctaaaggcgaggcatctggaaaacctggaggtgaagggctccagaattgcttcaagaaccacagaaaccaagaagcctattgtctgggacaccatggtccttgctgttcttgttgtgaaaactgtagtttcagtacatgatctgtgtcaatttaagtccaagaaaatgattcttctctctaattaattgttatgtttctcttatatactttgtaaaatggtggccctgcttgtcttggcattgagagcaggcttgtggatgtagctgtctggctccatctctcaaccaggtgtttgttactaagccttgctgcctagtctgcgtcctcccaaacacaggagcgtcctcagattcaagtagctcttgttcagagaggaactatccggggacaaaagcctgggattatcaatgttgctatccaaataaaactgttggttgttagcaagaggaaagactgtttcacacaaggactctctgctctttcttaaaaatctatatttgaaatcaatgcattccttgggtctgacatgagaagcccccatccacttggctctttgaaaactcacgactcactctccccatctatccatctacttttctctgaaaaaggaaagagataaactaccagtgagaaactttactatatcaaaaataatagtgggaaacacagaaggcttaaagtgagcactgtggccatttgatcatagggaggcttttcactgacagttctctggggacaatgtggccttactaagtaaaatgaaagagttagtgggagacaaaaccaggtgcagaggcaaaccacctagaattcctgctgtatagttatatttccatgtctctacacatcgttcatcataaacccaactatctgtagttaaaacgtccagaattttgaaaatgcagagatagccctgctgatatatccaacaagaaaaatattgagaacacatattttatgattttcttttcaaaaaattgtttttaaaaagttataaacatgttttttgatatttggaaatttatgaagaacagagtgttctgtgacaccatgaaagaaaatagatttgtatttgagaaatgcaagccagactactcaggaaaaatataatcagaaaaaataataacatcattggtaagacaatgtgaatcaaagcatcaaccattcagaaaagctgtggaggaggtcagtagttgtacattgtaaccaatgaccaatcagtgatgtaatacttacaacatgctgccttaataggtaaatgtcaccctctaaacatccagtcttactactatatcagcttttaaacttggaattcagaacttgacttttcccaacaggtttaagatgcagtggtgaaaacagcacagattaaaaacatggacttgaatgaagaaccaagttgggaccaggtttgtgaaacccacagaatcagctgacctgaacaagggggagtgcatgaaccccagactgctagctaggaggccagcatgtgactgatccagacccctgactatggatgtcaatgaggaggcctcggcactctagggggcccctggtagtggatcagtatttatccctggtgtaagaagggactttgagagcccatccacatggagggatgctctcttggcctggacacatgggggagggcctagccctggcccaggatgatgtggtagactttggggatcccccatggagtgccttacccttcctggggatcagagggggcctgaggtgggggctgctgggggcttgagaggagaggatgggagggagagggagaagggattgacatgtgaagcaagcttgtttctaatttgaactaataaaaaatttaaaaaaaataaagcatggactttgaactcaagggcaatggagttttaagagtactccagcatttgctagttatttgacctagagccagttactaatgttttctgagatactcttttttccattttattgaaaatgcattttttctcaaataatgtatcctggttacagtttcccttccctcttctattccttctagttcctttccattttccctcccatctgcatccactcccttcctgtctctcattagcaaataacaggcttctaagagataatagtaaaacaaaatataatgagataaaacaaaaactaacacattgattgaatagtacaatgcaaacatacagagggaaagagaccaatataagataaaaacagatataagatacagaaagggataaggtataagaagatataaggtataagatataaggcataacagatataaggtataagatataaggtataagaaacagagacccaattattcacacatttgagcttttttgtttgaaaagttaaaatatagctgttttgctggaatgctatcagggtttttttcattattgtaaattttttggcagacattcatatgtataagagaagactgtgcattttttaaaagttagagcacttcataattccctgtaactgtgaatagaaatctgtagatttacacagagaaagttttgggggtaaacaaggctaaacatattttcagatttttctgcatgaaatgcatttagaataatacttcagaaactcccatagaagccagattcttctcatttcaataatgatgagcctgactactgtttttaccaatgggctgtcagcagacacatggcatacagatacttgaaacatctagacattttgctggctatccccacttcttccagcagcactaaaacaacataggttgagcactcatctcccacagacacttagggattagccaggcttcctcataaggaccccatctggatttttgaattgtcatcatatagacacttgagtgagctcccctgaacccagcctggcatctctgaccctcaatcacggtggaataaatgatagatgtttacagaactgggtgataggcaaaggtttttaggggtatttctctggcaataattaacatttttttggctgttgtactttcagagtttctgtgggcacattcatctatttgtgtgacagttttaaagacatatctttgtcctttaccaggaccatagaacaaatggaattggtggtttgagaaatagatgaaaaacttgcaatctttaatataggcatatatttagagtcaatgtcctaaattggagaataaggtcttcaaatggctctatgatctaacagttctttaggatttcaagctccaatgaaaagacaagaaaataaacacaaaagtgtaacatattctctgccccattcacaaatgtttaacagcaacttcctctcaattaaaaccattgtatttccaaagacagtaaatatgtcttgcctatcaagtgtttttgaaaaaaaaaagtagttgctttgagtaacaaaaacagtttaggcaaataaccaagtaaaagtggatcagaaataaatacatcagaaacattttacttttcttgccgttgtgtggaaagctcaggctcctggagacattgcagccaggtgtcatgcaaggattgtgggctacagttctgatccagtgtagggcaaagcaatatgatcttgggagagaaagttggaagacatgttcataaatacagaataattaaaggtctattcaattggcttatacagttagaaaacctctacccattgtcttgaggatatgtaaatcattgcatgtggttttgtctaggaagaagaaattgtcattaataacaataaaaaggctaacttcatgccttgcataggtgtggtgggctaaatttgcataccctctatgataagaaactgaaactcctaagatctggcaaggaaatggccaaaaaagtataattgtcatacagaaaaaatatattatgtccaatatatacagaagtttctaaaaataatagtggaggtagaataaggagactcatttatcaaatacaaactcatatttttaaaaaaaaggaaaaaatcatgatggggaaatgcgggacaaattcaggaatggcactacaagtaaaattatttaaagaaaaaatgcaaggaagccatgtgttggtggtgcacgcctttaatcccagcactcgggaggcagaggctaggtggatctatgtgagttcgagaccagcctggtctacaagagctagttccaggacagcctccaaagccacagagaaaccctgtctcgaaaaaccaaaaagaaaaaaatgcaaggtgtacttaaaataaccaaattataacagagacaaatcatgtgaccaaaaatgaacaattaaaaatacccacattttctggtgcgcattcacaatggacttgcagctgtaaagattgaaaataaagctaagaaatttgcaggtaagtggatgaactgggaaaaattatacttgagtgagtccatccaggctcagaaaacctaacactctgtgctgtctcttgtatgcggaaaccacctttgaacttttaggtttgtgggttttaacttagaatatccatggtaactagaaagaggccactgggggtcccaagagtgtttctaagtgatggggatagtaagtgttgtgaagggaaacggtaaataatggaggatgctttaagtagagaaggtgacaggaccagggcaaagtgggggacaggagaaaaagccacatggaaatcaatattttataagctttcttacattttattatatattataaatggtaacctttattcttaagatcctaatgatgaaggcttcatgcacacttgggtcaaaggacatagaaaaatcaagctggtattgacctggaagctccctccctactgagctgtcacagtgacagaacatgtcaggcaggctgatgagggagaaaaatcaccaacagtcttacccagctgccaatactttgagctatagtcatgactgacctaacaggatttgccccttggtgcaatagtagcatgaatgttatgggagtttccagcctttctgattgagcctaaggcccactctccacagaataggatacatgtataatattgtaaacctgaccaagaactgatggctaaaaaggtcacagatactcaagccgaatctattaccatcattttgttaaggggaggttgtaatcaaactgccttctgaattcttacctttattttcattgattacgcagctctcaaccaccatcagagactcttccttttgcatgggactgcagtcaatatacacactcagaaatggtcaaagagcagaaaatacgtgatggcggagtgctcagccgctattgcaacacctatattagatctctttgcctcaagattcagcaaacatcacagaggaggtgctaagaagattgtaagagccagagacataggaggacttatgtgaaacggtgtcttctggacatgaaagggactcacactcaagagctttcagcagttgtgactgcctgcataagacctgcaccacactaggcaaaactctactacagatgggggaggagcttccaagctgccacctttgctgggtgctattggcagttcatggatactgggggtattggaatccttttggaagtatggcctctgataggtttcccatattctggtgggtctctatgtgcaagaatcttccttcatttttctgcactaagtatttggttttccactaaaacgtctctctgcttttgtgtgtgtgtcccccagaatttcttttattagtgttttaaaatattgtagggctctttcactgcttcagttagatgtatttctattgattttattaggattagttctgtcactgggtttttgtcctttcgacatatgctatattgctggattccattctagtctcctaattattatttgggcagggactattatggacttttttattttgttagtgtattagtggtatatgaaatgttgctttttgtttattatgtttcctacaactcactgaacttttctgttttagttttagtcagtatctttagggcttcctgtatagaagatctttctacaaaagaggttgaatatacctcattcctttctagtgatgtctttcataaaacttcctttgactgttctgactgagagcagcagatgtggacaccctcatcttttcagatctcaaaggaaatgccttcagctttttccacttagcacatgggcgcagtgtctttatcatatctggaactttttgggtgaggtatgtgaggtttgttttcataaagaggtgtttcactttaatgaatgttttttctggacccactaatgaaactgttttgatcctctctgttaatgttgtaatacactatggttttcagtttttattcattaattcataattaataatccataacaaatgggcatggcaaagcaaagctgcttgctcacctcatgagggacaggagcagggtgagagaacaagatacgcctttgaaggacacactgctaaggacctacctacttcttctagctggacccaccactcatatttctaccacctcataatagcactaccaattaaggacactttattacataagctttgggggaacattcaagatctaaatgttaacaatgtgccttttgttggtatcacatttaaccctgacgtttctttgctgaatttttgtttggatgacctgtccacttatgaaagtgggtgctgagatcccctattgctataatttttcaaaaagtgtctcaagagagaaagactccaggtgacagagctcaagagttcaagtgggctttttttcttttaattatggggaaaggatcgtaaaaggaggaatggggagggggagactggcttccagggacaggaccagtgggagaaaggaaagagagtcagaggcagatggggggggcagagagagagagagagagagagagagagagagagagagaggagagagagggggtgggggcagggcccttttaaaagggaacacagtgaatgtgcacaggtgatgctcttagtgactgcagctgagggcatatcctgtcagaaccccaaggacaggccagtacagatgcctgaatactgacattcctccccttctatttattataaaaagataaggtgttagaaaggggtcgcaggtgaggcagggatgaggacaccatgttctcgaagctactcactgcttacctgaggggtgtcattcattcatctttgggggacctgggaaagttggggtgcttgccacatcctggagtttcacttcactgtccaggctctgtggaaccgtcaggtgcctcctggacctggcaaaatgtcgttcttggtgaatccaaatcaactccctagggcttaaacctcctgatcctttcccatccccacagtgtcactggacttgtttggtcgtcatgtttggtagtcatgtttggtagtcatgtttggtagtcatgtttgagcgggtagtcctgcaagcctcctggtctatggccaacagcgggtagtcctgcaacagtaactgattaggaatggtcagtgggtctccaaagaacatcccaatggaagtaaggatgtataaatgatgacacagctcccatgagtgaggctgagaagacccaagagtctacagttcctatcctcccaagaattcagagagggttgattttgacacaggcacaggccacccagtgagtcgtcacataaagggtgacggccgaaagctcaaatgagcccgagagagctatggttgcctggcaccaggacctaacaagaccagaaggcaaaaaaacacactggagagaggagatgagtcctcactcgtggaaatagtcagagatggagaaggaggaggggctcttcactcatgcaggttttggatggagggacccagtgactgggttatatgtagacccagttccagggtcccagcatgccacaaactgcctttgggcaggagaatacaccaggagagccttcccagtcatggaaccaatgttgtaatttaaaaaaccaatcaaacaaaaaacgctcactcgagagaaaaaaggcatgtgacagagttcaaatggaggaagttttttttttaattaaattaaaggaccataaaaatgggaaagggggtggggagactggcctccagagacagcagcaatgggagagaggaaaaagaggcagagagagggagggagggagggagggttgtcagaacaatgaaaattacactctgagggaataaccaaaggggaggaaaaactattgttgttttggggtctatttttccctttagatctgacaaggcttactttatataattatagcgtgtgtgtgtgtgtgtgtgtgtgtgtgtgtgtgtgtgtgtgtgtgtgtgtatgtgtatatgtgtctctgtgtctgtggtgactggggaggtgtaaacaagcacttattcacccagatagggcataacaacaaaccaaaatacaattccaccaaagaccaacttagaaaagccatccagttttacaggcttatatacagagtatgggtaaacccaagctgagtagaccagtagaaaatctcagtgtggatgatgacttttccatagccgcacagatggagtccccttgtcattcaactctacacactctgtatacagtcacagcctctgagaacaggagacttcgagcagctggaacagatgtcagtggtgagagaatggcttaggtcacaggtgaatagcaacagatggtcttcttcactcttctaagagaatgtcaacaggccccaatcttgagagtatcttgtaggtggccaccttgtaggtttctgatgaatagtcatgactgctatccttggaggacaaaatcctacttcagtttatactagttatttcttcttactcaattggtccctctctctttttatagtggcctttgttgtctcctgttagtaggtcttatttgtcacacaaaattagtattaatcataatgaacattaaaatctaaattattcctgtggcaacaggtacacagttcttaaagataaaaggagggaacagatagaaatgaaaccccagatattcatgagataatgtcatggcctcaaaatacacaatgccaaaattttctaggtataaagaaaaaggaacagacctaccatctgattagaggtatttaaaatttatcatccaaaaatatatggataaagcattcatgaaataaacgcagaaagaaactgaacagcacaaacatatatagaacagtaaacataaaaacaatgcatagaggaagtggttacaaagtgctgccaagtcctaaccaagaagctattcacagtaggtccccctgacagaagcaaaaacagctttcatcagcagagtagcactgcctgtatcaaacacactccaagacagacctcatgctcaggatctggccaatacaaaatggattctctatatttgttttgattttgtgaccatttttgattgtgttttggtttttttccaagaaagaacgagcatgaagttggatgggttgggaggagatcttggaggtattggagggggagaaagaatataatcaaaatatattgtatgaaaatgctacaaatagccgggcgttggtggtgcacgcctttaatcccagcactcaggagaagcaaccaatatgacatttggtagatgaatagatacattcagataaggttgattcataaaacagactaccagtgatatttataaagaaatgaactattatgctaatacgaagataagagaaaaacttaagagtgggatactaaacaaaggaactcagcctataaaggctacatagggcttaatcacaaatatataaaatttgtgaaagggtaaagctatggaaactaaaaagagcagaggttatgggaaatgttttcttgatttttatttagtttgcattatagtgtgcatgagagagagggagagagagagagtaagagagagagagagagagagagagagagagagagagagagagagactgcatactgccctgcatatgaggaatcaaaggacaacttgtgacagttgttttctttccactatgtttcttccagagatcaaactcaggttggcagagttgagagaaaagtgcctttatcttctgagacaaatcactggtccaggttgcaggattctagagtaatggaaatatgctgtatgctgctacaacggtggttagatgtcatgtgtctgtacaaatctatataaggcacaatcctgcactaacgtttactgtaaccatgacctttggagagtagggttgtgtttacgtaagttcatcagtagtcactctggtgggaatactgataatgggaggggctttgcatgtgcaggaacaaaagataacacagggttatccctattctccataacttaattttgctatgaaccacaagaaaatgaaaaataaagtctgttattaaaaagaattcatatgatttagatgatgctatagagattctggatggaagcatttcttcccagagggatgaagggcgttcacaagactctgaagttccaaagcttagaagaactgacaagaatgttacaagactcacaaggccccgcctccagaatacagaagtcaaaaacagttgctggggagaggagacccttctgtggagctgcctgcaggtcgtctggggaattacagtgatgcatctgtcatgcatgatcacgggcttctagtgatgtgcctacccaagtcacccacgcatctgcagggaaccccgcatctactctcctgttgttagcccaaaatgaacttgttgattcaccgagacagacttgagtggagctatttcctttgtctgtataacctgtctggtgaatagatatttgctctcatctccgcggtaaaagtcatatagcatataatattttaaataataccaatagtgatatcaacagcaaatgatagtttaaaccaatgtgtacaaaatagagactattttaaataattcactggttacaaaataatagatatcgtgatgtacacacaactgaatgtcataaataggtacacttgaatcccacaaaccaccaaagggacagactaaagagcgcttagaaatttgtttcaggatctggaacttcatttttatgacagaactattatatagcaaattgtctaataagcagaaaaagattcaaagatcaataggtttagcaaatgtctaaagtgaagagagtaaacaaatctaagacaaaaacctggccaaaatttgagaaatttgtcaccaaatacaatctcaccttaagtaaaggattcttcaaagtgaattcagtacttacagggacatgttttatgtatactttagttttatcaaacacgtatgtattaagggtttgagtaagcatagtaggttaccaggcacaggggtgaattagacacagtttctgttttcaagggcacttagactgctgagagaggtgaacaagaaaaagttcaactgttggataaattatggaaagtgcagagttttccaggtgtgttatacacggacacttggaacaagcttgaattctagaataagtgtgaaaaatgatgtgggggtttccttcctttcacctaactctcacaatgtgatcaaaattcaccagaaattatactgtcctgcaatatccgaaggaaatttccaagtaattcctcaacttctcacttgtgttgctcaagtcagttcaaaggggaaaatgagttaattctgttcacagccacaagtgaatagaagaattgaaggaaggcatcccttgccaggtcctatgtaaaactaagaatttagaaacagcagtcagggcaggcaatggaatacggtgcacagtattatctttttatttatttattatcagtcttaacagtcagcatcccaaatggaaagagcactcatggggagtgacatggcattggttactcctgggctttctggaggagcacaatcctaggtgtctaggagggacagattgagactgattagtgagaacaggagaccagcaccatcagctgacaagtgcaaggcagaggcgactgggagactggaaatttttatttaactattcctagttttaaaaacaaaactgattaaaatcactcaagcaggttttcacctgttctgttttcttcagaccttgaacttcccattacacccaaatcagagtgagaaattatatataaggagaggtctagacaccactttaacgagtctcaggcactttgctcacaggggattcttctggagcattttcaattctgaaagaaaatacatgacacatggaacacagcaccccagtactattttgggggagcagtctttgctccccaagcatctgctgtagtgtgctaacagctgtttgactgcaaagggcttctctgttacatgttctggacagagttgctagatttctggaagatgttctttttttttttttttaagactggtgtttgtgcaactctggtgcccagttaatcacatttaagctttttctacactgtgttggagtaacttcaaggacaaaccatgctgctttgagtcacttgttacaaattcttcaaaatgagctatcgcattttgaactccctgtgtgtgcgggcatgtgtgcatattcgcatgtgtgtgtatacacgaattcctgtacatgttttagaatttgagcaccacaaataataagtctctcagaatatgttttgcttgttttccagaacacagggatattggggtttcgttaatttccatgtcaatagctctgcagagtcaagagcagcagcctccactgggaagtccatgcaggtctctccaaggactatgaacaaaagaaaaaagcacacagcatagaaacacaccagaactctgcaaaaagaaactcagaaatttgccacttacttctttggaggaactagctctggtttggtttctcttggcttcaaacatggtcttctatgtcaccttaaagagctcagcttccccaatggttaaataaaatgataaaggcatctgttttcctggcaatgtgattctagattcaacttctatagtcagtgtgaaagaacagaaaaagtcaaggcaaaatggactatttaaatatttctataatgtaaagcaaaaaatcccctgtaccatagcaaggccatgttaaatgatagattttattctctgacctaaacagttctaagttgttctattgcctcgaaataaaattttccagagcggtgtcacaagtggtgccatggagtctgagctgcatgctatcagcacatatttctatagaaatcaattacacgtaatgtcttttcaaagaaccgtttaaagcaatgcagggactttcaccagtttaaactctgttcttacagggactcagtctagtaccatgagtaagttattgcgaaatagtaagtattgcagtcaagccccttagcaaagagtgggtataaaggagtttaactgaaaatgctgagtaagatgatgagtagtgatttataggttatggaccatgtcagcattgagggttcttcaccgcgcctgagggtggttcaatttccacgcatggccaagagaaaagttgtagaggaaagggaagacctatatgattataaacgggcagcatagtggaacataaggaaagaaactgtgctgatggcgtcaagcccaataggaagagggttgctgatgcagttcacatagctgttagatgcaggcacaatgaatgcgtgcatttgttgaggcccaatttgcaagaggacatgtgacgctcccatttgacctttggagttatagaagcaagagttttgaaacagacccagttagctgcctgtcacaatgctgggacagatgtatcacttcccgcggcccgggtttctcatgagaaaagcataagatgagtaagtcacagggttaagtaacataaccgacaaatggttagcacgctgcccagtacacggtagttaatcataccgtattaactaccttcctttctgtttctgggccatacttctttctcattgccaccatttgtaccaggggccagactttggaaactttacaatctggataataaaaaacttcgtaaaccatggttgcatttttccagcaagttatgcagcacctaaaagagtcacccaattgtcacctccattgctgtttgctgctcatgcaactgttgagatggagtcctctctaaatgttaggtgagtgagctatggggccctccatgctactgagttgtgtaaggttcctggaagtaaaagaacaggggatccaggcatagagccagtctgtgagttcagttaggggaagaacaattgtgacgcctaaaggcagaggccgcgcctgctcaaaagctcagaaagcagccttgtgaagggcaggtgcggttgcctcgcacagaaacgggactaattgctcttttcctgttctttcttctatcacaccttcctactcagtcccgattccctttgcaatagaatcattaagtcttactgaagagggaaataagccctcctcatttattaaccacttctcagtttcaccgttgagaagtccgcggtacctcaaacctccaactcctgtgccatcttgattaaggcacaaaatgttaaaagcaaattactgtgaaacaattcccacttaatgtttcagtcatatctgtaaaaaatatgacttaaatatagttttattaataatacatattttaattaaacggctggaggtgcatctagcaggaaaaaaattgaatcttcccgggatttcacatagtggcatgattcatgggcagtaaatatgcaaagctttatgcccataaggcaatcagactccaaagccgatacgcgtgtttttgtctgaaagagtgaaatccagcgaggtatagtaataatagtaatcataacagactgccggaatcatcaaatgaattggctccggccaacagcatcctctccgtgcaacagaagcatcctttcaaccgcaattatatcgtctccaatattcattattacttctgctattctcattacacaaaaatcctgcttatgcccatgtacctattaaagaacttcataaatattgactgtagcaaacgatcaaatgctagggaccacctttgtggactcagaaataaatactttattgcaaactgctcgttgttgctatgacgatgatgatgatggtgatgatgatgacgatgatgacgatgatggtggtggtggtgagagaggtggtgattcctgggagcactcctcttcagttcctggtgttgacaattgtctagtgcatcagttaaccagagctgctgttgcaggcaccaaaggttctgaacctcaacagtgaaacgcattttctcatggatttagaaggcagaggtctgagatcagggtgtcaaggagaggttttctcctgcaactgtagaatgtcaccttctcccacgatcatcatgtgatcttccatctatgtctatttcccagtttcctctgcatataaagcaatgagacctattggttcagcctcactctaatgattgccttggcttaattattcaagaacattctctctaaatacaggatcattctgagatacgaggggatgtgatttcaacaaggggcctttagaatggcaccagtaatcctataacacctggcaactactttgagcttcagaaattgatactatccaccacatgccacggtattttaccaagaaaaacctgttaaatgtataaaaacaaaacagagcggacttaagatctctataccatcacccttcaaataaagtttgtgttaaaatagccatatattaccctacagacactgaaaacgtcacagaacattacaattttggttcagtcattcacatctatttctaagcctaagactgttacagttatctcttgtgtgtcatccctactggtctttcatttctagagacgtagaatcatttccattcagcctaaaaacatgtcatttagcttcttttatagagaaggtaagctggagacaaaccctcttattttcttacacacacacacacacagagagagagagagagagatagatagagagagagagagagagagattatttaacatgaaattgtaaaagattcatctccaaatttcaggtttttggattaacagctcttcatttccagttttaaaagggttttctgtcatctccatcttccatagattcaggtgagaagtccataatttaggtcattatccacctgtgtgcaaggtgttattctctgtatgtgttactttccactcaatcctgatttttgccagctctgtgatttgtctttcgttgtgtttacttatggcttgacttctgtattttttgctttttatcacatcagggttcattattatttccttaaatgttgctgtctcaatattccattaggattctattctctctttttgcatcatctgactagaacttgaatttctgtttgtttgtgtcaacctattttgttctctgttctttggactcagtattttccatcagtattttccatcaactggttttcaagttcagtgattctctttgattttgccatactgttactgagcctctcagtgaaaggtttattacagatgttagattttcaattctaaactatccatttgtatctttttgatacttaatttttcccttaaggaacaatatcaactttcttttcactctattagcttaatctttgacaatttcaaacatgtatgtaattctttcacaccctctctactgaaatgccaattttctacctcatgggttagggctgcaaaagcttctttaaagtctgcttaatagtttagtgtaactgtcctttcttctagggattggtcacattttcctgttgtttgtatgtgttttatatatgcatagttatgggccacatgttggacctgttaaatgttgtattccatagatcctgagtactattacaattctttgagaagtgtttatgtctctattttagcaatcaatccatttagatacagatggcaagttctttcatctcttctggtgagctgcaattcaaagctcagctttggtcatgaggctgtgccacaatggctgaggtctaaatcattggggagttttcaaggtacctgtgtgttttcacaccagtaaatggagaatcctttttccaaaataaatggagaattctcttcaaggtttctccaagacagagagatgtgattgttgtagatcataaccaactctgtcaaatagttacactcctgaggctcatcccagaaagaatgccaagaataacactccaccaattccttttgggaataaccaaaacctgcctactttgctttatttcaataacaagtctttaagatgctttagtgtttcatcaccaggtatttttataagttttctaatttctagttgcattcattgaataacatagttttgattaagatagttatgtcatcgtagtgaaataaaagtcccttgacttgtctgggattctccttttagcctcaacaacaagacaaaccatgtgaaatcctccaatgaaactaattctgctcaacctgtgtcacttagggaccctagaaccttacctaaaaacagatttgggtatggagtaacgtgatgtagtatctgctagaagagggtgcccatccctagtatgtaggtcaagatcagaagtagctgacagtagagttaatcctaagggcccagatgtattcattcacctgagtaatttgtgttattagaggtttaaatgcacttctgaaataaaatatgatttcaaggaaatccacccaccaagtgaataaagactatgaaatgggagcaccccaagaaataactctttattcgtgcctttaagtaagccacatacagccctagacgagcttcagaaatggggctttcatttccataaatctatttttactccaagggggcaattataattaatttgtacatggtcacaaaatgaatatcagcagtgcctgaaagtgcacacattaattcatctagtcaagaaaagtttttgagcacctacatgtgttgggcacagttcaatacatcaaaattgtcttaaaggagaactgtaaactaacaggttctaagacctgttacaatctttggaatgagcagtaattctcttcctccttcccacaattacattacttctgcagtttaccttttgatttattagcatgtttttcctgatttgattaatgtgttatatgtgaggctacagtgcaattataaatactctcaaagtgtagaaagtcatcgatttgaaataagcatgatatctcagtgcacacgtgaagcttcctttaatggtgccatgtgtaatggctactagtaattagaaaaacagtggccatgcatcaaagatagatgcaatggagcagagctattactgctaccaaaaccaaaaaggggggggcaaatgctttgcaccacgttctgccaggaactcccccaccccaacccccattagtaatctgggcatgctatacctcttccgcagatcaacaggcaatctcaccaactcatgcgatgagaccactctcccctctccagagactaggcttagttttcaaggtctgtaaagggggcatattcaccattgataaagagcagaaagacaggaacagttattcaaacatcaaaagttgacaatgtgtggacagagaagaagcttctagccaagctgggtagtgtgacctccatagtcacctctgacctgacacctttgtcccttcccactctttccaagctcctgttttctactataacctcactctgtgagagcatgtgtgcatgcatgcctctgtgtgtgtgtgtgtgtgtgtgtgtgtgtgtggtgtcaagctatttaaaaatagtaacctcattcattcagtgtgctggtttctgcacattttttaatacactatgccaggcactggactaagtaacagagaaacaaagagcccaaagttgatggagatttgcctctgggtcatccacttccttagtgagactttgggccattttatgctttgttctcctccctaaagcctgatgctgtctcttacctgtatctactgccaatccctgctcctcgtcaccagattctactgttgtggcagaccgtcgccatcctgtcttccccgccacccacctcctgcctcgggagttaaagaatacgtgtggatcctgggaacgttcttttttgtgtcacattcataaaaaaaaaaaaaaagctaaacccaagatttaattcctactccctcaaagcctagagcataacaaagggcttaccctacaaaaattaaaagcacagaagttacaaaagcacaaagtttggattttcacatttcctagatcaatgaaagtaagacattctccctgtggaaattaatgcaagtttaattctatttatattagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccaggaaaaggggggattaacatactggtacttagttgggttggtaagtacaggaaagcttgaattctcctctaccttagattgcaggtatgcatatatttacacttttaacatttatttaattttttatgaatttcataaaggagtactgtatcgataccattttaagacacattgcgtttctcaatttcttgaaggcaagcataaaagccaaacaaagaaatggaatgattgaacaattcaggttgaccaagccagcatccatgtgattccccacctttaccagctcagattctcaagtaagcatagcagaagtgttaaagtaaaaaacaacagtggccatcatttgaccaggacatagataggtatgtaagaagttcatgatctctgtccaggacatactaaaaataagctatgcagtcagctagataaagtgccacacacctgttatcccagcacacggcaggaggacacaaacagatcatgacatgaagatgatcttgggctatacacagaaggtgggaccagcctgggctacatgaaaccctgcctcaaacaggacatactaaaaataagctatgcagtcagctagatagagtgccacacacctgttatcccagcacatggcaggaggacacaaacagatcatggcatgaagatgatcttggcctatacacagaaggtgggaccagcctgggctacatgaaaccctgcctcaaaaaaaaaaaaaaccactatgcaaatttatcaccacaattctctcagaacacacctaatggagggggaaaagaaagctactttcttactctaagttagactgttgattgccctcaattcatatgtatgataaatgtaaagctaatctgatttggcctggttcaaatacatccacttcatgctatttgagtgtgagcaggttttcctttcttcctatgactatgtttccttagttatgaaatgagattaatgcttaaattgcaggcaggtgtaggacgtttaagtggcacaaaatatttggtagacagtgccaaaacacatacaggatacagaaaaccaatagcactgtcaactttatctgttccatcagtatctgtacccagcagcctgcaatgacagaaaggaagagggaagttggtccactaagtaactttcatggacacgcaataacttgaagacctactcacagcagccctgaagttctgtaaatttaaaaaaaaagaaaaagcctataatatgggactctatacatgcagaattactaactactagtgcagactccataaaaatcccattctatttatatgctcataccctgagtacctgaactaataaaattgcattaatggctatttacataaattcacaattctaaattagacctttaatttctgtaataaaaaagaaagtggctcctgcaatttcccatttttattttcctacatggaatacggtagctctaacataatgtacgactttgtgaatatttccagggctgctaatattttatctaatattatattttgtgttttttgatctctgacccccgtttatactcccagaaccctcatgagcaatgttcactatgataacccttggtgaaagaagcagggctaaaattgaagttaaatcatccatggcttggatctctcaaggaggcctctcagggtcaggagtgattttttccatgtatatttctctactttaagaatgtttcttaaatatttgattcatcaggactgaaatataagccctcttttcgaatagatcactggcaaacactatagagtgtgactatgaccctgagttcttcttgcctttttttttatttcactttgttcattatatcaatatatattcctacgtcctctggggagcaacaaactgaagaaagaggagcacaggagaaaattatgagacaatacagcttttaaaagatggcaaacgtaatttatcgacagaagaagaaatagaaaaacattatttttaaaattaaattgaattggtgccttaatatttacaaaaggtgatgagtgtttgaaaccaaaaaatggatatactttcctcaagggaagaaaaaagagttattagaaagaattaggatcaagtgaggaccagattatgaggaggcataacacattaggagcaaacacgggagggttaggatataaattgtaaatgggcaggaaaggacttaaacatcaatggtagcaagtagaggaaggcacagggcagccataaaaccacagggcaagccgtgaaccagaagaaagagaaactggatcactaccaataacacagctttgtgactcccactcacaccaaatcacagagctactcgaataatgtgcatttcccacacactgaccaaagcactgggggcctctgcaaccgattcacagccagtgccaaaggtctccgtccttgtcccattcctcctacatgggacacttcttttccgtgtctgcattgcttcccacggcccaattctggagtttctagctttaaaagctttgctgctcctccatcgcctgtaggtactaaatccagattcctgggcaagggtctccgggatttgctttcatttctgcagtagctgtttgctctccagcttcgatggaagtatagcccccaaacgtgcaagcatttctctttttttctgctttgccctcctctctggaatgttctttctacctttgaccacaacctccccccgccagagagtcctctcaccttgcaacccccagaatgtttatttttgctactttttaagcctttagtgccaaccaggatgcctggcacacacgtcagtaaacacacaagtaaatgatcacacagaaccttccaaagttcagtaaatactttttcgttcgcttgtttcattgtcacctccattcacttggttctgtttttcttcttctctaggactgagacagacgggcatttgaccgcaccacaggcatttcaggcctgagacagcgccaatgcgtgagcaatcaaaggactggactgtgaggtgcgggagaagaggctcaaccttggagctggactgggctctgtcttgtggaagctcacgcctgcttcttcctctgtgtgtttctgaagacattgtccctgctctaccgctgactgattatggccactgagtaccctcatttgtggcatttgtaccccttcagctagggcagtattccattatcctccccatgattttggtattgcaggggctctagagatcggagccatgggtaactggtaacattaaaaggttaagagtttgttcttaatcaaacagtaagacagtaatggcactacaaatagaaccacattttttacattctcatttcctcccatggaaatgagcatacttttcatttgctaatgaactacaggaaggtcatagccgtagtcttattgaaatagacacccatcaggtaatgcgctacagaggtgtttgtatctatctatcaactggctattacgttagtgcctactctgcaaagggcattttgtacagaggtgtttgtatgtgaggtaattactcaatctatcaactggctattacgttagtgcctactctgcaaagggcattttgctagattatgtagaagacatgaagaaatgtagggcatcttcccacacttccagatcccaaagtatataaacaattctctgaacaaaagaaacaattctctttcataatctgaaacccaaaagatattaaagtggaattaaccattaaaatatgactgctttctgccaggtgtgatgtatctgtacattcagtgaatccgccttacaaaagaatttatagggctaaagtgaaatcacgaaagatagatctaagatcttaaatctgcaagcctatgcctgagaacgtagcttagttagagtgctcgcctcgtgtgatgccttgagttcagagcccagcaccatatgaaagatagatctaagatcttaaatctgcagcctatgcctgagaacgtagcttagagtgctcgcctcgtgtgatgccttgagttcagagcccagcaccatacaaatcaggtgtggggatgctcacctaaaataataccactggggaggagactactaaagaattaaaagtttgaggtcatcctcagctacttggtgagttcaaggctaacctgggctgcaggagacagtctcaaaaggagagagagattggtagaaagaaagcagcagaaagcatctcttcagcccagactgcctcattcacgctcacatttatccattcgttcgttcgcctgaaatgtaatggcgaaagagagaacagcacgaactgggaattcaaagctgcagaggccagagagagaaagaaaggctgagctgagttccacggcctcccattgtaagtcctcatgactgtcataaaactcacacattcatgaaatcataagggaaggagaaagaatatcaaatgataggacacagagttaaccaagatgccaggctgcagtacagacacacagagagaagggatcctgagtaaatatgggtcaatgctagaaggatttaaagggagaccacagatggctgaggtacagtcatggctaggatatctgtgttattgttttaaaagggatcctgagtaaatatgggtcaatgctagaaggattcaaagggagacaacagatggctgaggtacagtcatggctaggatatctgtgttattgttttaacctgcttaggctaccataataaaatgttgtagactgggtggcttataaatgacagaaatttcttttttacagctcaagttgctgccagatttggagtctgatgaggccctactgattcatggttggtggtttcagtatcttcatctagaagataagcatttcttgggtctcttataaaccagccataacaatttgtcccagtgatataatcccttcccccaaacccaactcatgatagcaccaccttcagggttgaaattccatcacatgatttttgtaggggcaaaagcctttaaaaccatggtgattaattatatccagtattcagcaaatgcctactatatgccagacactgtgcttaggtctagaaatacaaggacaaagcactaattagaaacagagggaatggagcaactgggggtggcatgtagactgtgtattgcacacatgatcatgaaagacatagaacactctgtggagcagatgatatctcaagagaacaaagtgagggaccctgaattgaaactctaatctgacacacaggctttgtggccttgggaagtttatttcaaatctctcagcctcctgtttttcatgtgtgtaaagggataggttagatttcctatgatagtattgcttctatattacttatctgaagccaaggcttgttacattatccaaacaagaaaagtcattttattacacagagtctcagaataaaggaggaccatgacatatttgttgcactagaagaagtttggcatagctggagaaccaagggttgagaacaacaacaacaaattattctcagcaagtttggactctctgttatttgacattttcataaaggtgggtcattacttaaagaaagggctttcatggtttcaaaactagaggcatgcccatgaagataaagtatacatactgtcttaggaatactttagaccttcaacacccaggataaggcaagcggggagaggagtcaaggaaatctatcttctgatttaagcaggagttactgcattgttccttgaggtaggcaacagtaaaggaagagcatctaatattaatcaaatttcattacaaatccattctgtacaacatagatttgcacaaaaagaagggaggggaggagaagaagtacatagtggaagaaaatgcaagtttatatgggaaattaatgatcatataatggccatttccatttaaggcaaggaaagagttctttgggtattaatgttaatttggagaagaaaacaacttacagtcagatttatatcatatacaaaactagttgtatgtgaatctaaaatgcaaatatgaaaggcaaatgtaaaagtaaaacttatgaaattatttgtatgatcttggaatggtaagaagttgcttaaccaaattagagctcagttgccatggggtagggacttctgctattctagaattctgttagttaatggtatcatgatcagggccagcatatataataagggaatatttaccaatctgttaaaaagaagatgctgtctgcatttgttatttgagatgcacaaactatcttgacagctcaccctacctttcaatagcttactgcgttctgagtcccatctaccttcacacagtaaaactcagaaagctcattcttctgtaacccattgcaaaattatctaagttcttcctcactgtaactactgtacagactcaagatgacatgttgataagtagaactgagcctgtatctatgagatttttctatcacaagctttctgatagctctgggtgataaacaagtttgctgactcactcctccagagtggaaaactgggagatctcaggcaattcaggagtggaagatttggagagagcaactgagtcttgctagctgtattgagacaattgcctgatgctacaacacccagaacctgagggagcagagctgcatccaggggttggtgggccattcaggaaagcatagcacagtgcagctgaactgtgtgtgtctcttcttcagtgccagttagtgtttcgtgtctgtatccactgacatttctttctttggacccctcatccattgattcctccagtcctcaacatcttttgatagattctcaactgtgcacaaccagtcaattcctattgttactacccatagtgcagggatagtctctacaaattgaatttaaagaaaaacatctaacagtcggttcaaaggaaatataggtgaggaatacgcataagcattttgtttaaaggtaattaaattacaaccatatgaaccatatgaaaggatgtctgtcctcatgatgtaagaaagttcaaatttaaacaatgaattagacacactatttttactcgttgtattggcaaaagttaggaaatcgaatgcataactgatcaaagtgctatgaagaaaaatgtcagtagaatatttagccacaaactgaacccttatttcctatgtacaacacataagactcagggaccatcaagaaatgggaagacagaaagattctaggggtcagaggaggaaatgtaccagagagaaccgttgtctttggacagatacactcatgaacacacagcagctgtgactgtctacaagacaccagtgatgggggaagtacttctgcgtatatgtctctcttactggttaatgaataaaacactgttggccaatcgggaagcaagatgggcaggactaggagataaagaggattctgggaaatgtagtagggacctccatgtgccttggaggagaggacacaggagtctagcattctcggtaagataagaccttgagaaaaacacacacacacacacacacacacacacacacacacacacacacacacacacacacatatgtatacgtatacgtatatgtatatgtatatgtatatgtagttaagggttgttacttaagacagagttagccaacagaagccctagacactggccaacagtattgtaactaatagagtctctctgtgttattttggggactgaagtggcaacaggacccaggcgggaatcctgcaacacaccagtaacattctagcgtggaatcagaaggggctcctgatctgaggagctattgacagttgatgacttctgggggaaggataatcagggtttggggggaggctgtgcccctggtagatcaaccacaccccagtgtatgattccacacacacgacacccataccttagaaacacacatttgattcagtgggatatcggggtgggggcgtaaagaaggaaggagacagtggggaggtggggttctggagtttagggggagaagtgcatcaaaggaagttctcaaagaattaataaaatattatatttgaagaaattatcgctaacatcttgcaaaggaaccagaaaaaaaagcagctttgcatgctagttgtcaatgtcccttcagccttaaagcaatctgaaaactgctataaagctgtataaatacagctgcccctgagctaggagccagcaactccactctttagaagcaaagactctagtacaggggatatgaaaggttgtttgctacagtattgtttgcacccactttttaaaaaagcagttgattggattttatttcattcattatgcaatattatcttgcatatgtgatcaaaattttatagtatttataccataacctattaccatgtttgaatacatgttacaatgcatgaaactcaatgatgttctctgtgcactgggaaaattgtgagtgggaatgaagccaaactcagaggtattgagagagagagcaatgttcatggttaacacgaggaagacacgggagaaagtgaggggaaaaacacaactgtgaagtggaatttgccttgtatgctattacctgatgatgtaagaatatggagcaaaccatgaatgacaacctgacataaaagcacaatactcactcacgagcgtttaatcatctgtgtttgtggtttcttgtcttatcttgtagcttcataaataaaatttggagagaaaaagcaagttacagattaatctggaccccattgttttgtttgggtaaaaatacataagttctctgttgttacctcagaaaaatgactggttggtatatgtgactgggactttatagctttttctttctctttgcattgttatgtgttccacaagaatcaagtgctactttacattttttactgttgttgaaaatcataggcttacaagaaaaggaaagagtttacaactactttcagctaaccctgtcacactctatgtaagtgaggatttcaaaactgttgtgtgtatattgttagtattcaggcatctgccctggcctgtccttgggcttctgacaggattcaccctcagctgcagccactaagagcacagcctgtgcacattcactatgttcccttttaaaagggccctgcccacctcccatccttctctctcctttctctccctctctctgtctgtttccctctctctccctgtctctctcttcccctcttttctctctcctctcccctgctcctgtctctagaggatgctcttcccccttccctttcccctttttatgatttctttcccaaataaaaaacccctctgcttgaaccctgtggcatggtgtctttctctcaggcaccacttttcttaaattacaacatatatattagaaaattttaaacattataaaacaggaaagcaaatgtttacttctatatactttgaattttgagttttttaatttgaaagaaatttaggccccacccctttataaagaaatacagtcagttagtgagtgctgaaagaggaggaaacaatgggttctcatcaactcttctcctggacaggtgctgtggtctgcttgtgtgtgacctcggaactcatgcgctgaagcctccctcgttgccagggtggtggtcgtaagacatggaaactgaggcagcattgatcatatgtctcctcccttgtgggtggaattgtcctccttataaagaggcaaagagcccctggggagcttgtatacttttccacacatgagggcaccttagaaaccaccacccgtgtggtctctctccccagacaatagagctaccgtctccctgaccttggtcttcccagcctctagaactgtcagaagacttgctgtttaaaaattaatcagcctaaggtacgttttatagaaacctgaacagaatgataaaggctttccatattcacaaaattattcttattatgaaaaacacaattattttgttgttcaaaactaggtcccttttgttatcatctgagtgaaaatactgattatttgttgaaaatcaaatgagggactagtgagatggctcagaaagcaaagcacttgttaccaagcttgagagcctgtttgatccctggaacccacatggtggaaggaacaaaccaattctctcataggcacacactttataataaacaaattaattattttttaaaatcaagaaggaaataaaatgatgaaaggctaattgaagcatatggataagatacaaaactgggaaatttttcatttataacattttcagtgaaaggatgcaatgaatgtgtaaaatgaattaaacaagatgtaaggggctcagggagtttaatctaaggaccagagagatggttccatggaccaaggagcttgtcttgaaaaccttgaaacacttgaaaaagtgacttaacttttcgacccatggtaggaaaacccagcccagaaagctgtcttttaagtttgacattcgtgcattcaaaccacccacataacaataactataaatgacattgtaattatatgaaggaaattcaatctaagtctttagtgtagccatttaagggtacagtttaggttgaacaatacagaaagtgggcagacttcaatgttaatttaccttaaatagcaatgagaccctgagatgggattaagatgaagaatattgataaccatttgcaaataaaaaattagtttttcccaacagagtctcactggagatacaaattattcttaaggggaaatcctatgcccagcagtagatagccaaaacacaaccaactcaaaggcagttttggaggctctttatctcataatgccttgttagggctttacctcatacacacacacacacacacacacacacacacacacacacacacacacacacacacacacacactttaaaggtcctttgtgcatatattatggtttctgcttttgtgtttttataggagttctgtgtgtgtgaacatgtatattcctgtatctatatgtgcttcctagcttttttctttggctatttttcttctgtttgcttgttttgtctaattctggttgtttgttattgttattgctattactattattgatgccagtttgtattctaatgagaaagaaaaagaaaggtgtggatctgggtgagtggagaaatgggaaggatctaggaaacactaggggaagggaaaccctaatctgaatacattgtgtaaaagaagaaatcaattttcaatttaaaaaaagagaagttggagacttttaaaagctaaagaatttccatgacttcattgtgcatttagaacagttttccaaaaatggttccaaagagttctacactgaaatacaatcattcttactgaagacattttattttttgcactaaaatgagctacccataaataaaacagattaaaatatacccgtccctgaaagactgttagctttgtgattgctaataaagtaatgacaataataaacaataaaaggatctgtcactctaaaaaaacaatattttaggacgaagacagcaaatggctcgtaagccttaggaccagtgttgctgagtctgagctgcccctgaagctcatttctcatgactgaagaaagatcacaaggctgcagcttaatgacagtgtggataagtgagaggacagggctggaccgaacacatcctagctgctccatcatgtatgaggaaacagaacatcccagcactagagggaagggggaagccagataaaagtcagcccatcatttaaaactgaatcacacgactcttatctcatggacttgtgtactagcatctctctctactgctcaggccatactccttgcccaaactgggctaaaaccagacacgtatgttacaaaacttccatgtcacattgcctttatttcacctaatagaaactgagttctgctgcagattgtctaccactgtaattaaacacaaaacttaaataacataataaaaatcatcatgataaggaagtaaaaggaatgttgatttttctacatcccaaaataggatccaccaccttaatgccttttccccatcaaagtgcatgatgcttagtcaaactgggatgctaccatggttgctgccttccaactctttggtaagcttttatgggtgccatttatttatcttagaaataggccattactgtagcgttgcagaaaatgtcactttattcctgtgtcacatccaaatagaaacaaaacttaatttccttttttttttctttcagattttggtaacatagtatcgctaaaccaaagcagacagcagctgtcctctgtctcaagtcacttctcctccgagcaaagtcaggtcatgtgacattccccactcatttatgttttccctaatgaaaggatgcctctttgtgcctcaatagatagtttagattttttaatattgttagtgttgagagataaacactttggtacatattggagagtaataaattgtgttgaacattgataaactaacgcaattaccagcaaggtcagagagtcagctaatttagaaatatcagtcctaggattttgagttgtcccctggagaactgcggccactttattacagcaggagggtgaggagaaaatggtgcattaggattgatctcttgatctaattgtgggactctgccattccttgtttgaccaaaaatgcttagttagcaagaggaagcatagcacaactaattgaagaccatcccttacacaccagacacactaaaggaattctagaaaatagcagacaaactgcacttgaggttattgggaagaggttgttaccattccggtgcacgtttgtatttcttttgtaacgtgtcttcaacatcatagtcataaataaaatttaacatcttcaattcatttgagcagaagttttcattctcctgttcatgatctgagctggtgaaattctgaggaaatgaagtcatcagtacccccttttttgatagagacataaagttgctttctgaaattctgaggaaatctaaatgaagtcatcagtacccccttttttgatagagacataaagttgctttaggattacctaagcatccgacagattttcagagctaggaagcatctcatggtcctcacacatccatcaacactgatttcgttgcttatggataatataagagctgtgcaaacttctatctaaacctgtttacttagactatttaaattgattccaaaagtgtaaggctaattatctgctcacatcattattgttctgatataatttagtttacatctcgcccagtccccatcaggtcctcgtttctaggactacactaatttgaatgattgtattaaagtcaaactgagtaacatcctgaacccatggccaaaacaaagttcaattgaaatgagattcatgtctggctgccaggcacatcacaggcaccatcaaaccgtgttacttgggaaaggcatttcaaacgtaacctcttccaatacataatcccatttgacaaggagtttacaggaagtaccacagtggaaaacaacagaagcctatccatgcagcatcttggaaaggcatgagactgacaggttgacaaaacatcagagcctcagactctaatcctggttggtaacaaaatgccttaaaattgtctcctgataggagcatgcatgcaaatatgtaaatcacatgcaagtagtaaatctagaataaagttggattatctgaaaatgtccctctcaggtattatatctccaaaagcaaaatcacttccgtagatggatttttattcaatagcctaaaagacaatcaggaaatagaactaaaaatagtgatatgatttgctgcagttctgattctaaatagagtcattttttccataggcaaggaggctgacagaaaagggagcactcttagggagccgaggggagggaaggcatcagagcggagtgatttaagacaatacttcagggtctttgccaagagcccactcagtgcaacactcttcacaaacacacacagacacacacacatttccctctgtactctcacttgctattaactatggtacaaggtacttaaagctctctgaagaatgttgatattttaggaatagggtcttgagactacagctagaacactcacagttatgcatggtgagtgcagactgacctaatgcatgtaactaataactgatctcaaatagatgcagagggaggcccagctgtctgccctttgtctacagatttcattcttaggacggggctgggctaatccctttgtgatgtaatcagctccagggggttagtcacttacactgcattattgaaaggatgatgaactggtgatgggcccttaacagtaagattgtattaagcagaatatgaggccaaactctgtagctagaggatgtttggagtgttttgttttgttttgtttctttataaaaacagttgagaccatttgaaaataagtctaaatttcctttccaggaaaaggaatccatatttggcataaagaaatacagtaactcagaaaaatcagaatatgtttgtataatacattatatattattaaaatacagatattatattatttggaaattcacacaaaccaaatgatttgtcacaaattatgtcccaatttgaaatgcccaattcctgcagtttcacaaatttgaggaaaatgactttcagtgttattttgagcctggcatcataagatgtgtgtctaacccttatcaaacatctcactggctaagacctatgtgttcatctttcgagggcagtgtggtgtgttctttggattagtttagcaatccatgccctctgactttaggattcttcaagactgagcacttaatatttataaaaaaacaatctctcaccaaagaagtcaatgttacttttcctggtttcaaaacacagcgccctcaaataaattggtttaaaaatgcatcacataggatattgttttcatcagaaagtactttaaattggtttcaaaaaactggtgtataatgggatgagtgcccctgtgtttgcccattcagacagggttgtaggtcaatttctcagaatgaccaacccagaggaattgtccatctcttgtaaggacacgtcaagtttaagaatttgttatagatgtagggaggggagggaaaagatgaacagggctgactggctacagaacttctccttagtgacctagtcaacactgccaatgggtaagatcagagtgacttcatctggctcccaatgcttgagtacttgtccctctagttgccatattggggtcttcctattcagcaccccaaaaacacatttgcagataatattctctttcttcaaccaacacctggtatcagattctttcctgaaactgaaaaaggatgtcatgctattgttcacaatccatagagcagttctaaaccaggctttcataatcttagcacttatatacttctagcaattatctataaggaaatcaaagtatcaactttttgtttcctttttgtcttgggttctgaatatatgttatctttcgagagtttttttcttcaaagatatttcatggtagttctaagctctctgtgaatgaaattgtaagtacagattcccacacaatattcaattttcttatttgactaaggtttgtctttccagtttctgaaggtcattttacttccttacaagtttggcagttgtaaacaaaactactatgtatgtctatgtgtaagttttaatatgagtgtaattccttaatttatttgtgtaaataagagtacaaactgatgagttgtatggtctaagtatgtttaatgttgtaagagagaaaccattaactctcttgcaaaggggcctcccatttcatgttttacaagcaaggaatctgttcctattgctctgtgtcctcattgggagtttccttgttggttggccactatgattgtgtgtgtgtgtgtgtgtgtgtgtgtgtgtgtgtcatactgcatcttttcaggctttccctggtagtatgttaccttgagtatcttttcactcacttgcttgcagggcttgttttccttaatcagtgcctgtccatgcctgttgctcatattttaaattgagttcattctgattttactgctgagcaatacaagccatgttttgggtcagtcattgttcaaacatggttttgtagagatttgcttgacgtatgcagcttttctcagtcctttaacattgtttttcacaagtaggaacttttaatcataatatcagttataggtttcatggattatgactttggtctgtgtttactagagtggttgtttctgggaggggtgcaggctaaggtcaggatgtactatatgagagaagaataaataaaaagaagaaagaaaaaagaaaaagaagaagaaaaaagtaccatacctaaagtcatctagcttttgttttgtttatttcattttgtattttgaacatcagcaaatcctaatctgtaaaacctactacagtagtgtttctcaccttcctaatgctgtgaccttttaatatatctcttcatgtgtgataacgcccaaccatattttcattgctacttcataactgtaattttgccactgttatgaattgtagtgtaaatatctgttttctcatagtcttaagtgacccttgtgacagagtcattcaagcccaaaggggttgagaagcactatgctacgtcatcttttattttattcagagtttttatgtactatacatgttccccctttcataaacaactaagagtaagttatgataagttcatgcttctttcagatgacttcaagtctcctccattggcagcaggcatttgtggtggtttgaatgaggatgacccactcaggctgatatatttgcatgctaaattcccattgaagttattgtaaggattaggaggcgtggtcttgttggaagaggtgtgtcactgagggtgggctttgagatttcaaaaggccatgccagtctcagtctttctctctgtgtctctccatcactctctatctcttcttctctatctctctacctctctctttccctcccttcccactcccctcctctctgtcttcctgcctaaccctgcctgtggatcaggttgcaaagccctcagctactactccagttccatatgtgctcacagccatgataacaaatgaactaaccctctgaaactgtaagcaagctgccaattaaatgtcttcttttgcaagacttgcctttgtcatggtatcttttcacagctatagaacagcaactaagaaaatattaaagaataaaacattatagtggaatccaaactgttcacaagatgccatcctttgttaatctcctatcctgagcatattttatatagttactttagaagttagctgttgtgtgttcttgatcacactacatagtgaacgaatggacagcattccagtgaaagatcacatgtccaagagtacttagatatcacagattggccttgagaagtctttttaaagaaggatctaaggttgagtgggtagggaaagagggctggatctgggatgagctagcagagaaaagatgaatatcatcaaaacacgttgtatgaatttagagggttaatttgatcaaaacatggcatatataactctcaaaggataaacaaattttttaaaaatgcataaaacaatcctgcctacctatagcttatcataggaggaaggtgggtctgccacacaagtggaagaaaaaaaaggtgagcaggaaataatattttataacatgacacttgagaattgtccaaaaccaggaaaaataaaatgtatcaaaccactgagtccagaatctctgagaagcaagaaagataattacaaaagtaaacagaacatacacatatgtctcattaaaaatgaagaggaaataattaaatcagtcaaggaaaaaagataacgcatactggacagtaacactaataaagatctgcggaagtggctctcagctccctaatgctgtgatcctttaatacagctgctcacgttatggtgaccccccaaccataaagtttttcattgttacttcataactgtaattttgttattgttatgaatcataatatagatataccatatggaggatatctgatatgtgacccccaaaggtggagatctgtgggtttactctatagaaccactgttctatagggtaaactgagtacagtggcatatgtttgtaatcccagtgcaggggaggcagagacaggtagagccctgagatttgatgacttgactgcttggcaagtcccagaccagtgagaaagcctgtctcaaagtgaaagcagacagtgcctaagtaactatatcaggcatccaacatcatcctctgccatcaatatgcacagggcccaacatacaaaaaagttaaagtgtgcttttcagaaattctgtgagaagataatgaaatgcatggtagttcagacagatgataatgctctctcctccaatgctcttactgaaatagctaccatggatctttaatagctatatgtcgttggctttgttttgttttgttttgttttgtttatgagatggggtctcactgtgtagccctgtctggcctgtaacttgttatatatatcaagctggtcttgcatttacagagatccaacatacaagtgggattcaaggtatgtgtcaaaagacccaagctggtagttatttataatgtattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctctctctctctctctctctctctctctctctctctctctctctctctctgtgtatgtgtgtgtgtgttatatgtgtgcttgtatacacgtgtacacaggtacatgagagcaagagcaaaggtcaatgtcttctataactctttgctgtgttcttttgtttgtctttggttttgtttagacaccgatccctcatcggcctggagctcgtggtatagctagactggctggacagtgagtcccagggatccccctgactcagtgtccctgccagctctgcaattatggttgcactaccactggggatcaaacctaggtgatcatcttacacagcaagcacttgattcactgagacacttccaacctcaacggtggccattagtagcaataaatatactaatccaatgtaaggtattaatgatgaggaaattggagggggaactcttttgtactatcattatggttttcccataaacctaaatgtctctaaaagattcttttctaatgcaattaaggtaaaattttattaatgtcacaatttatatatcagatttatcactaacagaacagaacatcagtacatcttctgtgttgaaaataaaatatgagggttggtgatgtagttcagcatgagtgaggcttcaaattcaaccttcagcccagcaagaacaaacagaacaaagacaagatccacacccatctaaatatcaaagcaaaatagaattaacactttggttttctctaagaagcttttgtttaaaaaaaaaaagtggtgttcaatttttgagaatacaaactagcaaaaaaaaattctcccatctgtaaataatgtcttgccaaataatgtgctttgtatcagataaatgaatgtgaaactctagcatacatttgtgatgtgacaattaggtatgtaattatttggcaggatacattttcatgtctgtaagcaaaaaattaaatatgcaatataattccagggcaaacagttttcaacattgcttatgagtagcccttcctacttctccacccttataattactacagatcatcaaaattgaagtttggcaagtcgaagacagtagctgaaaacgtaagagcccggggccgactctgcaatacttggcagaaggactgggggtgagggagaagaaagcaatattctcccagaagtcagactcaggaagagtgctgtattcattcaggtgacccaaagtctggagtgtcagataacataggtcaacttattccaaagaatcaaagatcaccaccagagtcctcagaaaagaactccgcatcctgcttacatctgtctttttggcttctctttgcttcgcacggcttttatcaccacctggggggcaagccaaacaggcaagggcgcctttcccaccactaagtcattcataaattatgtgttttctgagtcaagaagacgcttatgatttcaaatgattgcttggctttttccccaataaaattcagtcatttattatatatttcttcttcatctcaaatacgattttaaaatataaactgatttttgtaatccatgaacatcgtctttttgttttatcttcttgtctcttcttatatgtcaacctgtcagaaaacttttgtacttactttgagcatatttcaacttaaaaaaaaagaaggttgaagttgtaaatgcacaacacttagttctttaattagtaggcaaggtatttgccaagtgcacactattgtgcctttaggttgtatgtcctacactagcagagcacaccagacaaacttttctttctaaaatgatttcaaaacaatttcatttcaaatgatacaaaaaagcccaaaatattgtttaggaaacaaaattttttagtttaattgttacatagatactatttatacctggtaattattttgaacaagtcgtaagtacaaataaatatgaatgaaaatgagaaatagtgttttattatgtatatatgtgtatacatatgtatatgtgtatacaaatacatattctatattttctttctccattcatccacttgctcactggtatacacttgtacggcttccatttctgggctataatgaatactgctggaggtagcatagattagcatctctctgaggtggcaccttcagttcctctggatgtacactgataagtgggattactagtttatatagtcattctttttaggaattcaaaggttccttggctcaaaaggagattattgttaagctaaattatttcagccaaattcttagcacatgcttcgtcagtactgtacactctgctcattccaaagccccaaaggtaagggtggaatttgcgactaagtgcttagggagttttatataatctgttagaacacttttatatattagaactaacaatactatgcctgggcttctggtttgtatgtctttttaaactttcattcttactgatttatgttatattttgcaaaatattgatatataagcttagcattttcaaaaaatattttaaatgggtacttcacagaagcctaccactgtctttcctatttctcagcaaagaaattaaacttgcagtggtaaagtaattgctcagttttcaaccccaaaattcctgttgtcagtgcccattcctgacatcctttctctatttccagtaacactgttgtcatggacactgagtcctgcatttcattgcatggcacgttttgtcttctaggatcatcaaggaaattatgagttgtacccaaacaccattttcctttataggcaaattatgaactcgctgtccgtggtttcttttatgcactttccttattctcctgcacattcttaatctcttgtatctacacaataataagtaatgtttgctttctttccattatgtataaatgtaaagcctactgctgcctgacttcaccactacgcagatcttttgcacatggtttgatataagatatggaggtttgcctctctttttttagctttttattttgaagtagctttaaattcattataattaaacactcaaaaatgtttacaagaaaataattacaaactgaccacaaaaaaagcttccacccctttgaaatggagtatttctctgcaatgttctctaatggtaatgtgataaaatcagaaataagtagacagactctcagttttctcagataactaaaattctagttatgttttcctgggaaccctgtttaaagggtagtatgcaggtataaatgcattcattgagccagataaagattgaaaacaacctgcttgtccttcacatgaaaaatgtctgttatgtaatagaagaaattcaatgtgtgttaagcagcatcatcaaggataaagctaacgcaattcaggagaaagaagagggcaggagagaggatgagaaaatcaggagggcttctttattatagaagatgggtggggtttgttataagatatagtgagatatcttcaaggctaagagtagacagtgatcaaagggaccattgtggaaatctacattttttaggttttatttttaagtgtgtgtgtgtgtgtgtgtgtgtgtgtgtgtgtgtctgtgtgtctgtgtgtctgtgtgtctgtgtctgtgtgtctgtgtgtctgtgcgtgtgggcatgtgcatctgagtgtaggtgcccacggtggtcagtgacattggatcccctgaagcaatgattgtaagccaccctgtgtggttgctgggaccaagcttggggttttcagatccagacctgaatactctacaaggacacgaaatatgtataactactgagtcatttctccaaacccaaccaacctacataaaagcggttttatgctttatcttcttcatacatacatattgtttctatttgacctagattcattgtacatgggcctgaatttcataaaaaagttttatgcaagtatacaatgtaatttgatggtatttcttcccccctccttcccttcgttgctgttcccaggcctgctacattcttttattcacctagacaggctcacttatacttccatgttgtggatacctatataattttgtgtgtcaatacaaaatctagaacccacaaatgagaaaagacatgtatctacctgagactgactttcttccctttacataattatctctagttttacacactttcctgtaaacattatcatttcattcttatttatggctgaaaattatcccatagttcatattactacatttgctttgcatctgtttgcagggagaagaggaagccctgagagagtgtgcattgttgactgagacacagccatgtcaaagaacccagagcctgaggccacgaggaatggaaaagcctccccactgggaggctcagaggcatagaaaaggctttccctggtccatcttcggatgctaacagtgtgtgcagaaaatgtctaccatgactgtttacccagatcttttggaatgcttaggtttctccatcagagagcccaatacaatctatcccaggtctacttctctctctctctctctctctctctctctctctctctctctctctctctctctctctctcgcgcgcgcgcgcgctctctctgtgtgtgtgtgtgtgtgtgtgtgtgtgtgtgtctgtctgtctgtctgtctgtctgtctgtctgtctgtctctttttctcattccttcactggctcagtcagattctagtcctcagaggccatgcagggacttaccactagtcctctgtggatggacacctagaatgcttctgtctcggttattgtaaatagtgctccggtaaagatggatgagcaagtgtctctgtgatgctgacttggagtcctctgggctccaaggatacccaaggatcctaggagagggatattttataaaatcattaaccatatggagttaacacttcatctttctgacaccatttaatcttgcttctctccccctgcctctctcttttggtttttcgggacagggtttctctgtgtaggtttggagcctatcctggcactcgctctggagaccaggctggcctcaaactcacagagatccgcctgcctctgcctcctgagtgctgggattaaaggcgtgcgcctcagatgctgggcttaaccttgcttatctcttaaaagctggtctctaaacactcacattgtggattagggctcaatcctatgaacttggagagtctccagcagagggatttctgctgctttgcctgtggaatgcttgcttatttgtagcaggagtcaaaagatgagtgaaagccagtggtttggagcactatgcatcctctccgagttgggagacacaggaagccacttgacgggagactaaggcaggcagaaatcaaagagcacgtgtcccaaagaaaaagaagttttctcatgtaaatcagttgttttccactccagttcctgatatggaaaattagcattttaagtctctattgtcatcatagatttataacatatttgctaaaagccatcagcaatattaataatcatgagacgccaataatcattgttcctgagtcaaaattttttctttaacaatattacttttctaatttaacttttgttttcccttgagaaacaagtgtgctgtttctcatttgcctggttttattataagtgccaggtttatttagccaagtgctccaatgtatttatctaagatctatgaagatggtttcaaaataggcaaacaggtgatgtactgttttcattcttttttttttctttgaagttcctcttcacatagccctctgaactacttggttttgttttcctggtaataccaggccaattaatctgatgattgaggcagttaatcaacagacaggtagtacatacagcgtgaacacactggacagagtgacagtccactttctaggtgagacaggccagaatggtacaggagttcaacacattactcagaaaataagcaattaaaaacttaattgtttatttctggaaataatattcaccacttactcctagggacagtacatctgcctgagttctcttgtcatgtgggtcatactagaaacactgtctcgctgaaactcaggtatgtgggaaaatgtgtggaatatgtgtacactcctcccaatttgctgtaaacttaaaaatgctttgaaaaaatggtttcaaaaaattatccttgaacatagaataaaggaatacttttaaaagactgactaaaaacttgaacaaaaaaaaactaaatgtaaaagtcgggccctgatgacacaagcctttgatcccagcacttagaaggcagaggcaggtggatctctgagtttgaggcccccctagtctatagagtgagttccaggacagccacagctacacagggaaactctgtctcaaaaaaatataaataaatatttaaatatagtatacagtaataatttccttaatttcctgatttttgaaggacacatccccaaaatagataacatattttcagtgtagccaaactacttataaattgtcacaggcaaatttgggcataggcttgatgtagatatcaatctctgctttcacagatcgcaggttttgcttgatgtcatgctcatgagatgttgcatataactctcatttgttcattgtaattgtatatggcataatacaataacttgaaattctgtttttgaagattttgtatttgtgtgtaactatatatgtatgcatgggtgtgtgtgtgtgtgtgtgtgtgtgtgtgtgtgtgtgtgggtgtgtgtggggtgacacaggaggccagaagcgggcctcagttaccctcctctatcatttaatcatgtattcttttgaggcaaggtctctttctgaagctggagctcgtgttttgtcacaaagctggaagccagaaagtcccagtgattctcccatatctgctcctctcagagctggggatacaggcatgcaccaaatgctcgactcattacatggatgctgccatctgaactctacgcctttatgattgttaagtaagcacctttaaccactgagccatttctccaccccctcataatctcattttttcctaatctatttaatgagtggttttatgtggtttttttcatttcccccattacatcaacactactgtaaacattcctgtccatgtgtttctgaggtctacacaaaaatggtatgtgtataaaaacatggtgaaactcatccattttatgctaactaaattttttaattaaattgaaaaatctgtgaagtaagacttattttctcaatgtgagcagttagaaaattaaaaatatgcaggcgacaatatgggggcctttagagcagaaccatctctgattgactcagagagcaatgctctctacactgctgctctccaaattacagcacaaggaggactcccctgagagtgacttcaggtgtgaaataagactaccggtggtcacagaacaacatagccaggtactgcaaccagcagcctgaggagcccttttacccctcaggcaaaaccacatcctgaactatatgcaaaaaagaactttactactaggcaagtgttccaaaattgatgaagtttattannnnnnnnnnacaaggtttttccctgcaagttaaactgttagaccaactcctttaggagttgtgcccatctaacttgggcactgaagctacactttcttcatgcaataaggagaaagtgttccatctgtaacactccctccctagaaaggaattacctttttcttatgcaactggtagacttcactctctgaactatcctcttggaattctttttaacaggtacatttttttcccaaatgagagagaattctcatttctctctctttttattaggataagtacactctcctatgtcttccttagtcactcttaatagtctattaaaaatcattcatttataagattttgtgtttttgataaaacatatatcagattctctcacacttttaatatcttaccatatctgaggatgcaccatatttcctcattttttttgtttttgtttttgttgttgttttttttaatgagactaactttccatttttttattattattattaattcaagttgaggaacaggcttgtttcacatgtaagtcccctctccctctccctctccctcccctcacccccatccctcctctcccacctccaacctaccccccaccccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggcagcaccctctcccctaccctcatgctctcaattagctcgggagttcatgccacttcccattcctggggtccatttatcccttagagtccttcatgtttcctagtttctttggtgaagaggattataggctggtaaacctttgctctatgtctaaaattcatatatgagtgagtacataccatgtttgtctttttgtaattcatatttcctcatttttgttgggtcttttgcccacttatttctttgtatagtttactaaacattttaattgttatattgattatttcaaggaacaaatcttggatgttttattcttaacacatatattacatttagtttacttttatatggcaaatgcacgatttctactttttctactcccctttacttacatttgttttccttttaccaagttcttgagataaattctttgtccatttattttcaatcttctatctcctatttgatgcatctagatccataaagtttcttaagtacggtgttggctatatcccacaagcttaatacatgagccactttctcttttcatttctaaattatttatagctgaaactttattccatcttcagagtgttttaagattttgaaaagaactacattttgttattgctagtatcatttgcattgtgtaaaaaatatatccattatcatctcaagtttggaaaaaaattattttactttaatttgttttataatacatggcaaatttatgtgatgttctatgtattttggaatcattgtgtatgttgtcatcatttaagtatctaatatatcagtcacaataattattatttgaatattgtactttcttgttttagagtttcataatctattgagttcttgaaggcatccctttttggtcctaacattttactttcttcaataaaatataagtagtgtcagaattgcttgttcactctgagtcccaggttcttcttgttgattacttgtattatatatatatatatatatctatatatatatatatatatatatatatattatttcatataagaactgtccacaaaataccacaaagctgaagaaaaagggaagtagataccagatggggcatgatgctatctactgagaactcactgaaaaagatctatcagcgttgtcaacaacctttatttgaaaattcatgacttgggtctgaggaggaggcttctgttgcggtcaggatacaagtgactgttatccaggcgagaatatagcctgttcatctcacactgacattgaagacactgggcactctactggagctgatggcactgtggtccatttgtaaagctccatggaatgttgagaaagtgttggggaagcaagccagtacttagggccagtcaaggccattacattaccccagtagagaaggctctttcagcaccttaaacttctgtgtgtttggagatatacgggctgtacctctacagccaatggactgactcatccaagcaagacctgatgggggatgtctttgtatatatatgtttctcttattggttgataaataaaacactgattggccagtagccaggcaggaagtataggtggggctaccagatgaggtgaatgttgggaagaggatgcagagagaagcagccagagagataatatgtaggcagttgggaagataggacaccgggtattctctggtaagataaggccatgtagaaatacacagattagtagttatgagttaataattaagagagagcaagccagtaagtagcctaagccattgaccaaacagtttctaattaatataagcctctgtgtgtttatttggggctgaagctgctgtgggaccagatgggatagagacaccattctacaaacaccattccagactaagcagttccttaatgtcaaagactttatctctatcatcatagtcaccagagcccagagttctaaggccgtgctgagtgaagttaaagacttcctagaattcaatgagaatgaagagacaacacacccacacttatgggatactttgaaagcagtgctaagaggaaagttcatatcactaaatgcccacatgaggaaactagagaatagtcacactagaaaattgacagcacaactgaaagatctacaacaaaaagaagcaaactcaccccgaaggagtagatgccaggacataatcaaattgagggttgaaatcaataaagtagactaggaaaacaatacaaagaaccaatgtaacaaagagttaattctttgagaaaatcaacaagatacacaaacctttatccaaacttaccaaacagcagagagtgaacatataaattaacaaaatcaaaaatgaaaagggggacataacaagggacagaaatccagagaatcttcaggtcattctttgaaaacctgtactcctcaaaattcaaaaatctaaaggaaatggacaccaattctcctcaaagtattccacacaatagaagcagaagggtcattgccaaactctttttaggaggctccaattaccttgatacccaagccacacaaagacacaactaagaaagagagctacagaccaatatccctcataaacattgatgcaaaaataatcaataaaatactggcaaattgaattcaaggtcacatcagaagagtcatccaccatgatcaagtaggcttcatcccagggatgcagggatggttcaacatatgaaaatccatcaatttaatccaccatataaacaaactgagaaataaaaatcacatgatcatctcactaggtgctgaaaaagcctttgacaaaatctaacactccttcatgataaaagtcgtggagagatcggggataacaggaacatacctcaacataataaaagcaatatacagcaaaccaacagccaacatcaaaataaatggagagaaactcaactggattcctctaaaatcaggaacaagaaaaagttgtccactctctccatgcctcttcaatattgtgcttgaagttctagctggagcaataagacaacaaaaggagatcaagggcatacaaattggaaaggcagaagtcaaactttcactatttgcagatgatatgatagtttatataagcaacccgggaaaaaatctaccaggaactcctacagctgataaacaccttcagctaagtggcaggatacaagattaactcagaaaaatcagtagccctaatatatacagaagataaatgggctgagaaagaaatcagaagaacatcaccctttacaattgccacaaacaacataaaataccttgggatgatgctaatcaaacaagacctgtatggcaagaactttgagtcttttaagaaagaaattaaagaagataccagaaaatggaaagatctcccatgctcttggataggtaggatcaacatagtaaaaatggcaatcttgccaaaagcaatctacagattcagtgcaatccccatcaaaatcccagcacaattcttcacaaaccttgaaagaacaaatctcaactttatatggtaaaataaaagacacaggatagccaaaaacaaccatgtacaataaaggaacttttcaaggcatcaccatccctgacttcaagctctattatagagctatagctgaaaacatcttggtattggcacaaaaataaacaggttgaccaatggaattgaattgaaacccctgctattaacccacacatctaagaacacctgatttttgacgaagaagctaaaatcatggaaaaaagaaagcatattcaacaaatggtgctactataactggctgttgtcatgtagaagactgcagatagatccgtatctatcgacaagcacaaaacttaagcccaaatggatcaaagacctcaacataaatccagccacactgaacctcttatatgagaaagtaaagataaagcaccctcaaacaattggtacaggagaccactttctgaagataacacaggtagcacagacactgatattgacaattgataaataggacctcctgaaactgagaagcttctgtaagacaaaggagacagtcaacaagacaaatggcagcccacagaatgggaaaagatattcaccaaccacacatctgacagagggatgatctccaaaatatacaaagaactcaagaagctagtcaccaagacaccaaataatccaattaaaaagtggggtatagaactaaatagagaattctcgatggatgaatctaaaatggctgaaagacacataagaacgtgctcgacatccttagccatcggggaaatgcaaatcaaaacaactctgagataccatcttactcctgtcaaaatggctaaaatcaaaaacacaaaggacagtttatgctggagaagacatggagaaaggggaactctcctccactgctggtgggattgccaactcgtacaaccactttggaaatcagtatggcggttcctcaggaaaactggaaacagtctaacacaagatccagcaattccactcttaggcataaatccaaagaatgcacatgcatacaacaaggacatctgttcaactatgttcatagcagcattatttgtaatagccagaacctggaagcaacatagatgcccctaaactgaagaatggatggagaaaatatgttacatttacacaatggagtactactcagcagaaaggggaaaaaaaatggaatcttgaaatttgcaggcaaatggatggaactagaagaaaccatcctgagtgaggtaacccagccacaaaaagacaaaaatggtatgaactcactcatatacagattttagacataaagcaaaggattaccagcctacaatctacaccacccgagaagctaggaaacaaggaggaccctaagagagacatacatggtcctccagagaagggttaagggacatgatctcctgagcaaattgggagcatgggggaagggagaaggagttagaagaaagagaaggggagaagaggggggtagaggaagacatgagacagcaggaagattgagtcaggggaaaaataaaggaaagagataccatgatagagggagcctttataggtttaaagagaaatctagcactagataattatccagagacctacaaggttgaccccaactaacaatctttgcaatagtcgagaggccaccttaaatgcccttcccgatgagactgatgactaccttatatgccatcctagaatctttatccagtagctgatggaagcagaagcagtcacccacagctaaacactgagctgaactctggaatccagttgcagagagggaggagtgataagcaaaggggtcaagaccaggctggagaaacccacagaaacatctagagttctgaacaaggagaagctcatggagcctagactgattgctgggaaaccaacatggactgttccagacctcctgaacatggatgtcagtttggaggactggttaatttgtgggccctctggtagtggatcagtatttatccctagtacacaaatggactttgggagcccattccacacagaaggatactctctcagtctaaacacagaggggagggtctaggccctgctccaaatgatatgacagactttgaagatccgccttagaaggcttcaccctccctggggagcagaaaggggatggggagaggtgggggacagaggaggaggggagggagagggaattggggttgatatgtaaaacaaggttgtttctaatttaaattaaaaacaaattttacttcacaaaaaaaaaagagcctggtttcatttctaaaccagatgtattttacagggacagaggacctatcttgcaggggaacctgtagccaggcatagtcagggtgacgtagagtaagaggttcagggctgcgtttcacttttgctacgccccctgtccccattgttgtcacttaggatagtgtatgtacctagttagggatagcttcctattgtttatggttgggattggaaggaggtgttcaggggtagacacctctttcagatgactttaggatttagttaaaatagatagttaggatgtgacataagcagattgttgtatcttcttatatttcacttttatgattgttcattttggatactttacagtgttaagttttaatcctcttttagactaaaaggggaattgtaggggaacctgtagccacgcctgcttagtggcgtggtcagggtgatgtagagtaagaggttcagggctgcatttcactttagtttccctttcagcttgctgtacagactgctgccatggcggctggctaggtcactctgtaagtaaggcttttccctgttaaatacccttatatttcttggctccgtattggtaatttcccactatactatctaattttttttaatatctgaactatgaaagctgaccttatcaaaatagaaacaaatattccattatgattacataactgtgtatgtgggaccatggaaaaagctcctagtgtccatgtctttcagaggtttggagcttgaaatgccccaatctaagtgtggctgacatgtgttgtttatccaggtagatcaggaagtgactgagttggttggagctgttggtatttactgaatgtaaagaagtgttcgtagcagatctgcctggttttcttggcctcctcttctgcttttcttgtcttctgatctcacacctaaaatgcagattcttttcccaacacaagtattaaagaggagcatcccactttgctttttgttttgtttttcaatctttgctttccaaaagctaaaagcagctttctcatccacacagcccagacgtcctttcagggtctaggacaaactgatgcaaacaaagccttatggatatgcactttggaagtgctccaagctttcccaatgtccaacccacacaggtccagggatgtgtgtgtcctatccataaggatgttggactttgcataaggcgtgtcttcagaagcaaagcttactctactctggaaagcgtatgtaggcacctctgcttcacccgctgtagtcttatcttcattatcggtgcgaaagcccacagagcaacgttttctcaataatgttgaccatgtagggcctcaaaagggtgtcagtgaccctgagaggttcacagatcatgccctacctacaactaagggacttctagaatgcaatctaggcacatctagaacgccatccaggcaggctgggaatcgtcactgtgatgaacaggacacctgagtgaggatcactgtccttgattctgtgtttccttcctcagtagtccatgaaaaatgtgtattcaggagagctcttcctctcaaagggaggatgtctctgagagttccccacagggtttgaggctactgtctaggaaagacaggatgcatccacagtggttcgatctcagaaacaaagaaaaagcaaaacaaaaccatggaaccaaaagcaaaagaaccatggaacactgcagtttgtgctcagttatcagccctacagaaattcttagaacctaaaacaacaacaacaatttaaagaacttaaaactcaatgtaacaaatttggaggtgggtaagaaaaagaagaaaaaaaatttaatacaactatttcactttcagcaaaaaaaaagggaagaaaatattaggcctttgctttctaaatttaagtgtatatttgggggtctaagttacttcaggaaacaatttctctattaatatgtatgaaaagaaatttatagcagctatcatgaaatacaaagcaaccaggaataaattcatttaataaaagaaattgagtgtgctgtatatatccctagatgttccatttaaaatatttcaccaacttaatctagttacctagtagtaaggcaattacacactgaagatttagagtcgatacagatttagggttcagttgtgatcttggaggcttctcacaaaacacttcttacgggaaagcaagccccttggcaacctttgcatcattgtgttcaattaagtgacaatttattctgtttttgtttgtaatggggctcgtcatttactgtcattactggtccaccagagagtattctctttgcttttctcttcagaataaatctgagccatcgagagtttactcttctcagcagtgagaaagcttgtgactaatgggaagccagctccatctagctgtccatcttgtgctattcctctggccacatccaccagaggaatatcttgtgtcatcaaagtccagcttttctaaattagtcccttgccaaatgcagaggtctgtgacttcgtgtctgaaaactttcaaaggggttggtgctcattcacttatttctgttgtattttccccttttgttcctccaacatgaagctggttattctaaggaaagagcctaacattttaggcaggttaacaggtaacctgattaagtgttgaaatcgtattatatgtgagattgtttattgtgtgcatgtgggtctttatcaaaaaaatgctaagcaggtctcctgagacttccaaagaagtgctctccagtctctcttgctgaaatcaatctaaaaatatttagcatgtggaaatggtgtgtagccacatgcatctttattagactgtgccaatattaaagagatttacagaaaaaaacaatgcttgttgcacacatttcctacattgttgttattaaattattcttaaatttgtaaaattactaagctctctaatccatgcttctgagcgagttaggaattgcactgtcaccacagttttatcactaaagagatatgctaacatctttataaattcactaaaatcacctttcacttcaaagagctctacatacatttcaaaacatgtggtttttaacacattttcagtgcatttccatcaatatttcattttgctatcacccagctttgcctctcatcacaaacagtaaagcagcgggccagtcaggcagttaaacatagcttgggttggggaagcacattacgctatgttcttcattcaaatagtaaaatatgctctgagggacaaaggactatctgtaaacacaaatatggttttataaacccttcagactctaaaaaacagggtacatacatcagatgtgatttctcagattgtgccatgtcctatctggctcacaatcctgcatttgtactggtagcaatcatacccatgaaacataaaaacgtcatgtgtggagatctcctgaagctccctgtctgtacaggttgggcactggccatgatgcactcattcatccatccactcaatacaattttgcaaatctactgcaaacacatagttctacagtgagctatgtccttagacccttaagagaaaacatgtcctcagatttcccacccacaagcattatagagacaatgtaaagaatgataaattggctttacttttctaaatataatcaattctctttgtggttaaagcacatgccttttcttaaaagccattgacatccaccaatactacagcatgattttgatcatcaggaaaactggcagaaagaggtgcactgaagaaagagtcagggcttctagcaatcagaagtgagacgcagcaccatacaacatgaaggacaacgaggagcttggagtgagcactcaacaactgcagagagctcgtaccaggagtcgggtgaggcacgtctgctggctcccagcaccaccaccactagtgtgtagccatgagcaacacgcagttgctaactttcttttgcttcacaggcaaactgaaaatggtaaaaagaaaaccactaaaatatataaattctgtaagcttgaggtcttgacagtctcaaacttgcctaggacaaggatatgccccaacttagctccaaaaccaaatcatattttggtcaaacacacaaaaggaaagctttctaggccattctggctgcaggatacattcaccaaatacacaccagatatcccccaattgatctgaatctctggcctgcttgtcaatctctggtcaaacttgttcaagatgggcaggatgcccccaaactcatgcttctcttccttcttttctaataacatactttatgttgataaatgcagaatgactagccaaacctccatgtttgaaacccttttgcctcatctgtttcacaagctcccaaaactggccagcaccactctccacagagacacgtatcataaagcagaaactaatcttcacttatatttgtgaagtgagcattttcaagacacgtatgactgtcaacttttgtctgtaagttaaatcactttgcttttaattcgctgtaatcctttactaatccataaacaaagcctcgttaatcatctctaaaattttcttttatttatttgttataattcccttctatatttgggtgactctgaggagataatttatgggtgatatttacttgatattacagaatggctttaaccctgcaataccaaaagggactctgctgctcaaatacaatcactagtccagtaggttggtggagcatggtaaatctaggcttcgtctcttcctctcatgcagaactagattttccttagacactaaggatctgatgagatggctcaggatttaagggcagtggctgctcttcagaagacacggttcattcccagcgctcgccggtcagcacacaaccacctgtaactccagctgcaggagaatccagtgccctcttctggtgtctgtgggcactgtacgtgcatagcgcacagataaacattcaggcaaagatataaaatcaaagtgttaaaggtgggttggggtgggttgggtagggaacatggggggatgggaaggtgagggaacgtcgggatggatatgtaaatatgagtaattaaaaataaataaataataaaaaagtctaagcaggcatggaggacagctacagctccaccccaggacatttgtcctgtgtaggcagagatcaataaccagctgcccattgccatgagacccgggaactaggaggacagctacacagctacaggtcggccccaagtagggcaccattatggtgagtgagtaaatggtgggggtggggacagaaaggttcctgtgttggggagaaggcagacacgaagcgtcaagagtcaagggcagtgaggaaccggatgatatgggtggcctgcttgctacctggggccaggtttgggctgttgccaagagccatgtctgggtctatggccctactgcattgatgtccatggttcctgttaccatcaaagacattgtggatagggctgcacagagttggttggccccacccctcactgacttcagtactaaggagaactggccctgctctacagcaactgtagtactgagaagagcaggccctggaccttgtctgggcagcccaatagagctgaccctattgacagaggctcagttgatctggtccatgaccatacacgagatatctagcctcctcatctgccatatagtggaatggaagagggagacatgtcctccccatccccctgcctctcaacacctatggtgggtggttgagttggccctgaggtcatgagagtgggagagctgattctgaccctcactggcttcagtgttcaggagaactagtcctgctccttgctgcctgctgcagtgggtgagctagccagggcaatgctggagagcttgcttggtggtgtcaatgatggaaagctggcaggataatcaacccagcaaccagccaggcccataaccaggggtatgagttggcccaccctaacatctatctacctcacattatgtataaacttctgggacatgtgaagggcctggacctgtagacacagcaggatctccatgacccaaggtaacattaggatatccaaaaggagtcccaatagggcccattactgagggtgtagcagaagccagagaccaatgactcattgcaatgaacacttacaggtaaagatacatggacaaagggtatactgtgtgactcactgtgtatatccatggctacagtttccatgctgagatttttctttctctttttctttctttctttctttctttctttcttcttcttttttgtatgttatagtttgtttttgttttgttgtattgtgctttggggggagttgttttgttttaaattttattttatttggggggggttacaggggcagttggtggatatgaagggacagggagatgaataggatcaggacacatgatgccaactccacaaagaatcaattttaaaaaagcctaagttgggcatggtggtacacaccttcaatctcagcacttggaacacagaggcaagtagatttccttgagttcaaggctaacctggtctacatagtgagttctaggacatataggactgtatagaacaaccctctctcaaaaaaatactattttttaaagattctaaagcagatgggagactatttgagaaagaggtcagtgcgagcatcaagggacaaagagtgatgggtaagtgagcataaacaaagtgtgttatctacattatgaaaatataataaccaaagtggctgttttatgcaattaatacacactaatgaaaataaattctcacacagcactcaccgtctgagaagcactgctctgtgtgacttaggaacataagtttgtcatgaagaaactaccttttagaaatataatgttgaaacttccattatcccctttgaaagataagtaatattaacaacaacaaagtctatcttcagttgctttgttgaatcgtgaacagaacagaaagcaaattagcatcgatagcattggctttcatttagattagaattacctcttctggtacttttacatattcatagcatcgtaacaattgatggtttttaaatttctcccaaaatcaatccagattatgaaacttgaatacttagttgtcaccaatttaataccactcgtgggaataaggtgtcattttcattacatttctatcttatattgatttttatctcatggtgagactcagacttggaatggttccaatctcctagggagatttcctcaaagacctatttaccccaatccctccagttttcatcccctgtggttctcatacttcacacaaaggcgatgcaatatacagggaaccaaaagacaatatcagtatcagagctaactgaaaatatatttgggaacaatgcaggcattctgtagccctggagccagggttcctctcacactctcagaactgaggtgagcctccctgtctagtgcctctcaggatctacctactccaaatgccaaagtgctaaagacagcaaggtaaagatgccagacaaaaaaaacagtgaggactccaactcatccggttcctaagctccttgaattgagccttaaggaaatagatctgcatggaagaaggaagagaggaagggttgggaagatctctgtggtagggcacttgcctgcagtgcataatcctgattcagtccctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagagtctttaaaatcccatcttctactgtctagaaaacaggctgtaaacacagctgcccactctctcaagtggaacagtctgtgtcaaggcctagcgcctttagctgttatgtttgaaagccaaagaggaattttaatttaataagaatgaagcaccttaaagatacaacatgatcctccatttgagagattggatgatttgattagcaataaataacaaagaaaacaataagtaagcactgagaacctgaatattaattacctgtgttgttcactcttaaaaaggaaggaaattctgacacacattacaacgtttgcacaaatctccaggaattacactaattgacataagctatccacaaaagacaactgctgatggtttctcagctatcgtttctatgagtagttagattcatagaagcagaacacagatgggccattgccagaagttggagatgggaaaatgggatgctgtagagcaggcacagaagtccagttttacaagatgaaagtttcggagagtgggaacacggcactgtgaatacactcaacatgactggaatgaaaagatgggtatgaggaagacattatattcatgttatgtattttagtacaataaaaaatataaaaactactgcttttttaaaccaaccagtaatagcaccaatgattttcattcatttgacttccatattaaaggaagtgaaaatgaaacattttggacatagccctagtcaataagtacctcagatcaactgatcagcttaaattttcacaaaagccacaaacaattctcaataacaaacaatagagcatccaggtcaatatataatatgctttaaggttagtcgtggttgagaactgggaggaaaaataaccctctgataccagagacattgcttttggccacttccttaaaactagagagtttttacattcatgcacatttttgtcagatttggggctgagattattttttttcttttgttttgtttttcaaaagtgcctggaccccattactttatacctctattgtactgaaataaaaaaaactgatttgtttgattgtaaatacttagtagtgaataagaaaatcaacatttctgctgacaattctatctatactgtttgacccagtggaaatacacatctatgagatagtaaactttgaaagaattggtaatggaaagactgacagaatgtaagtatagtaagtagtaccatccaaatactttaagaacaagcaattgtgctgtgttgtcatatgatcatttataaataactaaatagcagaggaactaggggccatagctcagaataaagagcatgcatgaggctctgggtttgatctctaaaactgaaaataaataaataaataaataataaataaataaataaataataaatgataaataaattagtagaagttgaaaaagcatttctgttcaaagttattatggtgtatacactgcaggcattttcaaagaagcagcggcatttctgtgtcattggacagagtccacccacatgggagcacctgcaatggcattcagggtaccactgttactcctgggactatgatatctggaaacgacctctcacgtgaacctcagtggcaacaccttgagtgtgtttggcctctcgtttaaggagtgagatggctaatactggctgtcagtttgacaggatctggaatccctaagagacaagcaggactgagatgggaagcctgcagcgattgtggaaagcaccattccaatggtgagaaccccagactgaaaaagaaggggagtgtgaatccagccctagcattcttctctctcagcttcctgactgaaggtgccatgtgccaggctacctgaagacccattagccatgacttcccaccacaatggaccagccccttgcactgtgaggcgcagtaaacccttccttccctcctcgtgctcctttctccaggctactttatcacaacacgaacagtaactcatgcaggaagcattaactgactttgtatttttggaaaattttctgcatgtctatgaaagaaacacactcttcctatatctgaggattgaccctgattagattgttccataatctcttcttcatgaattcttcttttccccctttcaaacattttagcaaagcattcccaagtgccaactctcagtgcctcctcagagctgatagcttgctctggtcacaggaaactccataaaagtgcaccaaagacctctcccctgcctatgtccagccgagcacaggcttcttcagggaggatccagctccaccctgcagagtgagacatcagttcctccagctgtgagttgaaaatcatcttaagctggactgtgtcagaagaattagacaaatactgttttctgggtgatgctgttcctctcttggccaatctcagccctagaatctactcccttgtctgtcttaaccacctttcctgatgtttcttccccactttggttgactccacgactactgtaggtttagctcccatctagtatctaggaccacagctctctagaaatcaacttgacttttctccatcaaacatattatgtaatctctgacattggttcccatcaattttaggacctctgatgcaccttactgttctctaaaccctagtccaaactcccaccagctcttgcaatgtccctgtctagaacctgaactattatctccttcccaaatccctcccgtccatggttccctgcatgacacagtcttttccatctaccattcattccacgaagccataaatcctttcatgaattcacgggggatttgggaagtgaagtacaaataaatcttccatgctcagattagtaattcaagacccaaaagctgcaaaaacaacaccagattaaagcattttctttatcattcaaatgaattatcacagcaaaattattaaagttatatctagaagcagactccaggctatttcttgcttttcctgggaaactttttatgtgtagtgacttcgtatcattctgtcccttaaggcgttcttcctgaacctgtgaactcatcaagatacaaccaatagaaatgtctacctagaagacaacttggaaagtaaaggaagattttgtacatggaacccaagaaagaaaaaaatatctcaagaaggcaaagcagggagaagaggaggaggaggagtaagtcaagctactccctgttaacatgtaatttactcctgttacttattttttgttttattggaatagtgaaaagctactgtgtgtctaccatattctacatactggagttgtatctcatcaaaccagacagaaagccttccttcaaggggacaactgtgttgtaggtgtttagctaatttttattatttattctgtttatcaggagcagctgtgaagtctttttgtgcccttacctcctctgcattaacttcttcattatttgatattctgtctctcatcataccagcatttgtatgcaaaccttttataacctttaataggcttttccaaagtagattatccattgtgttacatttcagcacatttgtggtcttcctttaactttcatacacacatacaaagtcaaggtcatgcttaagcgattgctctgtccacaatttaatataaaatgatggaggaaggcttcacggagtttgtaaggtcatctttcagtagacaaaaaacagtttgccttcaaaccaaaccaaccccagtgagaacattttcaggaacagaaagcagcatgactcttactcaggggtgcactcttgagattattgagttaagtgtctcaagccacattaacatcctttaagcctgattccttctctcaactcttacctctccctaggcttagcaagagtcagatgcagactcaatttagtactactaccctagatggtccaaggaagctaagattgatgaaaaatgtgctaaatatattctcaaatcaagcaaaaaagattgttcagttggttgtgctaagaagtttgtggtacagtcatgcctctaatgtaaaatattttataaaaataaaataccttttaaggagatggggctggtgagatggctcaacaggtaaagtgtctgctgcctgagcgcaatcccccaggccccacacgtggctggcaatagcttgtttgtgctctaacaaatgctagaacacatgaatcagccctagcagctgtcctctggcctacaaatacatatacacacaaagaaataaaacgtacatatatatgtatatgtgtgtgagagagagcgtttgtacacgtatgcatatataccatttttaaaagaaaagagacttctctgtgtttttcccaggtcccaggcaatagcacattcaggtgaatgaagatgaggactgatgtttatttaaaagctttagcttcatgagacctttatgggtccagtgtgcccttaccctttcctcaatcatacctcctgtctccttttggcaaaacagaacaactggaggctgcagggaagttttcttagaagcaatggttatgttttccattttccacttagcattttgcatcacacaacttgatagacacaatgactgaaaaataccaatgggaccagatggcctgacattaaaatcccaacaggcaaataaataatctgctttattgctttaattctatttgtatataccatacccttcattttctatacagcaaaatgaccttgaactctaaagtttaaacgttagtcggggtatacatactagaacacgtgcgtacatgatggcctcaactataatatgttgtgctttggcagaattctgggtaactgttcaaaattattatggaaatacatactttaatataagtactcgaaataatataacccaagcacccaatcaattaagagaaaaaagaaaggtgcattaatcatttagttcttttaagatgttgagaaactcaaacacagtagttcttgttaacgatagagtctgaaacgtcaagtgggtgcttggaggtgcagctgctgaatacaccaggtctttccctatacatcccatttccaagcgaggcccagcaagaaactaacatcgccaagaataaaacagaacaaaagctgcgtgagtgtggtctctctcctctcctaactcactgggttgctctcacctgtgttcttgggacgatgagaaataatcccaacgcttgtgtgatggaacaggctgctgggagaggccctgcattcaatcttcagtatcagaaaaaggaatcagtcgtcctgaatgaacttgaaagctcgtactccagcctgtgcattagatttgcacctgacttttggtagtaacctccactgttgctgcttgagtggattgcaggcggtaaatgctccgtccagatctgaaggaaactatggtaggcttcccggctccacaactgctggcaagttgaacttcctgcctcacacttacctccctttcattttctcacaggcgaggcctgcttccactgagatgacctcagcaaaggttcaaggccttggaattttgtgcctggggcctttcactgagaaaattgagtgtgagaacttgatctccaatagtttccgcctattgtgacatctctcctgggtctcttcaccccgaaattcttcatttcttttcagaatttagctgaacagcactttcctttgcctgtttatctccatgtctgtctccctgctggtatttattgcttatcactgtaagtctttattgaatgtaatctgtttggggatatagttggcatgaaagatgctccaccaaacaaagttgtaaagtattatacataaatacttaattcctcgatttatttattatcgtcattacttatttaccactgtacgtacccaggacacctttgaaagaaataaatctggtcagttgctctcccaaatttgatcagaatatcttgtaagatataaattatggtgttatataattattaatattcttcatatgactggcatagattacagtttacaaaaactttttcacatttaatcttccaggcacccaatattaaaagaacctcagctccatgtttctggtcaggaaactgagactcagaaagtttgggtgacctagccaaggtcaccccagaaagaagcctcacaaattggcacaaacccaggtctccggctgcaagttcacagcgcttccctcttcaaagtggtctgtgggctgtgtagattccaggaaatccagcaaagggctcacgagaaacagaatggccctgcaaccccatgtgtccactctgtgactcttcattgaggtgaagagttaactgtgtgtttatgtttccttttcagctaacttagcccaacttttttatttaatccaagctcattggagtctaagttgaatttgagactgctatactatttttttctgtataactgtagacaagctgggaaggccaccacagtgatcgctcatttataaacaagtacagtaggttgtattcaccccaaaatgctagcaatagctgggctacagttgtggctttcagaggtaattgtgcaatgtgtagggttaggatcctgatcagaagagaatatcaataaaatgggacaaagatccatgaagaacaaaggacaataaacaggttacaggagtgagctgacgacctttattactgacaggctattagggcacttttaaataatgaatgtgcgtgtttggaagtccaataggccttacaattaacatcagctgcattcactcgtctcgttcttctttacaccaggagtagagggagggaaacacagataaagaatttgcatagctcagtcggcacaataaaggtcccacatccctctggaaaggcaaaatcgtttattttatatacaccattccttccagagcaatcttcaatagagaaaatcactgttgcatccaaaattttaaagtattccaaattcgatcatccttgggaaaatccctacctctcattcacagacttctacactaactcctgtcagtgtttgggcagaccttgaagggaatcgactaaacaaactgaaggagagatgctcagaaccttcactgggtgccacgaaaacatcttttgctcatagaacacttcccagtctactcgaaagtccgctctgcaaatctgggtaccataaagtcattccacactaccctaaccctaaagagacgctttggtgcgaaccccaatagctacagacatgcatttcctcaaaaggaataaattagctatcgaatctcattccagcagtcaatgaagcacattaagtccccaaataaatacactacctgggaaaattttattcacttcataataaaaacagattaaattgccactttgaactgaaaaataattactcttaaaccaagtataacagaccagaggcatccattttgtaaaagaaaaaaagggagataaacagaaaataaaatctctcagctacatttggaaactatcaagaaatgaaatgaaaaataaggactgtgataaatcatgcatgtaggtcagtggatgagggaatgtttagcatgttttctatttatattcttatttagcttggtaattaaacataaattacaaaacacaggagtttcaaattgggtacgaaaataattaactttttttgtcaagtgtgtaaaaattaagctgttccagtgggaatatgtcatgttaatcaataacccactgatgtcattagcaatagcttcattcaccaaatttaattgtatttccagaagataaggttaaaataacatattttcacctttgtgccactgtgaccaaaatgtgtgccactgtgacaaaaatactaagaaagacttaaagaattactcatgatgtggaaggttccagagagtgtcagtgtgtctgtcaggcatcagtatgtctgtcatgctgcctttcactttcggaccctgaatcgaagcccatgggtgcacacatccaatgtgggtcctcttttcccttagtcttttctgaagatggaaacacatacacacacacacacacacacacacacacacacacacacgtatgcctaacacacctagatgaatccgaatccagtgaagacagcaatgaaaattaactatcacaaagaatgaggatttgcagtggttttcaataaaggccattgagacacatttaatgaaatgtaaaagaagaaattcaaactgataagtagcagacaaattatactaacggtgaagaatatgatgctgttacagataatcaacaagtttggcttgagtctctgttaaacaatggtgtgagaggtttcatttcaattatctcaaagagggagcagtctcctcagggttacaatgtattactggacagtaaatcttggactaacgctcatagagacaatgtttgtctaacagagtactcagtagactaagggtcgtgagtctccaaaagagactttctgttactgtcctttttcagggcacttgtgttagtaacaaatcttaaggccaggcttactacataatgcaagatgtatcacacacaaataaggcaacatagcacatgtattagctttctggtgatccaacttgatcagtcctaggaaaaccatgttcttctgacacgcaccccaaggagtggatcacagacacacgccaccatgcccaactgtcatcaagatttttcacttcaggatggaactactcattttcagatggagttagactattctcccaacacctcaaacaagtaaaactgtatgaatcaaactgctctggtgtgctttctgctgctgtgattaatcactggctaaaaccaacttgtggaagaaagggttcattttgggttacagtcatcctaccttcctggagtctccactgcaaccaaagctgcacctttaccaatggcctctcttcaggaaagcttccgtcctgccacctagtgccattgcttagttgttctccatgaccccttcatgtaggagactctcacacatcctgggccatgttcttcagtcagcttggtattcagccttaacaccatactggaatacagcctgtgctaaccctgggaaactattccgcagtaattttcatttcaataatgctattcttatacaaatcacaacttatttttgagcttcaactaaccagtattgtggtgatttgaaagaaactgtcaaaaaaaaaagaagaaataaattggcccccaaaaaaactattaggaggtgtggagtgtgtgtggccttgttggaagaagtatgtcactgtggaggcagactttgtgtgtcacatatgctcaagccacacccaggatctcagaccacttcctgtttcctgcaaaatcaaaatgtattaactgtcagtttcttctgcctacatgccttcatgtcctaccataacaataaggggctaaacttctgaaactataagccacccaattaaatattttcctttataagagttgccacggtcagggtgtctcttcacggcaacagaaacttaagtaaaacaagtatctaccatgctaggaaagcaaatattttagttccacagatctcaattcaaaaacatcatacaaaaagccatggtagaatctaagaaagattcccaaaatttcctttaagatgtcacaagctacatgggccaccattgcctgcatttttctcaagcccatttctgagccctaacttgcattctagccaaagctctaaataccttcataattcttcacaaaataaaatggtcaggtccatcacagcaactctcactctctgttatcaatttctcttctagtttgctttcagctactgtgaaaaaatactgaccaacaccaactgaaaaaggagaggtttacttcagctcatgggtttcagtccacagtcaaggaaaatcagggggctcaggacaaagactgctggtggggactggggcacaggatgtgacagagcgctgctcactggcttgctccacacagcttgctcagcaatctgttgcagcccaggcctaccagcccagggatgggaccttcttcatcacttagaaattttcaaaaatgccactacagacatgcccacaggccagtctgatggaagtaatccctgaactggtctcctcttcccagacgactctactctgacaatttgacaaaaactaactagagcctttctcctccacattctgcctcacagcagcactgcccagggcttagagaacgctcagcttacagttctggaattctgcctggtactccttcacttcacagaaagaaggcattgcaaaaatatacagaacacatcattctgcaattttctataccaccaagaagttactgctcaaagtagatagcctcttaaaatacagctgagatcttagaagtaagatagggtcttgtgaggacacgtttgttcctcaagatgttgtcattcaccccacaaaggactgtctatcatttggtatggtacctaatagaatatctgctaacagcagggtgctgagtattgccagcgttgcatgagactggggtaactccatagcctgcttccatggacaagagcaaggccaggtgacttcagatgacacctgtgatttgctgtttcctcttccttaagtcatttcaccctcaacttcctaacattttctgaaaacactttctcgataaatcacgtgttatgattaaaactaccatgtcaaaggctcttctcctgtggaagagcagctttcaactttatttgtatatgaaatagtagaaggggttgatttaaggcaggtgcagtggctcaaatctgtaattacagcatttgagaggctcaggtaggactgtcaccatgtgttggacactaccctgggctacatatcgagttccaggacaggcgctaggctgcagaatgataccctgtctccaaaagaaccagaagtaaggggaagaggataactgctggtttaaagtgaggattattttgccctacctccagagaagtgcattttacaaacacgccataaagctcaggattaggcatttaaaccagcactaaatatgggttcaacagagtagcccagcgaccactctttatgtttcactggcttaaacaaccactgcatattatcaacaatggaaagctgaggactttactgacgtggcaacattcgaaatcaatgcatctgagagcaaggtgttctgtagttactgccaggaccttcccatcccccggcttcaactttatgttatgacttccactctgttcatgttcacagcttcaaaatgttaataaaacatgacaagtgcaaaagtcaaaataaagtagaagaggtgacatgtaagtaatggactgcacattcttaatttaaatcatatatatttattcactcactcagtaactgaatcctaaccaaatgaatttgtaatatattccagtctagttttattaggatttgtgctgtatgggtaagtgtgaaaacaaagaaaatatattgctacatcaacttatattattcatgcatataaagttctgtgtatctgcccacacaattgagaagatgcattaggaagtcgattataataacaagaaaaggttatttgagtcaaatcaaaacaataaatgggctagagaaaaaattgtaaaatatttgttttacattttcctccagtggcacataaaacattatctccttctctaagagattatgaacatttctcctgtcatgtggcacaaagttgtgatttgtttacagtcatttctgtctctaaagttacacaagcctccttgaactttagagaaagtatattcttgcctccattgctgaatattacagtttttatttctaattattcccagatctatataagtactaaaaggtactttaacaaaactctaatttgctaacgtattgattcaccacacttggcactctctcttaaaacacacccatatttgttgacaaggttcagagtacatgcttggctagtctctcacgaccatccaccttctcctcccgggaggtgacacatctcttcaagagttagctgtgaacattcccaattgtgcctctgatccttctttatatagtatttgatactgttaaatgctaaagaatcatacaaaaggtggctctaaaataaagagatgtttctttgaaaattaagatgggtgtttcaaagaattgttactttaaagcatctattaaaaattccaagaaaagaaattttttaaaaatcctattcaagtagcttttttaaacaactctataaataaaccaagtaaacaaggaaaaagacattctcagtgaaaactttcagacactgaaaacagaaattgaaaaagacaccaataaatggaacaattttccatgtgtatcaatttgcagtattaatactgtaaaaacaatgggtacattgctaaaagcagcccacagattgatgattacacttacattcttcacagagctagaaaaagaaaacgatcctaaaattcatacaggaacacaaaagacaccaaatagtcaaagcaaccccaagttaaacaagcaatgccaaaggtattctgatatctgatctcaaattatattacagagccatattaacaaaacagcatggtaatgactcaaaacagatttgtagaacaattgaatagaataaaggaaccagaaatgaactcatacaactatagccacttaatttctgacaagagtgtcaaaaataaacattaaaaatgactgcctcttcaacaaaatggaaaattgaatatccacagataaaaaagaaaaaatgaaaccagatccaagtctcaaaccatgcacaaaagttatttctaaataacttactataagacttgacactctgaaatttctagaggaaaccccttcaagactcaaggactttctcaaaagaattccaatagcatgggaaatgattccaataatcacaaagcttctgcatgggaaaggaaacaatcaccacggtaaagagacagtgtataggatatggaaatctctctgttagctatacttcagctatgtaattaacatctagagtacataaaaacaatattgggttgagattacagttaagtgatagagtgattttctgtcatacataaggtgctgggttcagtcaccaacactatcagaaaaaaatgcaagcctagagatatggttcaattggaataccgttctattcttcatggaaacctagatttgaacccctgaaccacataaaactaggtatagagacacacccctcaatgcctgggaggtaaaagtaggaagatcaggaattgaaagtcaatccttagctatttaacaagatggagactagcctacgctatccatgatagccagtttatgaaagccaaaaacaaatgacaaaaaattaaacatcaaagaaaagtaagtggagtaataaactctgaagacagttctcaaacaaagaaatacaaatggccaataagtactggaaaagtgctcaacatgcttagccttcagagggatacaaattgaagcttctttgaaattctccttcatcccagttagagcagatttcattgaaaataacatattccatgcctatgccaggggtggggaaagggaatccttattcttcactggccggaatgtaaactaaagcttccagtatggaagtcagtctggaggttcctcataaaactgaaaacaggaccaccatatgatccagttgtcccattctggagtataacagattctaagtcagcattccacatagattcttgggcatacaagtgtattgctgcattattcacaatagtgaagcaatggaaccagcctatacatgcatccacatatatagagataaataaaatgtggctaatatacgaattggaacatcgtcagctttaaataaaagtgatatcatgatattttcaggaaaacgggtgcaaatggagaccgttatgttaagtgaaataacggccgactcactcgggaaagacaaatgctggactgttcctcttatgctcagaactcagatttaaatgtgtgtgagagaaataactgcaaggaaaactgaggccatggaacaggaggaaagatctgagggagcaaacaagatgggacacgtgtgacatgacggcagacgagatcatctgggggcagaaaaggagccaaccagcgaggtaggactcacctcacagagagagcggtgagaaaggaggaggagcaacagggtgtggtgacacaatccacaaaaatgtcaccgtgaaacccattacttgtatactaacaaaaaacgtgttttaaaaacttgtccccatgggcacagctataaaacactcccatgcctaaggctcagagagagagactgtaagagccagaggagcatggcgtttactgtgagatgcttttctcctactgacgtcagaagctgcacctttaaaagtctcctcagcacaaccgcctaaacaggagctgatcaaggacgtgatgaggtggacgggggcagcctaggaggatatgtaaccctgtataaaaaactgtgggaaactgaagaatgccaagagtgcgagaaatggtcttcctcagtgaagagctcatcagttggttaccccaacatccaatggtcagccctgaaaacacacataaaaacaataatatgtgaatatatgcacataaccattaataaaaatagaacatgaatttgaagaaagcaaggagagatacatgacagagcttttagagaggaaaggggaggaagaaataatgtaattataatctcaaaaataaaagaaaaattaaaatccacaaaaatactctcaaatcttttatatatacatttatgcatatattacatacataatacaaggagaaaagcaacgaaggtctaagagaattctacaccctctcaaattgcatcccagggttctaattgctcctttttaaaaatccctaattggaaaacatcaaggatccaatgttgctgtaatgtacacaataaatgcacaatacacaagcctctctaatgagacccatggatagtcccatcatatttactaattaatttatgttttatgtattgacatggttttattaaaaccctaaaatttttaataattttcgaattgtagcttttaaaggcaatacgcacaaacagctttaccatatatgcaaatattcctttaatgagacttgcactgaaaagtgccagtttcattcttcctcagttatagtcttcaaggcaaagactgagactacctatgtctttcaagtgtgtcagccatccatccattctgactgagtctttgaggagttaggggaaaactatctagactgacagggaaccaaacaagaaaattctgggtcatggtatatggtcatctttccttttataacatactgccaaattgttccccaaaggagaagttaaaaatctcatgctcatgcccaagctacaattccactttctttaaatccttgccaacatttatcattgtcaaagtcaagcctttgccacactattggatataaaactttactgctttaatttgcaactcacttagtggagcagccttttagtcataaaacatcaactatttgaatctgtttctccatcaattgcttccttcttcctcaggtgagctttcctcctactgacttgtagatgtgtgttaggtatactaaaaacactggaaattacaaagcttactgaactgaaagcagaaatcctttgtctgtcatccagtcctgaatttttctccagagattcaatcaccttatggacttttggctgtttttcataaaatttatctcccctattttgaaataatatgattatatgttgttattattattgatttcctatatcgagggttgagggtttagcatccttacaccattatctcaccctcccaataaaattataactcattttcttcttaaaatattataatttggaatgttagattatataaaaatcgaccaatgcttagatcattattgccattattgcctttccttttttaacattagtttttcctgaaataaataattacctcatttcctcccatggtttccttcactgattcttcctatactcacagttcaatttcaacataacactatctaaattgttttccttttctttgtgagaaaccctttgtccttctgttccaacttcgattgctcattctcccaacatagttttctctgggattctgagatctgttttaccctgggaatttgtcgctttctccccacgtgaagaggtctctgtttcctggataccctcctctactgctgtacaaggcaacctctgtcaatgtgaattgcttttaatcaaattagaacctaccatccatcaacctacagattgatatctaattcattccctttctctattttgagttttccttctttttgtctattgtccagtgttgctgaagagtttgatgtacttctgactcattttccccagacttaggccgtttcttcctcctccctacaagatttaagagtcttctgttcatccctgtgttctgaaatctcatgatgttgaagggaggttgttttgttgttgtttaggggattgattttggttttagttttgcgttttggtggtgtctcaccatgtgtcctatacaaaacagaaagatcccaaaataaaacaaaagcttcttttttcataattgggggtgggaagactcaagattaaagtgctgctagatacagtgtgtgatgaggacccattcacgagtctgtcagtgactctcttctcactgcgctttcctaagcatgaggggcaggaagacaacaaagcaaacattcgagtgaggagctgagtgcagcatttgttatgcaagcctgaacacctgaattcaatctctagcacccatgccaaaagggaggtatggggcatgtgcttgtaatgtaagcctggggaaagtgagagaggctgatttctggggcttacaggccagccacactaggttactctgtgagccctgggtcctaatgaaagaccttgactcaaaaaataaaataaaaaagagacagcttctgagtgtgcacacctgtatgttgcatacctacctatacccacatgagcatattgctacctgcatacacacacaagcacacacacacacagagagagagagagagagagagagagagagagagagagagagagagagggagggaggggagaggtgggggcaggggagagagagagagagggagagggagaggtggggggcaggggagagagagggagatagggaggagaggagatgtcatctagaaacaaaggatctcatatctctttgataagggcattaattctactcatgaaggctccatcttcatgacctcctaaaggcacccaactcctaacgctgggttcagcatacaaattctgggtgtacacaaacattcaacccatggtgtattcgggtgtgttctttttcacagaatcataattttgttcaatagaattcaacttctctcctgatgctttcttacacagacacctgctcctctgaactgtgtcattctccatttccccctttcttctatgttagagcttttcatgaatgcatgataaaccttgattacacattattattaagaataggttattagccagccatttggaagctttgtgaagaacaagactttataactataaggcaagattgcagcattgttttactcagaaccatgagtatccatgtctctattttcttttttactatgtgtttggggggagtgtgtttcagagacagaaaagaccactgtggttgttaccattgacttttagcttcacaggatctagaatcactgaagagataagattctggctatgccagtgagagtatctaggttaggttaactgagattggcttaactgaagacacagctttaatgtgtgtggcattttaataagaatggccccatgggttcatatatttgaatgcttattcatcggggagtgcattagtcatcagggagaaggattaggactcatggccttgttgcagtaagtgtgtcactggaggtgagctttgacatttcaaaagcccaagccaggcccagggtctctgtcttccttctgcctgtggatccatatgtagaactctgagttccttcttcagcaccatgtctgcctgaattctgccatgctccccaccatgatgacaccggactaaataaatgtcagaaagtataagcaagcaccaattaaatactttcttttaaaagaattgctgtggtcctgcttgcttctcacagcattagaacactgactgagacaatgcagatggtaatattctgtgggctggggtccttgaatgcatagaaaggataaaactagctgagagccagcattcatgactctgcttctgagtatggatacattgtgacaccagctgcctcacatctgccaccatgttttcctcgtcatgatggactgtaacccccaactagaagccacaataaacctcctttgcttgcttctcgatgggcatttgacccaagccacaagaaaagtaactaatatgtgcctattacaaaggttttggacatcaaccatgaggactgtgatgaagcatttctctctaattagctactaggatttaatttagcactcctgccttcaacagggagcccaagtgcactcagaacagcttctctggagaagaaaccttgtatctcctgccagagtctgaagaatgagtgtgtgtgatgaagctgagagcaagaagcacaagttcttcactctcttttctcaactctcttccttctcctcctgagacccctggggtatttgagaagaatcagctcctctccccaggaagcttctcattagtttcttaggttcttattttctcttttctcctatgtcaaccacccctcagtcactggatttccatcttccacatgtattgttatctctcttgtctgtggccatttcctcacgttatctgtgtggctagaggaggagtaatgataattacttggatctatgcatcaggtttaagtcaaaattcccttgcaaatatctactcctagtttacactcctatcgttggatttgatcttctcctaaaacattatcatcaccataatatccatccttaagatattcatgtgaggctcccaacaagatgatacattcaataaaactttctaaacaatcattaattcaagtcgcaaatatagattctgttaatctggggaggtggggacaaaaggtttgttatcctgtgttactgtagtgttggtatgctatgctgtgatattctgggctatataagaaaaatgatggagctatatttatgcattttgggagacagaagtttgagtgagtattctctgtgaatccaagaactggattcttgaaggtcaaccagatctttgtgaagagactcttggaggaatcaatactgactgaatatttaaatatatcagaggtgttgcttttcttgctctttttgaaaggactgaaaaattctggttaattttaattaaaaaaatgtcagatcactgagctctccctttcgataaatgagtctatctgttaacttagccagaccacaaaggtgtattgtctcaaggagtttagattggaggatataatttttattgcacaacacaagaggtagaggctggttgagcggggtgaagttattggtggtgtagcattcaatcttctctggcaggtacagaggcaatcttctttgcttcaaaagagcttcagctacttgcccaagcattttcacaaagcagatcctactttgtcctcaccagaatccttaaagtatttagactcagtcttattttcctgtgtgaaactaagaggggtcaaaaggcaaggccatttgtcaagtcagatgagagtttgaatccagatctccagatgccaaggaaaatatgttattgatcacttcaaagacccagccaccagcatctcttccaaacatgtcactgcaaatatacagagtccaataccaaggtgatggaacaaagcagggactctatcagccaaggagactgctggcagatgtctcatggcatatgccagcacattctgtcatcccttagggcaccagggcatcaggtgaccaaaaggacatgttgtgcaaagacctacactcattacaaatggctcctcttcccttttgtttcattcattctgagcatctggtacctttcagtgaagtgtcagaattatacttaagacatagcacatcattaaaataaagctctgggctaataattatgtcttgttcatgtgttttatgactaaagattctgactttccctcaaggtttccaactcactcttcaaaattgcttcttcctgaggcatttgttacattgtggatgtgtccccaacaattaaatagcaatttagttctccatctctagatatttctatttgaagcagtatcccagagctcaagctacttctgcttttaagatggcatttatggagtcttcagtcagctctaagtgtgactgcacacagacgttcatcagagtggaaagtcagctctcagcctccgtgctgctcacacacccccccccccaatgtagctctttatcagcaacgagggtaatccctctcccactctgccttcatctcaccaaatatattcgacagctattaagatatcttagagcctaaatttcacctcagataggggatagggcatgtgatccggattatacaagcatgaactcttactctcagtattcaaatttatatgttaaatgcatcctgcaaagattaggtttgggtccagagtgctgctttggagaagcagggccttatggaggttttgggggtgacagaagtcatgctactaaaggaaattggagggccttactctcttctctttttctctgctccctaaatgacgaggcagaagacgtggtctgccacgaactcccaccataatacactgcccgcaccagaggctgaaagtaacagtgccattctgtcctgccctggaccctccagaatcatgagcaaaataaatctttttgagtgagttgcctccaggaactcattataatgatggacagctagcatgcttagttgttttaggttttacattattattgtgaaaaaccaaatcagactgtgagatcgggcatctttaattatttggtaagttataaagaagtagtacttcggggctggtaatagcattttcatacagaatgccttgctgaatactctttgggagctggtgaccctggtactttgtgtaatggaccaggatcattactttgtgtaatgtaatagaaggatgttccttgttgttttaaagttgaaagccttcttcaaccatctccttctgtggtttgatgtctaacatggctctgccatgtagagaaaccaatagcacacactgaggcagcttctctggcaaaagtagtagatgcatgttaagagatttagacacagaataatgccaaatgagcctttctccacacattcatgggaagccatctgtgtagtatttcacaaattattaatttatgtgttaaactacttagctttgctactgtatgggagagtgagaaaagcattttaaataaaactttcaatcactttccctcacaaaaaaactctattctgttcatactggctagatattgagacacaaaaagtggattgctgtggttgtatggttacagtaaagaataaacatgccttgttgttgagatccaaatttcagaacccagtacacagcatttcctttgtcaggtggtttggactcttcattaattctattagcaagaattttcaactccttttcaggggaggtgattttctgtgagctgagggttcaggcacaggaactgagtcctgtgcagccttcatgcagcttaaaattatttagtaaagaaaccagtctcttcataagaaacaccccttcccatgccatgcacttggccttaggtgtctctgggtctaccaaacttaggtaagtttagccaactgtgatctaactcttacagaactattaaaatatctcatatcatcattatattgatgatatatctttggttgttataattttagtgaaaacaaggtagactggaaactccacttactcatctaagttccttttggcagattgaaaatgttcatgttgatgaaatcagcaagcctggaaacatacacactgtgaacaactgaaaaatcagaaaaaaatgttagcaaacatttaaaatgttagtaaatcatattagccagtattaattaaagattaccaatatgacgtgttctctacataggttatttttctaatgttcatgataacatgactaacatgtgaagagataaagattacctcaaacgtagtgagaggtaagctccttatcatgtatggtgctgatacgttcgtaagtgagatctctgaatatccttatgcaatatttatttgctgtttgttgagtttcttttgttgtggttattgttgtttgtttttgtttttgtttttttttttgaggcagggtttctctgtgtaagaaccctagctgtcctggaactagcttgttgagtttctactgcatgtaagtcacaatgctggcatctgcaaaagggagtaaaagtgaagagaactaggccgccgggtggtggtggtgcatgactttaatcccagcacttgggaggcagaagcaggtgaatctctgtgagttcgaagccagcctggtctacagagcgagtggcgagtgttaggacaggctcgaaagctacacagagagattaaaaaaaaaaaaaaaaacctccacaggtggtgagaactctcatgtaacaagagagcagttcacacctctgcctcagggccttctacgtcctgtgtgttggctttaaactctgagcacagagctaggctcaaagggttgaacacaggacatctgtgtcctcaaaggcccatagaccattgcagatacaggcatccagatggcttcaacaccccaaaggtctgagagcagggcaaagacagggtgtacccttcctaccacagtacccttcctgtgttcatgaagtaggaatagaccctctaaagcctatccgtgactttaaggaactgctgtttttaagtgggcgagggatgtgctgtaaatgatactgaggcggtgagggcaggcaagctgaggtgacaaacaggagtttgggctgaggggcgtggctttcggtacaacacttgccccacaagcaccagaccttgactcccgacactgcaaaaagaaatttcatgtctgacaagagtttgtattgagggtgtattgaggtttcagaaggtcaagggccagacactaattattctctagaattgagcacttaatttggaatatatccctaaacattcccattccctctgcttcttttcctaaatgagccttacaatggttatgactgctgtgaatgtcaaaggtcataatgacataaagctcctttagaacactgaatgctacctaaagggtagatatttcttatagccagagacagttgtccctggtcatcatactaacaattaccctccatcctctcccaaacttacagtcagaacacccttagtaaagatgtttatgactcatttataacaaaggacaaggagagacagttcataacaacaacaaaaaaaaaaaacatgtgcccatagtcagatgtcgaatccacttattaaatatctcaagtccaaaacaccctgtacgagttaagtcaggtcagcaagcatacgctcaagaggtacaacagacagtaaggcaggtgggtgtcaataacttacaggcatataaaaaactatccaagaagctcaagactgccagagatctaaaacctaataataaaatatgaaaaggtttacagtgtattttaggaatggtacaagaattcagacaggggaaggaaattcacaaatgcaacaaattcaagaaacatgaaaaggtcaagtgtaagtttcttgaagaagaaaatatgaacacatcgtgtttctaaccccgctatattaggccatgtgccataaccaatggccacgtgattaatgtctgctgaaagaagggaaagaggagagaggggcaagatggacggggagtaacttagagtggcaggaatgagaagcaagtgctggagtgagaagggaaaaaggaagggaaagagctctaatcaactcaaaccttccagtccttgagggttctggatagcaccgccaatgaagaaccagaaacatctccttaaatgggtgggcaggaaaattaccaggggttggggtgggatcacgggaaggtagtgctctattggaagctagaggacaattacgatgcattaatccaggctcagagcgatgcctctgagagaaagcattctcagtgtgtgctgcaacatttgtgatgacagagctggcctccgctgaactcttccctcgtagatgggagcatttatggggaagcaggacgtgtcttatccagggctcccctagtgagcactggccctagagatgccattgcttctgagtgatggactgggtagccacatgcagtttccgagggaaccagagcattatcacagcaagttggctcaggagaggaggaaaatgctgggcacgtttgactatgagtaagactagagagcacagacactccccaaggactccaggactactggaaagaaatcgccacaggctataggtcctccaaatgcactaggagagattttgaggtgagggaatattgctttgctgctgtgtgactgttacggtgactcctgggattctgatctggggaaaaaaatatgagacacagaaacaaagcaaacaaagttctgtcagggcatgtgacctggagtctgaacttcccttgaccctgacatcagagggccccagaggagtgatgtccccactgcttgctgcagctggcagcaaccagcatcaagagtcagccagccccaaagagtcagaaaacaagagctgcaatcaaacacttaggggaatacagacatcttccttgaggcaaagcacaaggtattgtgtaacagaacacagcggccttcatgaacccgtcctcatttcaaaaacctcggctggcagagttctgctgtgtggacctatcagcttgaaaacaaaaatccatactggaacagcaaaaaggaaaacaaaaggtgtgtgatatcttatttttcaaaacaacatcaacaatacacagtcctgcaaatggtactccatgctaagagcaagcctggaaagtagaatgtgttataaagggataaagggaaaatacagcaggggaatagtatccctccataggaaatgggctcccgaagcccatttgtacactagggataaatactggttccactgatagaggtcctatagactgcccaggcctcctaactggcacccacattctgagggtttggttcagtccaatgctggatccccagctttacgactgggatccatgtgctctcactaggtcaggtcagctggttctgtaggtttctccagcatggtcttgactcctttgttcatccttcctccctctctacaactgcattccaggagtgtggctcagtgcttagctgtgggtgcctgcttctgcttccatcagccactggataaaggctctaagatgacaattaaggtagtcatcaatctttttgagccattggccaaagggatcccatagaccttccccaaacatcatagggtgtttccattgctattggttaccctccataacctggcaataagactttattgctgaatacaccatatacttacatcatcaaacatggagaaatggagccagtgcccaagcagaagcttcacccctactgactgacatccacagtgctgaagagtgccatccatgctacaggaggagtgaccattggtctcacccaggtatgaaccttgtgagctacaacagttgaccgacagcaaaatatgcccactggtacaatggaggcactaatgttagggaagtaagtaaccacatttggattaagtttgaggtctgctccatgaactagaattcgtatctgacattgttaattagaccaagcacatgaggctagataggtcatgggccttaagggaaaacctaccactttcatcctgctaaatgagcataacaataaaaattcctgataacacgttgctatacacacagatcagctcatcacccagccctctccagagaaacttcttacagtagacgggagttaatacagcgacccacaactagacaatgtgtagagaataagagactttggagtcttcagtcctaactacattgtctatggcaaacctctccctccaaggctcagggatcaatatggaaagacagaagagtggtggtggacggttccaagaaaatagcattttctagacacaacaggagtgatgcaatatgaactcacacagactgtgacagcatgcacaacacttgcataagctcaggccagacaaaagtcccagcatggagaaggagaaggggccacaaaggtcccacccctaaccaggaagcgatttgaaagggatcccttctgggaaagggaaaattggggttttttcaatgaaataatactgggtatatcaaccataccccagggcacaccccatgctcagatgtagttggccaacacaagtcagagtccatctgtgtgtttgtgtggggagggagggggtgttttgtttggggtttgttttcctttttgtttttaagagggagagaatatgaagttggataggaagggaaggcagaggagactctgacgggatttaggaaagaagaaagactatgattaaaacatactgtatgaaataatcaaaaataaatattcattaaaaagcaatacgtccaggggctggagagatggttcagcaatttagagtactggcttttcttgcagaggagccaggttccattcccagcacccacttggtcataccagtccggttccaagggatcatttggccttcatagtgcccagatatgcaggcaaaacactcatatacataaaaaataaataaatcttttagagaaagagatcacccacctctatgagtgtaggcataggaaaacctgctttattaggagacaatgggaatgacaacactagcactccttaagacagagttacaaaatgaggcattgtgctttcttgcccttgaattatttctccaggagtaaaactagaacataatctgccgaactatgtaatgtttacggttttgtatcccaattgccatttgtttcaaaattttatgcattgaatactgttttgttggcttttagtctcataagacaaagacttacttattttaaaatagtgattccctttaagtcacccatgttagtaactgtgaggttcaagatggcactattgcatttcaatgttttaaaaacctgactcactttgaaacactagtagaatgtactagaaattcaagttatgtggtttatctagaagagaaaaagcaatctgtttagcaggagaaattttgcatgcacaaagagttaatgctcaaaagtgtcatctggggtgtcaggctatcctggtgtgaccccaccgtgcagtctcttctgtcgctggctgaagccttttggctgccaatagacgctattttctggagactttgactccttctctggctatcgtcccagaagtattgatcagctccgcatcactgcctgactccccatcagaatggcgccagggtgatctcaaacccacttgtcatcccagctgagaagactcagcatgcttaggagggcggaaaggcagccctaatatccgggtactaccctgtttccccttctcctggaggaaagtatgagccattcgggtagacagcctgtgcaaggccagcactaacggatggcactgcaaacactctgcggtgtagtgactgtactccccaccccagcgctgcattcactcaacagaagctgagacttaccattttcaggttcattgcgaaaatgcaaatagcatgctattccttgcttattaattatttgaaaactttagttgaggctgaaggcaggtaactaatggctgaactgaaaaactcattccagctcacttgagaacaaactgccttcccctgttcacttcctccatctgacagttttaaaacggtatttgttttttttttttttttagtcctaagtaatatagtctctctgggtattttctttgaggtgatatttcctggattgtgactattgtgctttcgtgttttacgtgttttactttcaaaggtctcggtggctaatgctgttcaatgaggattgctgaagggaaaaaacgcctgaggtcacttggtcagctgcctccatttgtccatttcttccattgttctcgatgctctctctgcagaataagctttgtggctctaacaatgtctacgaagatatcaaaagacccaaagacaagcagctctagactcagccaagagtctagagctatgcccacaaggaatagcaaggtcactggcccagtggcctccacagcaatgctgcttgacttggcaagtggccactgcttcctgggcaactgaggaactctgccaccagtgtctgttggcatgatagagacctaggagcttccacggtgctcagctctggactggaggtccctaagaggccgccctcacttccctgtgctactgcactacagaccttctcatgaaagagacctgatcttcatccggtcgcagctgctagacaaggtgtgtgttcccaagccacctgtgcacagatacacagcatctttactttaggtcaaagtattttatttagaaaacaaattgaaaaggaactatctgaatgtcccatcaaaattataaataagtttatcagccaatgagatatattatcttagtgttttattttaataaaaaatgctttatgcttagaattattacagcaggcctttcagcttgagtgctttccaaggtggaacactgaagtacatggttacctacatgatgacatgtagtaagaactgtacagtcccaagtccgtactgagaaatacctgtctttccccctatgtcacctgatcactgcctagaggcagcctaaacccacccaacactcaactatagaaagcaccacataatctacagctagatggcagtgatgtaggactttctaggtcactcttggacctcaaggattagggatgaagcccagcatcacaagaatttcccccatttcctgacgaggctccaatatccaaggagtttttgaatcttcccacaagctgccagaggctcctggggagacggagttatgcaagtaagtttccaggtcctaaccaatcaaaagagacccgttcaactagatgataaaagctattggtacggccaggcagtggtggcacacacctttaaggccagcacttggtaggcaacagcaggtagatctctgtgatttcgagaccagcctggtctacagagcaagtgccagaacaggctccaaagtcacacagaggaactgtctcaaaaaactcaaataagtaaataaacaagtaaatacataaataaacacaaatggatatttgaataaataaacataaataaatatttgaataaataaataaagccaccagcaggacaagggcaccaccagaggatcaaacaggcaagggataggctaagaatgcatgaccctctggggctcttcctagcgtcagaagttactcccaggacactttattcctttactcttttaggtaaaggagggttgcttacccaagggtctgtcttaattgtacagaactgctgttcaaactgaattacattactggttactttctctagttcttttttaaaaaatttcaaactggataccttgtttttcctggctcatctcaggtctccctatagaaatgaactaaacacatcgataacccttctgaagcttcctctattgaatgagactcatcagctcaagtgcctctggatggcaccacgtgtacatcagaggagtcctccaagttgtcgctcagggaagctagtctatgtcagagctccagagggagtggtgggcagtggcagcaatagtagacaaaggaggaagaggcccccatgagattaaatgtgggaggaaattgttaagaggtaaggaattgtgtctacatttcccagtttccggcctattgaatattaacaaaggctctcttcgtaattattacctgttataagtgggagactgggcactgagaaaatagcatgaaagtgtttgcaggcactgaacataagaattcccaggtacagagtctgcaggcctagacatctacagggattactctacatattgtgttagtttttgctgcaacacaaaagataccttgcacccaagagtcttctaggagtttagaaacttcagatcttgtgcgtcctgtctctagtgtaaaattaccatgccctgtgcccagtctctccctcatgctctctcactctgatgacaatgtgggaaatgtgtactaatctgcttggggaataaggaaacggcttaggaagaatacaatgtattccctgggaaactatttgagtttgctaaacagaaaaacatacagacttactctcaatcactctgaagtggtccatttcaggtcccttgtaaaacacagaaacacaacattgaatgtgtgtcccgacaagagctgtcgtttgagagctcaggtcaaacagagccaaacctacccaacaactgcctgctgtaaatcacaggtcacaaaacacatctcctatctgccggtgttctttttcaaaagcaaaggcaccaccgtgctttgcacatgaaacgaaaatgctatggaaatttacaagaaaagtataacagaaacacatggcttttcagaaactcaccctttccccatatctaaattcacctccatcgccattgtcttccccattttctaagctgaaagacctcaaggttatctctggctcctgctctccaagcccctactacctgaacaggctttctgttgctctcactcccgtctcacccagctgtctctttgtctgcagacatctctgcagtccttggctgcatagcacaccgtttagaggcatttattgactcccagacttaccattgattctctctgcactacctattcttgccctgtgacctaacaacacctcctgctttggtggcatcccactactaacagctatggtggcatcccactgccaacagctactcatttgccttccccctttgggatctgcagggttttccctttccaatgttcctttctccacctcggcagacccaagcagatggagacatcttgaaatcttacctaaacggcaaattcagttcatcaaaccttcttagaacctatctgtgattatctgcgtctgaaactgtcacttcctcaaagactgtgatttcctgttcctctcggccaatgcctcccattttccgcgcccaacctcccatatgtgcctggattccacagcttttgaattcactcaggacttagatatcacagtggtcccatcatcacattaaaggaaggagactctgcacacacacttcattctttagcagcatcagtggtaaagagctactgcgaactaacagactggaaaatcattgatcatttttcagatgccaaacacttcagttattttcggtggtttgaacagtttccccaaatgctttctgaagcctcctgcttctgcaaatgctggccaccctgttatctgttatataacccaccttctccattggccagactccatgccttttgctcacctcaagtagtctgtgagtctatctctgtctgacatgtaggggagcagtcatgcatatcctcccctgaatggcagataatttttatcacttaccttgaactgttacattttttctgtatacttcaataagctgcagatttcctggagagaagaattgggattcatctagagggacactggtgccagtgatgagtaaattatatgtacatcgtgaatacttcaaaatatttattacagacatgcagtgtcttatcactaataaagttatttggcaaaatggagtcactgagaattacagctcaattgcttttatacagagtttacacagaatggtatatgtttctattaagtatcttattttgttttttattctctcctgtcaatatactttttctcaggtaacttggcttgtctatccaagtatataatcattgtccatatatacatacataaacatatgtgtgtaaacatgtatgtacatatgtgtgtatacatattgaggcatggtcttacttagctcccactagccttgatctcattatatagctgaggataaccttgagcttatgatcatccagcctctacctcccaagtgctaatattatattataaaccaccacgtacacatttttccttttattaaatttgttctttcatgatttttatacctctatatagtccattctgattactgtcacgttttactctctgttatctccttcccaatcctatttctagacatgcacgcacgcacgcacgcgcacacacacacatccctttctcacatccacgtcttttgggaattttgtgatgcactgagtttagccagaatcctatgagtgaccctgggtttgggaccacccctcagagcatggaatgtccacccgagggtacacaaatggaagagtgtttgccctcctcaagaatccagcagtagcccatagtacagctgggatagtaggtcccaatctctgatgaactactgacaggcccattgtaggaagctacggtagctgtgagacaatggctgcttggcaatgtcatgcccataagatggacaacacacagcctttgtttgtgttggttttttgcttttgcccttacatttttttcatcatccctcctttagttcctccctaggcctttaggaagatggcatgaatgccctgttcaggaatgaacacctggctgtcagttattctcagcatcttgactggacaggtaactttgtgtttgctgctcctcatttgtaaagaaaatcttctctgattgagactgacagtagaatttgcctacaggtataaacataagtatttagaaggcaacttgatgcaccccaggccttgcgactgccaggcaatcccttccttgcattaaagagcaagctttctattttctgctacttccttcttgcatgaaagttttgtatgcccttagtgttctctctctttcttacctgaggcctcatacctgttaccacaataatctccttcaatccacagcaattactctgtttgggaggatcattgttggtttttagaacttttaatttcggttacgtctgtgtgtgtctctgtgtgagaatgtgaacatgagtgcaggtgcctgtggggaccagaagaggagctagagtgacaggcagtttgggactgcctaaagtgaatctcaagagccaaactcaatagcaatcgtagtttccactcttaaacagtgagccatctttccagccccctaaatcctattctaataagaactaggtatcactaagatactggcttctctttccttatcctagacccttaatttatatatgtgcaagattctcaccatctgcccatattctgtgctacttgctttattttccaactctccactaaaagcattgattgtgcttttttggcaaatgtctgcaaagatgcattccccagtaaccatgctagtatttagctccttctaattcttcattttcctggacttggtctgaacctttctggtttcccacaaaccggtggccatgtgactgcaagacttgggaggtgaggatgtaagaaggctcactgaagcttaagctttgatctttcacaagtttcctgctcttcttaaatcacctgattcaattgtagtccaaggcagaacagtctttacaagaacctatgaacataagataaaaatatcttctcatctttccaaatggaattccaggactctggtttcccttactgcacaaagataaatttagtttgtcaacaactgtttcagtgatactttcatatttcccgcatcccgttatcattaccacaatcatcatcatcacaatcagcatcagcatcactaacacagattgtagtctcactgtatttcaggcacttgttaagtggtttgggaatacccaagaaccacacccttatatagttttcaaacaagtaatcaaattatatgaggcatattcaaaatactttccaaagaagaggctaacattttccttctttgtgaagactatgagagccaaacagacctacctcaaaaagttgttctgcagcagatttacttggtaagtaccaggggaagccatctgtcattgcactgctattggcttccatggctcagtgccacagaattctattaaagcaaccccagtgttagaaacaaatgagctgctcctttcaatattaaaaggaagtgacttcgtggaagatatcggctgataaaatacataagaaagtgttagatatgtgaacaaaataaaggtgggaatctttaaggaggaaaaatgcctggattttgcctttcacctccaaataaagaataatagatgctcttagcaaacagagagagggaaatgggggtggctgggcttccagactaacacatcaactatacgctgtaatttcacttttgcaacaccacactcttgactctgtggcaccaccagtaaaaattcattttcaggcagcacacctgaacaacctgtgctttgccttaattcactttccctgctaaaagccaacaggagaggtagcctcgcctaaggaggatggacggcagagcactccattggaggaggccacacgctaaattaatcatgttccaactagaatttgcaattctttgagagatgttcaagatggtataaaaaattcagaggtagcagggaaaggagaggggctgtgaagcagaaggcatcagagggcactttaaatgtgaagggcgcatcacactttcagcacgtgtacaaggcagcctgtcttacccagaatgtgataaatgaggactcttctcctagatacgccatttgatgggaactcccctcccagaccacacaaattgcagattcaatgctcatactgctttagttttatttctgtttctgtgattaaaacactgtgaccaaaaacaactctagagaaaggtttatttggcttacaattccaggtcacagtctatcattaagggaagtcaaggcgggaacttaaagtagaaacctgaaagcaagcctgcttgctattccatggagcattacttctgaccagagaaattattccacagacaaagaagtgtggcaggcattgtggaagatgctgtttgctgtcagccaggcagccttatgctcagctagttttcttacacacttcatgatcacagtctaaggaatggtaccactcacagtgggctgctcccttccacgtcaccaaccgagatgatcccctactggtatgcccaagtgccaatctaatctaggcaacccctcaacagaaagtctcaattttagattccattaagttgacagttaaagtccatgcgagagtttggagagcagaaacataaaggagaaaagatgtaactatcaattcaaaactgtaaaatgttatttttcaaaagttaaccaggacatacgaatatgaaattcatttatcatgaattatcattgatgtgtctatttgcaaggatagggtcagtctggtgataagctctccttaagagaacatagtctgactaagtaaaccagtcttaggagtattgcagtcttctagtttaaaactccttccctgaaaatgctgttacaaaaaccactttctttcccaacttctagaattttcacattgtaccattgccttcaccactgattttcttctatctgaaagcttccatttgtggtctcctcctgatgcatcatgagttgagatcttgggagggttttcacagcaaacagatcctctagaattattcctgtattttaaaggttgaaagtaaagcaatggggccaactatggagttcagcaggtattaaatgcacctgccaccaagtctaatgacctgagttcaacccatagggcagaaaaatagaactgactcccacaagttgtcttttgcctccacatggattccatgggatgtgtaagagcatgccaacatgcatgcacgcacatacacacggatataataagtgtaataatattttaataagctctctccttccacttgagaaagtgaggctccttgactgactcctgggaaatgtgacttctatatggaagcctctcctaacacaactccccttagaggcacatgagatctgcccctcaaactcacattttacctgtcttcaagcttccatttagttcctctactacgccacactcctcaaactttacacaggctgttggccgtcttcctggcatactgtccattccatgaataccttcccaaggcctaactggtctctagccttcagtcccaatggaaacattattgctcacaaagaacacatagtatctgtgccctgcacttaacccagtatttctacagttaccacagcaacacacatagcctgctctgtaacactgaccaccacttactcaaattgacgcccatagcagatggggaaagctactggggctgtgggtctaatttttttttttttgccaatgcaaacacatagcaggtatttatcacatggatgaataaagacaagaatggcatttgattcttctagctgctagtgtggtagctgaaatctaattagcattcagcgaaatactctggattaaatgcaggactaagaacccaagaatgtcagctgaattcagcagtaccctgagtcagctgggaaaagtcttcctaccctggttcctgcctgatctctcagtgggcttcttgctctcgccttggctcagatgaaagctagaaaaaaaaaaaggagagaaaaaaaacaaaaataataatatgcaatggaaagcaaactgccacattcaaaaacaatattcttctctgttccttacaattcctaccgttgaatgccacccctccccagaggaaaggatcactggaaaaacactcgtaaggaaaaaaatcaccacatttttttaaagtgtgctatttaaattctcactcatgaatatgtagctaatattgactaatgggaaccctaaaaggaagaaaactaaggctttttaaggcaaatccattgaaattaaggtcatctgtaagaaatttgtttaatttttttctgagccacatccaaaactccagcgggcacgttaaataatgaaagtataaactattgggatttggtgctggttagtatgttggcacagtacatagatccctatgtgatttaaaaaaaaaaaaaactaaaattttctctgcttcctttatctggaagcctccacaattaaaacagttttcttcatggagtaatacatgttaaccaaattatactctaatattttcattcaacgacttggaaagtcataaaaatgcttgtgtggggagttgccatgcagaaggagaaagaaagcaccatatcaggaggattttaaaaagagagagataaaacaaagagttccaaggattgtcacaatctgatctgcataaataaaagataatggcttcagtgcgctggccaacctttctgtggagtgatcggtctgtggagagtcatgtctgagaggctgcaggtcattatggcaggataaagcctatttctcatttatattaaagcaccttgcctgttaagggcttgatttgaatctcagacgtaaatgtgcatggggctacacaccttgttaagtcaatggctacatatgcatgctctccctaatacacagatagatttcagcatccacagccccaccattactccaactattcttttcttgacttagaaaagataatatttaggtagatcagaagtgctcaaatggacaggattagagcatacatttttctcttgacacagaattttttttctaattttgcatagaagaaacaaatttcttttcccttaaatgagatttgctacatcaacagaagaaggctaaactgtttccagttctgttttacatgtttgatttatctgattatctggtttcaggcaagatgaattgttccaagttagcatttggagactttgaaatgaaaatattgacatttaaaaaattcaataaacaaagcccaataacaacaaggaagtcaaggaaaactatagcccagtggactcaacctccttaatgctacaaccctttaatacagttcctcatgttgtggtaacccccagccataaaatattcttgctgctacttcataactataattttgctattatgaaacatattgtaaataactgttttttgttgagatctgatatatgacctcccaaagggtcatgacccacaggttgagaacccctgccgtagccccttgaattctttttttaaaaatgatttgtttttattttatgtgcattggtgttttgcttacttgtgtgcctgtgtgagggtgtcatatctcctgcgactggagttagagatagttatgaactgccatatgggtgctgggaaatgaacccaggtactctaggagaataaccagtactcttaacccctgaaccatctctccaactccacccattgaatttttaaaggagttgtgaattaaaactgaataacttctttggctaagaatctgagatggctgtagttttaatgaaagctctaccttcaatgcctttggatcaaaaggcacatatcacttcattcaggcatacttaagccctaatgagttgattggcatcagcaatccaaaaaattattcagacactgactttcagataaaagagcaacagattaatcttgactatagtaataatataacctgatagaagttttttgaacagaagataaagtctctcaatgtagcctcctcactaggctgatgatgccatttggcttcactggttcacagtttcttgcatttcctagtggatgaggtagtaggagttgatccaaacctatgaaaaggtagttctatagaaaaatggacaaagaaaggaataggagctaagacagggtggtgctgtggtcttcaaacaaaagtctagagaaatcaagaagagccagacttataaataatggggtgacttgtaccgaaaagtatcacaggatggttttagggggtctctggaatacagataaagggctcatgctgtggagtgctgtcaaatctgtgatgtgtgtgtatgaaagagaacacaaacatattccataagaaggggcctgtgtttcaatgaggatgctactgccccttgaaataggttttggaaattgggtcaatcatttattaacataatggttgggacattactggatcatcctagacaaggggcagggttctccctgtcttacagtggacaaggaagactaagtctaccccccacttgtcacatcatcacaatgatgaacacttgttcattcaccattatctagttttctcttataaatgcacatttagcatcacttgtctagttttaatattcatggacttctagagtagcagttataaacccaatcaagggcatgccatgtgtgtattcagatttttatcaagaggattcacaattttgaataaaaaagcatatctctcatgatatttgattaaacaatgcaatattacaacagtctttatggttggaggatttatagtgattccatatatgagtcagatgtcttttcagagaagattcctggcctctcctttataatgaagttaaggtgctattttaatatttatattccagtagtgcagaatgttatataaaagtagaactttggtcatctcattgtccagaacactgatctagggcaaaaatagtctgtatgacaaaggaagaaaatagaagctctcaacagacttaatgggaagaactgtcctttctgagtgtatctcaaagtgatgtaaattttaaggaaaggagaaaggcacacatgtatggttcctgagggcctgtgcgtacacagccattcccccactagatgttaagttaaggcaaaggcagggactgtagagtacatccctcacttggaaacctgggaagacactgctttgccttgtgtctcacgcagaacaccataataccagcagaatagacatggcagtgtggctcatacaggcagcaagtaaaaatggtggttctaagattgcttatgctacagacagatcacatgatagaagctagacatatataggtattcttggtagaggaactggatggcaccaggggtagcaagccagaaggttatctggagctttccctgttaaagttaaggtgcccctgagtcaggacctataggatggatagtcaaatgttgtgtttcatttgtttatgctgcatttgtttaactgtgtaaagatgtgttgctgtttcaccttgcctgtctaaagcacctgattactctaataaaaagttgaacagccaatagttagacagaggagggataggtgggcctggcaggcagagagaaaaagggagctggtcagccaggcaggcagacaaagaggaagcaggaaagtagggcatacagaatgaaagaaggtaaaaatccccaaggcaaaacatacagagaaacaggttaaattaagttataagagctaatgggacaagcaaaagataaggcagagcattcagaattaataataaatctccgtgtcataatttgggacctagcagtccaagaacgtctgctacagtcaaatgcggtaagatgtgacagggtctcgtgctatggctgagatgtacttacagccccagggcagcaatccctgaccgctctaagagaagggatcaccacagcagagccatggacactgaagcagtttgaatcaggggcatctccaaagtggccagcttacacacccaagaaactactgtggtgtcccaaggtctcttttcatacccagaagccatcctgcacaaagaacaagagcccagacatcaggagagcctgagccaggtccaggagtggcggaaagccaattagaagctgagtgactctggagaggtgtggatactttgcatgaccacgtttaagacttctcacaagggcaaaaactcttccctactcagctggataccaacaacaaaattaaaaaaaaaaaatcaacctttaaaaaaaaaaaacgactcagttcaccaagttttgtatttgtgtttagccttccatggatcagaaactggtcaagttgatcttgtactaaaggaactagaagggcatttcatttatcctgaacctaagactataaaataaaaacaagaataagaatgccatctactggtgtggaaagtagcaagcctctaataagtccgcagtgagcaaaagagaatgaaatgttcctgttattttacaatggagataaaagctagagaatggagtcttaaataactgaagtaataaagggcgtaggcaaataaacctccccagctggtagatctttcacggtatctaagttctgtggtgttccctaccgtgggttccgctctgacccagaagacaatgttaaagtggcataaagcatttcctttactgacttgttacaatgtttgaaaacaaactaatctcgaacttcatattttagttgttttgtccaggcagatagatggaaaggcatgtgactgtcctctgtttgttttcctggacattggcctaatgccgagctcttcgcacatttttgcagaagacacaccaggcatgagtgaactgtgtgttcagtgctcagtgctggcctctgggcacgtgttcatgtctatggacatcttcacgtggctggagatgcatttgtcaccatttcaaattgaaatattatgtctaatcacttgttatttcaaaatccttttcaaatcatgatatttcattagatatattcattaaaatgtccacatccccagggcttatttgattgagtataaatatctcattgttccagcaccatttacagaaaagataaaattatccttttcccaactaaacagctttggcacatttgccaaatactaattgatgaaatgtgtgggcagattcctgggttttatattctcttccataatttatttacctgttcttcactcttttgataatgatatctttatactaagtcttgaatcagccattgcaaatcgtctaaatagattcttttccaagaatttttaaaaatctatttttaggcattttgcagtcccatataaaccttaaaatcaccttgtaaatttgtgcaaaaatgagctgtgggaatcaattgagattgtgttgtgtttctaagttaattagtggcaaattcatcaataatgttgaggttttgtgtattaatagggtatgtctttacaattatgtgggtcctttaaatttttatgaagaaattatttgtaacataaaactcaaaatgaatccacagactaaatagaaagattaaaattataagcattctgaaatagaaaaagaaaaaaaaagacttcatgatcttgggtttggcgaaggtttcttcaatattataagaacataacacaaactatgagactaaataataagtaggacttcatcaaaatcacagaagagggggcagagagattttaagagccagaggcccaagacatctgctgctaggaagcttagtgactcctacccaccacagagaagccacacccaggaaatcccaaggttgcctaaagaagacttgtataatgacaacaccagtcgccatgccaacatggatggggagttttcataagcttctgtgcctagagaaaggactgcaggcgatcaatgacaactgcgaaagggccaatcagttttctcccaggacaatcccccagataggctatccaaccctaagtgatcagccctaaacacaagtatatataaacaacacagactcagtaggttttacatttaaatacacttcgtgtgtgtgtgtgtgtgtgtgtgtgtgtgtgtgtgtgtgtgacaataatagtttgaaaagaagaggtcatgaatttaagaactagtgggagagaacagagagataaacagggaggcagacataatgtaaatatagtgctcatacatggaattctcaaaacaaaaacaaatcaattaaatgaagacttatactcagaaaatgtaaatgaaatagaatcctatcatattattttgtgagcttgaaatgaattagcccagatgaaaaaaattaaaatgtaattcttcagaagacaccattagcaaaaaatgaaaggcaagtcccaaactgaaagaaaaattttgcaaaacataaactatctacaaaaaagaaacttatctggctggaaagatgatgcagcagttaagaataattcttgtacaggccatgccttccagaaaaccagatgggctaccaatagaacttctcctctctctgttcccctagacccaatccctcagtctcttcactagtcctgcaacagaccactagctgtaccctcctgcccccaattccctgtgggtcccacagactatcgcctcctaacccacctcccccaactgtctctgcatcccagtctccaacaccagcaggctttccctgtgaacacatcagctgagcaggtcaggaaaacaggcaggacatagccatctcacttacagaaaatccagaggaaacagaaatcaaggaacaaaacacctacccatcaaagacaaatcagcacctaggcctataatcatcccaaagccagatgcctagataccagtgtaaaaatacaacaaataaaagccagggcaatatatttctactagagcccagctatcctatcatagtggccctgaatatgtcaacagagctgaagaacaagaaaatgaccttaatgaagatgatagaggtccttaaaaattaaatgaacaaatctcttaaacaaatacaggaagacacaaacaattggaggaaatgaataaatcccttcaagaaagccaagaaaatacacagaaacatttgaagaaaactaataaaactgttcaagacctgaaaatggatatagaagcaataaaggaaacacaaactgagtgaagtctggagattaaaaaaaagttaagaattgagagagtgcggaggtgaggtgcttcaggttctgccttgggcccaacttctgcctgcccaccctggcaaatcccacccaagggtctgcaataggacgactcgacccctgaggaccaagcaacccaaagtctgctgacatctctgtgccagtgctgctctcacccacctggagagcgagtgcctcagacctgcctgctcctaacttgagacccatcagagtatcaaagtcaattgcacacacgtgaagagaatgccggacctatacacacctggaaaggaagtaacaccaactgtacccactggaacaagagatgggaagacaacaatataagaacacatccaacaacaggaaaaacaatatgacaccactagagtctagggactctacaccagcaagacataaacctcccaacacagaagcagcagaagagagcaaccttaaaaacaacttcatgcagatgatagagaacctaagagaggaaatcagaaaatccttcagagaaatggaagaaaagacaaacaaaagatgcaagaaatcaaggaaagcagaaaaaaaaacaagaaaatacaattaaacagctgaaggaaacagttcaggacctgaaaactgaattacagacaataaagaaaacacaaactgagggaatgctggacagacaataaagaaacaacaaactgaggaaaagctggaagtggaaaagctgagtaaacaatcaggaaccacagatgcaagcataaccaatagaatacaagagatggaagacagaatctcagatgctgaagacaaactagaggaaataaactcgtcaactaaaaatctgaagtctaacaaatccgtaacacaaaatatccaggaaatatgggacacaatgaaaagaccaaacctaagtataataggtataaaagaaggtgaagaaacccaactcaaaggtgcagaaaacatattcaacaaaatcatagaagaaaattttcccaacctaaagaaaggcatgccaatgagtgtacaagaagcctgcagaatgccaaatagagtggaccacaaaagaaagtctcctcatcacataataattaaaaaccaaacatacagaataaagaaaaaatattaagagcaacaaggggaaaagaccaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattaactacactcgcataaacataggcaatagataatcccatgctacaaaaacacaaaataaaaggcaggataaatcctcatacaataccaataccaacaacaaaccaaaaacaaacaagaataaacactcaatggaccttaatttccctcaatattaatgatcttaactctcctataaaaagacacaggttaacagattggatatgaagacagaatccatccttctgctgcatacaagaaacacacctcaaattcaaaggcagacattacctcagagtaaagggttgggataagatactccaatcaaatagacccaagaaatgagctggggtagctatccgagtatctaacaagttagacttcaaactaaaatcaatcaaacaagatgaagaaggccatttcagattcatcacaggaaaaatccatcaggaagaagtctcaattctaaannnnnnnnnnnnnnnnnnnnnnnnnnnnnnnngtaaaagaaacattattaaaactcaaatgacaaataagacctcacacagttatagtgggagacttcaatacccgactctcaacactggacaggaccaccagacagaaacttaacaaagagacaaaggaactaacagaagttatgacccaattgggattaacagacatttatagaactttctatccaaacacaaaagaatataccttcttttcagcatcacatgaaaccttctcaaaaatcgaatacattctcggcaacatagcaaatctcaacaggtacaaaaaaaattggaataatcccctgtgtcttatcagaccaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaattaaccaaaaggcagagagagatcatgcaaattaaaaaaatcagaaatgaaaaggggaacctaacaacgacactgaggaaatccagagaatcctcaggtcattctttgaaaacctgtattccaaaaaatttgaaaatttaaaggaaatggacaattttctggacagttatcacttaccaaaattgaatcaagaacagataagcaacttaaacagacctataacctctaaggaaatagaagcagtcatcaaaagcctcccaaccaaaaaaagcccaggaccagatggattcattgcaaaattctaccagaaattcaaagaattgctaataccaatactcctcaaattgttccacaaaatagaagcagaagggacattgccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccatataaacagactgaggaaaaaccacatgatcatctcactagatgtggaaaaagcctttgacaaaatccaacaccccttcatgataaaggtcttggagaaatcagggataacaggaacatacctcaacataacnnnnnnnnnnaagctaacagccaacatcaaattaaatggagagaaactcgatccaattcctctaaaattggggacaagacaaggctgtccactctctccatacctcttcaatatagtccttgaagtcctagctagagcaataagacaacaaaaatgagatcaagggaatacaaatctgaaaggaagaagtcaaactctcactatttgcagatgatatgatagtctacattagtgacctgaaaaactctaccagggaactcctacagctgatannnnnnnnnnnnnnnnnnnnnnnnnnnnnnnnnnnnnnnnnnnnnnnnnnnnnnnnnnnnnnnnnnnnnnnnnnnnngatgacacattggtggagaaagaaatcagagaagcatcaccctttacaattgccacaaacaacataaaataccttggtaacactaaccaaaaaacgtaaaacacctgtaccataagaatttttagtctctaaagaaagaaattaaagaagataccagaaaatggaaagatctcccatgctcttggataggcaggatcaacatagtaaaaatggcaatcttgccaaaagcaatctacagattcaatgcaatccccatcaaaatcccaacacaattcttcacagaccttgaaagaacaattctcaactttatatggagaaacaaaagacccagggcagccaaaacatccccatacaataaaggaacttctggaggcatcatcatctctgacttcaagctctattacagagctatagtcctgaaaacagcttggtattggcacaaaaataaacatatagaccaatggaatagagtttaaaaccctgatattaacccacacacctatgaacacnnnnnnnnnnnnnnnnnnnnnnnnnnnnnnnnnnnnnnnnnnnnnnnnnnnnnnnnnnnnnnnactggatgctggaatgtagacgccttcagatagatccagatctatcaccatgcacaaaacttaagtccaaatgaatgaaagatctcaatataaatccagctacactgaacctattagaagacaaactgggaaatacccttgaattaatcggtacaggagaccgcttcctgaacattataccagtagcccagacactgaggtcaacaattgataaatgggaccctctgaaactgagaagcttctgtaaggcaaaggaggcagccagcaagacaaaacggcagctgacatactgggaaaagatattcaccaatcccacatctgacagagggctgatctccaaaatatacaaagaactcaagaagctattctcaaaaacaccaaacaatccaattaaaaaatggggtacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatggagtactactcagcagaaaaaaaaacaatggaatcttgaaatttgcaggaaaatggatggatctagaagaaaccattctgagtgaggtaaaccaatcacaaaaagacaaacatggtatgtactcactcatatgtggattttagacatagagtaaggattaccagcctacaattcacactgccaaagaagctaataaacaaggaggcccctaagagagacatacatggtcccctaaagaaggggagagggtcaagatctgctgagcaaattgggagcacgggaagaggggggagctaggagcatgagaaagggagtagaagagggatgcagaggacatgagggagcagaaaatttgagtcaggggaagaatagatgataacaagaatggaggtatcataagagagaaagagagagattttaggtttacagagaaatcagccactaggaaaaggtctggagatctacaaggatgacaccagcaaacaatctaagcaacggagaagaggctaccttaaatgccctcccctgataatgagattgatgactgacttatttgccatcctatagccttcatcgagcagctggaggaagtagaaacagccacccacaactaatcaccgaactgaactggaacccagatgcagagaaggataagtgaagagcacaggggtccagaccaggctggtgaaacccacagaaacagctgccttgaacaagggggaactcttgctccccagactgatagctggaataccagcatgggactgatccagaccccaggaacatgggtttctgtgaattatttttcagaaatctacggcgcctcctatagaagtttactacttatccctagcataggtgtggactttgggagcccattctgtatagaggaatactccctgagccaagactcatggagttgggcctaggccctatcccaaaggatacaatagtctctgatgacatcctatggaaggcctcaccatccagggggagccgaaaggatatgtgataggtagggttttagttggtgatgctggtagggcaggactggcaagagaagggaagtgctgggattgttatgtaaaacaacactgtttctaattcaaattttaaaaagttggaaaaatatagagcacaaacacataggaaattccagaccatcatgttttaaagatatttttcaaaacactgaaattcctttgtctaaattattttttaactagggaagactttaaaggtcctagctttaaatatagagaatggatgtcttgtggaatggaacaaacttgaaaataaaatatttttctgacaataaaaaaaaattaagaagtcaaacaggagctatagagtcaagcttcaccaacagaatataaaagttggaagagagaatctcaggcattgaatatacaatgaaagaaatggatatatcagccaaaacatatgttaaatctaaatcaaaaaaaattctgatgtaaaacatctaggaaatctgagacactatgaaaagaccaaatctaagagtggcaggaatagagaaaggggaagagtcccagctcaaagacccagaaaatattttcaacaaaatcatagaagaaaaattcctaaactaaaggacatgcctataaaggtacaagatgcttatgaccaccaaaaagattgtaccagaatagaaagtccccttggtacataataatcaaaacactaaacatacagaagaaagaaagagaattataagatgcaagggaaaaatagcaactaacctacaaaagcagatctgttagaattacacctgatttctcaatggagactctaaaagccagaagggcctcaacagatgtgctgcagacgcctagagaacacagatgccagcccagactactgtactcagcaaaactttcaatcacaataggtggagaaaataagatattccatgataaagtctattctaaatatttgtcaataaatccagcccatagaaggtattagaatgaaaactccaactaaaggaggtcacctacacccatgaaaacagaaaaagtaatctcacatcagcaaaacataaagaagagatctctctctctctctctctctctctctctctctctctctctctctctcatgcacacacatacacacacacacaccaccaccaccacccacaacaacaacaacaacaacaacaaccacaaaatcataggaaacaacaatcattggtcattaataactctcagtatcaatggtctcacttccctgataaaaagacacagactaacagaatggatgtaaaaacaggatccctcttctgctgcatccaagaaacacacctcaatatcaagggtagacattacctcagggcaaaggattggaaatatatgaaacaaagggacccaagaagcaagctagtgtaacaattttaatgtctaatataatagactttaaaccaaaactaatcaaaagagctgggaaaggacactgcatattcatcaaaggaaaaatccatcaagaagacatttcaattcttaatatcttccccccaaacacaaagacactcgagtctgtagaagaaacatgactatagcttaaattacatacagatcttcttacactgatagtgggagacttcaatcctccactctcaccaatggagaggcatccagacaaaaacaaaacagagaaatgctggacttaacagatattatgaaccaaatggacctaccataactacagaacatttcagtcaaacacaaaataatatattcatactcatggaattttctccaaaactgaccacatactcagatacaaagcaagtctcaacaggtacaagaaaattgaaataactccctgaactctatcataccatcatagattaaagctggatatcaatggcaacagaaagcttacaaattcatgaaaactgaacaactctctactgaatgaaaaatgggtcaagacagaaataaaaaagaaactaaagacttcctagaattcaataaaaatgaatacacagcatatccaaacatttttaacactatataggcagttctaagaggaaagtttgtagtactaagtacctacatttaaaaataaaatggaaagatttcatactagaaacttaacagcacagctgaaagctccagaaaagtggttctcaaatttcctaatgctgttaacctttaatacagtttttcatgtcatggtgtctctcaaccataaaattattttcattgctacttcataactgcaatattgctactgttatgaatcctgacataaatatctgatatccaggatgtatgagtatccataacaatattgtgttttgatatgatggccctcaggaaggacccctacgaaagggtcatttgaccccctaaatgggtagcaacctaacaggttgagaaccacttctctagaacaaaatgaagtaaatacactcaagaggagtgtatagcaagaattaatcaaactgagaacagagatcaataaaatagaaacagagaacaatacaaagagtcaatgaaacagagctagttcttcaagaaaataaacaagatagaataacccttatccaaatcaactaaaagactgagagagaatattcaaattcacaaaatcagaaatgaaaagggtacacataacaacaaacaccaaggaaatccagagattcataaggacatactttaaaaacttttactccaccaaattggaaaatctgaaagaaaaggataattttcttgatacacaccacttatgaaagttaaatcaagatcagataaacaatataaatagacctataacacctagtgaaatagaacaagtcatcaaaagtctccccccacacacacctcaaaaaaaaatatctagggccagatggttttagttcagaattctaccaaactttcaaagaatagttaaagccaacatccctcaacatttttcacataatataaacataaagaatgcttatattcctcattttataagtccacagtagcctgatacctaaacaaactgaaagaaaaaaataaaaacatgatcatcttattagatgccaaaaaagcctttgacaaaatccaacaacccttcatgttaaaagtcttagagagattagggatacaagaaacacaacaaaggcaataagtaacaagcctatagccaacatcaaattaaatggagagatactcaaagcaaatccacaaaaatcaggagcaagacaaggctgttcactatctctatgtctattcaatatagtacttgaagttctaaatgaagcaataagacaactgaaggacattaagtggattaaaattagaaaggaagaagtcaaaccatcattatttgcagatgatatgatagtatatttaagtgattataaaatttccatcagggaactcctacagctgataaacactttcagtgaagtgctggatataagatttacaaaacaaaacaaaataaaacaaaaacagtagccctcttctatacaaatggcaaaccgactgagaaagaaatcagggaaacaacacctttcacaatagcctcaaataatataaaataccttggaatgactctgaccaagcaaataaaagacttgtatgataaaaaacatcaagtctttgaagaaagaaattgaagatatcagaagatggaaatatctcccatgtacatggatctgcaggattaacatagtaaaaatggcaatcttaccaaaagcaatctacagattcaagcaatccccatcatacttttaacacaattctttacagagcttgaaatgataattctcaacttcatatggaaaaacaagaaacccaagatagctaaaacaatccagaacaataaaagtacttttggatgttttaccatttctgatttcaagttgtactaaagaaatataataataaaaatcacatgctgttggcataaatacagatatgttgatcaatgaaatagaagtgaagacccagacataaattcataaccattaggacacctgtcttttgataaagaagccagaaatacacactggaaaaaaagaaagtatcttcaacaaatggtgctgggcaaacgtctacatggagaagagcacaaatagatccatatttattgccctccacaaaactcacatccaagtgcatcaaaaacctcaacataaaatctgagacattggacctaatagatgagaaagttgggaatattctttaactctttggcataggaaaagaacttctgaacagaacactgttaacacttagacactaagatcaacaattataaaacagaaccttgtgaaactgaaaagcttctgtacaaaggacaccatcaatcagataaagtgtaagtgcacagcatggaaaaatattgtttccaactccacatctaatagagggctaatatccaaaatatgtagaaaacttgagaaactatataccaaaaaagaatctaattttaaaatggggtatagatttgaacagaggattctgaatagaggaatctcaaatcgctgagaaacacttaaaatgtccaacatttcctgatgttagccatcaggaaaatgcaaatcataatgactctgagatgccatcttacacctgtcagaatggctaagatcagaaacacaagctacagctcatgctggagaggatgtggagtaaggggaacactcatccattgctggtaggaatgtaagccactatgggaatcaatatggtggctcctcagaaaattgaaaatacatctacctcaagaccctgctataccacacttaaagcatacacccaaagtcactccatcctaccacaaggatacttgctaaaccatgttcttttggctttattcataatagccagaatgaggaaataaccaagatattccttaaaagaagaatagataaacaaaatacgatgcatttacacaatggaacattacttaaatgcttaaaaaacataacatcatgagatttgcatgcaaatgagtgaactagaataaaatcatcctgagtagggtaagcctgacccacaaaggcaaatatgttatgtattcacttataagaggatattggatattaagtaaatgacaaccaagccacaatttgtaaacacagagatgttaggtaaagagtttagttgggtctccctgggaaggggaaatagaataagttttattggtagactgggggcaggtgtggacaggagcaggagggggtaggtgggaaggagatggttggagggagagagtgctggaaaagatggctgaaattggaagggttgtggaaacctggtacagtggaaacttcctgggatcttcgaacattgatcctaatgaggactcctagtaatggtggcgagagtctcaactgtctatctctcatatccaggcaatgtgtccagtagaggaactgtgttgcattcaactgagttgttggccaagggggtcccatgaaaatccccaaacaacataagctgatgctaagacaaaagagttgctcttcccaaactgacagtggggtcccactgccaaggataacatccacacaatgcactgaacatggaaaagttgagctgatgtccatagaaccctcaccttacattctagtctctttggtgtgggaagatactctgcaggctactgaaagagaaatgtggacaccaatccagccacaaaatctttgacctacaatatttcttacctataaaatatgctggggcaatggtgacacataacttgtgagagtagccaaccaatgtctgatttgacttaaggcacattccacttaagaaggaacccatatgggacgctgcttgagtaaccaagaaccggagactagacagcccagagacttagagtaaagcccaacatgactaacctaaaaaaacaataaaatgattcataatgatattctgctatagtcatagatcagtaccttacccaatcatcatcaaagaagattcctccagcagcagatggatgcagatacagaaagccagagtcagacattctgtggaaagagagtctaaactagaggtctccattgggttcctcccctcggagcttagggaatcctatgaaagaggaggcagaaagactttaagagtcagaggagacggaaaaatcaagagaacatgacactctgaaccaagtaagcaaggcacacatgagctcacaaagccggaagcagcaagcacagcactgacgtggctccacagcagctgctctgcatatatataatagccgctgttagcttagtatttttacatggctgctgattatgagaacaagtgggtctctggctctcgcgcctgctcctgggctctttgcttcctgtggggtttccatgccacactccaatgccagagctttcacttcatcttagtagattttttgtcgtttggttgttttctcttagaagcccgttcttttctaatgagagattgagagatggaaagggaggaaggtgatgaggaactgggtggatggagggagggggagctagaatcaggatatattatatgagaaaagaactatcttcagcaaaaaagaaaataaatcatataaattctctgataaagaaaataccacttgttcttatagggaacccaggttcaattcccagcacgcacatggaaattcacaactccatttccagggtatccactaccctcttctggaatctatgggtatcaa
